United States Patent 11,098,302 (IDENTIFICATION OF POLYNUCLEOTIDES ASSOCIATED WITH A SAMPLE) - sequence listing, part 34

SEQ ID NO: 114398 - DNA, 613 bp, Homo sapiens
  misc_feature: GYAE6OF02HL4QL.15.86.H09.1.454.CMB.1.raw
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttggtaaagccgtgggggtcccttagagtctcctgtgtggcctctggattcactttcagtaatggcggatgagttggtccgccaggctccgagggagggctggagtgggtggacgttacaaaagtaaaatgagtggtagagaaatagactagngcaccgtagaaganatcacatctcaaganataactacaaacgtacgtagtatttgactaatacgaacagacctacgaaaaccgagacacgagccgtactacgtactacgtaaccacgtagtactcggaagtcgactaagtaccgaagtaacgggtaggtacctaagtacggttacgttttagaacgtttagtccggttacgggggaccccgtaaggggaactacggttcggttaccgg

SEQ ID NO: 114399 - DNA, 667 bp, Homo sapiens
  misc_feature: GYAE6OF02GKOES.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccgaggctccgaggggaaggggctggagtgggttggacgtttacgaaaagtaaaatgaagtggtagaagaaatagactacggtgacaccggtagaaaggagtatacacatctacaagagtaataacttacgaaaaacgtacggtataagtttagactaaatagaaacacgacctaaggaaaaccgaggaacacgaacgccgtacttaattactacgtaccacgtagtacgtttacgggaagttcggactaacgttaccggaaacggttaaaagggacgggtactttaagttcggtaccgttttttaggaacgtttacgttccgggtaccgggggtacccctaagggggtacctaagggtttcgggg

SEQ ID NO: 114400 - DNA, 617 bp, Homo sapiens
  misc_feature: GYAE6OF02HBY0L.15.86.H09.1.454.CMB.1.raw
  modified_base (445)..(445): a, c, t, g, unknown or other
  misc_feature (445)..(445): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccaggggaaggggctgggagtgggttggacgtttacaaaagtaaaatgatggtagaagaaaatagaactacggtgacaccgtagaaaggaagattacacatcacaagagataatacaaaacgacggtgtaatttganaaatgaacagtacctaagaaaacccgaggaacacacgaccgtacttacttacgtacgtacccaagtagagtttacgggaagtcgactacgtaccgaacggtaaaggacggtacttagtgttacttttagaagttacgttcggtaggggaccccgtaaggggactaagtcggg

SEQ ID NO: 114401 - DNA, 714 bp, Homo sapiens
  misc_feature: GYAE6OF02IB7ZB.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatggaggttcgggtcccgccgaggcctaccggaggggacggggcgtgggtagggttggggttaggttacgtttaacgaaaaaggttaaaagtgaagttgggtagaagtaaaagtaggaacgtacggtcgaccgtaccggtaaggaaacggtaagtactaccaccattacacaagaagtaattaattaaacgaaaacggtacggttagttattacgaaactaaagtacgaaacgacgtaccgtaaacggaaaaccgaggaaccacgaccgtaccgtacttactttaacgtacgtacccaagtacggtaagttaaccggtagtacggactacgtacggtaacggtaaaggacggtcttaaggttcgttacgttttagagtttacggtaccgggtccgggggaacccgtagggtaaccgtaggttcccggg

SEQ ID NO: 114402 - DNA, 609 bp, Homo sapiens
  misc_feature: GYAE6OF02H16GC.15.86.H09.1.454.CMB.1.raw
  modified_base (518)..(518): a, c, t, g, unknown or other
  misc_feature (518)..(518): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaagccgtgggggtccctagagtctctgtgtggcctctggattcactttcagtaatggctggatgagttgggtccgccgaggctccgagggagggcgtggaggtgggtggtacgtttacaaaagtaaaatgagtggtagaagaaatagacgtacggtacgacgaccgtagaaaggagtattacacatctacaagagaataataacgaaaacggtacggttagttaatttagaactaaatagaaacagtacctaaggaaaccgaggacacgagcctactattacctagaccanagtacgttacggaagtgactactacggaacgtaaggcgtatagttgtacttttagattacgtcggtacgggacccgtaggactagttcggg

SEQ ID NO: 114403 - DNA, 627 bp, Homo sapiens
  misc_feature: GYAE6OF02GCQDQ.15.86.H09.1.454.CMB.1.raw
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtgggggtcccttagagtctcctgtgtggcctctggattcactttcagtaatggctggatgagttcgggcccgcgaggctccgaggggaaggggcgtggagtggggttggtacgtttacaaaagtaaatgatggagaagaaatgactaggtncaccgagaaaganatcacatacacaagnaataatacgaaaacgacggtagtatttgactaaatcgaacagcctaagaaaaccggagtaacacgaagacccgtagtaactttacgtacgttaaccaacgtaagtaatttaccggggaaattcggacgtaacgtacgggtaacgtaaagggacggtcttaagttcgttattttacgattagtccggttacggggccctaaggggactaaggttcgg

SEQ ID NO: 114404 - DNA, 892 bp, Homo sapiens
  misc_feature: GYAE6OF02GVFCD.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagtccgttagggtaaaggccggttcggggggggttccccttaaggtaggttccttcccgttggttcggtcgggtcccttcgtgggtactttcctaccttttcaaggttaagtgggtacgttgggaagttgggtaacgggtttcggggtaccccgcccggtaaggggtccgttacccggaaggggggaaacggggggtccgtagggggtagggttggggggtttacggggtaaccggttttaacgaaaaaaagggttaaaaaagttaggtaagttaggggttaaggaaaggtaaaaaagttacggtaacgttaacgggtaggacccgaacccgggttaaggaaaaagggtaaagtaactttaccgaaccgtaataccgtacgaaaggtaagtaaattaaacttaacgaaaaaacggtcggttaaggttaactttaggaacctaaaatacggaaacgaacgaccgttaaacggaaaaccgaaggaaccaaccgaacgtaccgtacttaacgtttaaccgtacgtaacccagtaacgtacgttacgggtaaagtcgaacgtacgtaccggtaaggtaaacgggtacggtaacgttaacgtaggtttaccgttttaggtaacttacggttaccggtaccgggggtaaccccggaaggggtaacccgtaaggttcccggg

SEQ ID NO: 114405 - DNA, 723 bp, Homo sapiens
  misc_feature: GYAE6OF02G6UDX.15.86.H09.1.454.CMB.1.raw
  modified_base (446)..(446): a, c, t, g, unknown or other
  misc_feature (446)..(446): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaacgccgtgggggtcccttagagtctccgtgtgtggcctctggattcactttcagtaatggctggatggtagttcgggtcccgccgaggctaccggaggggaagggcgtggaggttgggttaggtacgtttaacgaaaaagttaaaagtgtaagtaggtagaaggaaaatagaaccgtaaggtcgacctaccggtaggaaaggaagtacttacaccatacanaagagtaataataacgaaaacgtacggtagttaagtttagaataaagtacgaaacgtacgaaccgtaacggaaaaccggaggtaaccacgacggtacccttaactacgtttaaccgtacgttaacccaacgtacgtaacgtttaccggaaaggtcgaaaccgttacgtaccgggtaaacggttaagggaaccgtacgttaagtacgtttaccgtttttaaggaatttacgttaccgggtacccggggtaacccgaagggttaacctaagggttccgg

SEQ ID NO: 114406 - DNA, 606 bp, Homo sapiens
  misc_feature: GYAE6OF02GCU9H.15.86.H09.1.454.CMB.1.raw
  modified_base (513)..(513): a, c, t, g, unknown or other
  misc_feature (513)..(513): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggctgggaggtggggttggtacgtttacgaaaaagtaaaaatgatggtagaagaaaatagactacggtgacaccgtgaaaggaagattacaccatctacaagagaataatacaaaaacgacggttagtatttgacaaatgaacagacctaagaaaaccgaggaacacagccgtactattactacgtaccanagtacttacggaagtcgacaagtccgaaggtaaaggaggtactagttaggtcttttaggattagtcgtcggggcccaggggtaccaggtcggg

SEQ ID NO: 114407 - DNA, 689 bp, Homo sapiens
  misc_feature: GYAE6OF02JR59U.15.86.H09.1.454.CMB.1.raw
  modified_base (308)..(308): a, c, t, g, unknown or other
  misc_feature (308)..(308): n is a, c, g, or t
tcagtctacgtagccacgaccggtgctcgatttagtgctatagacttgggtttgggggggtaggagggaggccccgagccttggggatccccaagtgttttcattcagtgatcaggactgaacacagaggactcaccatggagttcgggctgagctgggtttccttgctgctatcttaaaggtgtccagtgtgaagtgcaggtggtggagtcgtggggagccgttggtaaagccgtgggggtccctagagtctctgtgtgcctctggattcacttcagtaatggctggatgagttgggtccgcaggcncgagggaggggctggaggtgggtggacgtttacgaaaaggtaaaatggatgggtagagaaaacgtaggaacgtacggtagacgtaacccggtagaaaacgggtaagagttaccgaacctagtactacaaaggtacgataaacttacgaaaaacgtacggtagtaacgtttgaacgtaaaatagtaacagaccgtaggaaaaccgtagggaactacgaaacgtcccggtacttaagttaccttacggaaccctaaccgtaaggtacgtttaaccgggaaaggttcgaacgtaactacggtaaccgtaaaaggtccggtaacgttattacgggtcttttagaatacgttggttaaccgggccgaacgggtagtaaccgtgggg

SEQ ID NO: 114408 - DNA, 600 bp, Homo sapiens
  misc_feature: GYAE6OF02I99XC.15.86.H09.1.454.CMB.1.raw
  modified_base (504)..(504): a, c, t, g, unknown or other
  misc_feature (504)..(504): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctgggagtgggttggacgtttacaaaagtaaaatgagtggtagaagaaatagactacggtcgacaccgtagaaaaggagtagttacaccatctacaagagataatacaaaacgagtagttattgactaaatagaacagacctaagaaaacgacgaacacagccgtactacttactacgtaccanagtagttccggaagttcgacgagtaccgagtaaggacggtctatcgttacgtttgaagttacgtcggttacgggacccgtagggtactagttcggg

SEQ ID NO: 114409 - DNA, 623 bp, Homo sapiens
  misc_feature: GYAE6OF02GABV8.15.86.H09.1.454.CMB.1.raw
  modified_base (396)..(396): a, c, t, g, unknown or other
  misc_feature (396)..(396): n is a, c, g, or t
  modified_base (566)..(566): a, c, t, g, unknown or other
  misc_feature (566)..(566): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcacttttcagtaatggcgtggatgaggttgggtcccgccgaggcctccgaggggaagggggctgggaggttgggttggtacgtttacgaaaaagtaaaatgagtggtagaagaaaatagacgtacggngaccaccgtagaaaggaagattacacatctagaagagtaataacttacaaaaacgtcggtattaattgaacaaatagaacagacctaaggaaaacccgagaaccacgacgtccgtacttaattacctagtaacccacaagtattacggaatgacagtacgacgtaaaggnggtactagttgtacgttttagacgttatacggtccgggaccacgggtactaggtcgg

SEQ ID NO: 114410 - DNA, 583 bp, Homo sapiens
  misc_feature: GYAE6OF02G3L2L.15.86.H09.1.454.CMB.1.raw
  modified_base (185)..(185): a, c, t, g, unknown or other
  misc_feature (185)..(185): n is a, c, g, or t
  modified_base (390)..(390): a, c, t, g, unknown or other
  misc_feature (390)..(390): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagcctcacctgccacccgtaagtagtgagcatcgaacctacaccatcgaatggtatcaacagagaccagggaacgtcccccagtatataatgaaaagttaagagtgatggcagccacaccgaagggggacggactccccgatcgcttcatgggctccagttcgtggggctggaccnctaccgtcaccattcctcccaacctcccagttcctagacgattgaggtcctgagtataccacgtggtaggagagacgccaacgtactaaagtgactacgggaccgtaaggtacgggttgggttcgttaccggggcggtaacgggaacccgtaaggccggttagaaccccggttcggtacggtcctaacccggg

SEQ ID NO: 114411 - DNA, 774 bp, Homo sapiens
  misc_feature: GYAE6OF02JZ14P.15.86.H09.1.454.CMB.1.raw
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattctactttcagtaatggcgtggatggagttcggtccgcgaggctccgagggagggcgnggngtgggtggacgttacgaaaagtaaaagtgagtggtagaagaaatagacgtaggtgaccgaccgtaggaaaggaagtacgttaccaacgatacctacgaaagaagtaattaacgttaaccgaaaaaacggtcggttaagttactttacggaaataaaacgtagtaaaccaaggtacccgtaaaggtaaaaacccggnggaaaaccctacgtaaccgggtacccttaacttaaacgttaaccgttaacggtaaccctaaccgtaagttaacgtttaccgggaaagtccggaaacgtaacgttaccgggaaacggttaaagggtaacgggtccgttttaaacgttcggttttaaccgtttttaagggaacgtttaaccggttccgggggtaaccgggggttaacccccggtaagggggttaaacccgtaagggttttaaccccgggg

SEQ ID NO: 114412 - DNA, 631 bp, Homo sapiens
  misc_feature: GYAE6OF02GCJZT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctccgagggaggggcgtggaggtgggttggacgtttacaaaagtaaaatgagtggtagaagaaaatagactacggtgacacccgtagaaaggagattacacatactacaagagaataatacaaaacgacggtagtatttagactaaatgaaacacgaccgtaagaaaaccgagaacacgacgacccgtataacttaccgtagttaacccaataacgtacttaccgggaatcgacacgtacgtacggtaaagggacggtctaagtgttaccgtttttagaagtttacgtccggttacggggcccgtaaggggtacctaaggtcggg

SEQ ID NO: 114413 - DNA, 724 bp, Homo sapiens
  misc_feature: GYAE6OF02JDN5Z.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttcctgctgctatcttaaaaggtgtccagtgtgaagtgcaggtggtggagtcgtggggagccttggtaaagccgtgggggtccctagagtctctgtgtggcctctggattcactttcagtaatggctggatgagttgggtccgcctaggctccgagggagggctggagtgggtgacgtttacgaaaagtaaagtgagtggagaagtaaaataggactacggtagacaccgtaggaaaggaagtatcgaacctatactacgaagaagtaataaagttaaccaaaaaacggtacggtagttaagtttacgaacgtaaaaagtgaaaccgtaacggaccttaaaggaaaaacccgggagaaaccgtaaacgacgtaacccggtacttaacgttaaccgtagttaacccccgaagtaaaggtaacggttttaaccgggaaaacggtttacggaccttaaaggtaccggtaaaccgggtaaacgggtacggggtaacctttagtaccggttactttttaagggaactttacgttcgggtaaccggggaccccgtaagggtaacgtacgttacgggg

SEQ ID NO: 114414 - DNA, 574 bp, Homo sapiens
  misc_feature: GYAE6OF02F2UXP.15.86.H09.1.454.CMB.1.raw
  modified_base (415)..(415): a, c, t, g, unknown or other
  misc_feature (415)..(415): n is a, c, g, or t
  modified_base (443)..(443): a, c, t, g, unknown or other
  misc_feature (443)..(443): n is a, c, g, or t
  modified_base (521)..(521): a, c, t, g, unknown or other
  misc_feature (521)..(521): n is a, c, g, or t
  modified_base (535)..(535): a, c, t, g, unknown or other
  misc_feature (535)..(535): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctgggagtgggttggacgtttacaaaagtaaaatgatggtagaagaaaatagactacggtgcaccgtagaaaggaagattcaccatcacaaganaataatacaaaagtacggtgtaagtttnacaaatagaacagacctagaaaccgaggaacacgacgaccgtactattactcgtaccactagtacttacggaatcganatacgacgtaaggnggctatgtctttagatgtcgtgggcccgaggacagtcgg

SEQ ID NO: 114415 - DNA, 651 bp, Homo sapiens
  misc_feature: GYAE6OF02HYDAS.15.86.H09.1.454.CMB.1.raw
  modified_base (267)..(267): a, c, t, g, unknown or other
  misc_feature (267)..(267): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggtttttccttgctgctatacttaaaaggtgtccagtgtgaagtgcaggtggtggagtcgtgggggagccttgggtaaagccgtggggggtcccttagagtctcctgtgtggcctntggattcactttcagtaatggctggatgagttgggtcccgcgaggctccgaggggaacggggcgtagggaggtggggttggacgtttaacgaaaaagtaaaaatgagtaggtagaagaaaatagactacggtgacacccgtagaaaaggaagatacacatctanaaaganataataacgaaaacgacggtagtattagaactaaatagaacagaccaagaaaaccgagacaacagcccgtataacttactacgtaacccagtaacgtaagttaccgggtaagtgataacgtacggtaaacggtaaggaacggtacgttagtcggttactttttaaggaatttacgtcggtacgggggaaccccgtagggtaacctaaggtcggg

SEQ ID NO: 114416 - DNA, 668 bp, Homo sapiens
  misc_feature: GYAE6OF02GHTD0.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttggtaaagccgtgggggtcccttagagtctcctgtgtggcctctggattcactttcagtaatggctggatgtaggttgggtccgccgaggcctccgaggggaaggggcgtggaggtgggttggtacgtttacaaaaggtaaatgatggtagaagaaatagacgtacggtgcaccggtaggaaaggaagacttacgacctatacctacaaaggaacgtaattaacgttaaccgaaaaacggtacggtttagttaatttagaactaaagttacgaaacagacctaaaggaaaaccgcgaaccacgaacgtcccgtacttaattaccgtaccgtaaccctacgtaagtaacgttacgggaagtggactaacgtacgaaggtaacggacggtctaaggttcgtcgtttagagtacttcgggtacccggggacctaggggtacctaagttccggg

SEQ ID NO: 114417 - DNA, 881 bp, Homo sapiens
  misc_feature: GYAE6OF02IL6WA.15.86.H09.1.454.CMB.1.raw
  modified_base (388)..(388): a, c, t, g, unknown or other
  misc_feature (388)..(388): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtccttagagtctccgtgtgtggcctcgtggattcactttcagtaagtggctggatgaggttggtccgcaggctaccggaggggagggcgtgggaggttgggttaggtacgtttaacgaaaaagtaaaatggaagtggtagaagtaaaanagtacgtacggtacgaccgtaacccggtaaggaaaaggtaacgtaacgtttaccgaaccgtaacgttaccgtaacgaaaggtaacgtaaagttaaacgtttaaaccgaaaaaaaccgggttacgggtttaagtttaaacggttttacggaaaccttaaaaagttaacgggtaaaaaccgtaccggtaaacccgttaaaaccgggaaaaaaaccccgggagggaaacccgtaaacccggtaaccgggttaacccgttaacccgtttaaacgtttaaaccgttacccgtaaacccgtaaacgttaacgggttaacgttacggggtaaaacggttcgtaaacccgtaacgggttaaccgggtaaaccgggttaaaagggtaccgggttaacttaacggtttacggttaacccgtttttaagggtaacccgttacggtttacccggggacggggttaacccccggtaaaaggggttactaaccgggttttcccgggg

SEQ ID NO: 114418 - DNA, 609 bp, Homo sapiens
  misc_feature: GYAE6OF02IUUTV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaagcctgggggtcccttagagtctcctgtgtggcctctggattcactttcagtaatggctggatgagttgggtccgcaggctccgagggaggggctggagtgggttggacgtttcgaaaagtaaatgagtggtagagaaaatagactacggtgcaccgtagaagagattcacatctcaagagataatacaaaacgtacggtgtatttagactaaatcgaacagacctagaaaccgagacaacgacgtaccgtactattaacgtcgtaaccgactagtaagttccggaagtcgacgtagtaccgtacgtaaagggtacggtacttaacgttgtacgttttagtagttacgtcggttccggggaccccgtagggtaccgtagttccggg

SEQ ID NO: 114419 - DNA, 739 bp, Homo sapiens
  misc_feature: GYAE6OF02IG0OZ.15.86.H09.1.454.CMB.1.raw
  modified_base (401)..(401): a, c, t, g, unknown or other
  misc_feature (401)..(401): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtccttagagtctccgtgtgtggcctcgtggattctactttcagtaatggcgtaggatggaggttcgggtccgccgaggcctccgaggggaggggcgtgggaggtggggttggtacgtttacgaaaaagtaaaagtgaagtggtagaagtaaatagacgtacggtnacgaccggtagaaaggaagtatacacgtatctagaagaagtaataacgttaaacgaaaaacggtacggttagttaagttagaactaaaagtagaaacagtaccgtaaaggaaaaacccggtaagaaccaacgtaacgtacccgtaactttaaattaaccgtaacgtaaacccgaacgtaaacggttaacgtttaaccgggtaaaggtacggaacctaagttaccgggtaaggttaaaacggggaggtaaccttaagttaggttaccgtttttaagactttaacgggtccggttaaccgggggaccccgtaaagggggtaccctaaagggtttccgggg

SEQ ID NO: 114420 - DNA, 618 bp, Homo sapiens
  misc_feature: GYAE6OF02FKGKW.15.86.H09.1.454.CMB.1.raw
  modified_base (342)..(342): a, c, t, g, unknown or other
  misc_feature (342)..(342): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggctggagtgggttggacgtttanaaaagtaaaatgatggtgaagaaaatagactacggtgacaccgtagaaaggaagattacaccatctacaagagtataatacaaaaacgcggtagtattgacaaatcgaacagacctagaaaaccgaggaacacgacgcccgtataacgttactgtaaccacgtaagtacgttaccgggaaatcgacagttccggaaggtaaagggcggtacttagtcgttacgttttgaagttacgttccggtacggggaccctaaggggtacctaaggttcgggg

SEQ ID NO: 114421 - DNA, 645 bp, Homo sapiens
  misc_feature: GYAE6OF02IJQAZ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctggggagccttggtaaagcctgggggtccttagagtctcctgtgtggcctctggattcactttcagtaatggctggatgagttgggtcgccaggctccgagggaagggctggagtgggtgacgtttcaaagtaaaatgatggtagagaaaatagacacggtgacacccgtagaaaggaagattcaccatctacaacgagataatacaaaagtacggtagtacgtttagacaaagtgaaacaggacctaaggaaaaccgaggaaactacgaagcctacgttacttaacgtacgtaaccaacctaagacgttacggaaaagtcgaccgaagttaccggtaacgtaaacgggtaacggtacctaaagttcggtaactttttcggaaatttacgttcggtacgggggtaaccccctaagggggtaaccttaaggttacccggg

SEQ ID NO: 114422 - DNA, 545 bp, Homo sapiens
  misc_feature: GYAE6OF02IT0I4.15.86.H09.1.454.CMB.1.raw
  modified_base (368)..(368): a, c, t, g, unknown or other
  misc_feature (368)..(368): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacacgaaggggacggatccccgatcgcttcatggctcagttcgngggctcgaccgctacctccgaccatcctccaacctccagtctgactatgagcngagtancactgtaggagagagccacaacaatgatacggaccgtaaggtacgggtttgggtcggttcgggacggtacgggaccgaaggtcgtacggtacccgtaccggtacggtccgtaacccgg

SEQ ID NO: 114423 - DNA, 589 bp, Homo sapiens
  misc_feature: GYAE6OF02F26PH.15.86.H09.1.454.CMB.1.raw
  modified_base (408)..(408): a, c, t, g, unknown or other
  misc_feature (408)..(408): n is a, c, g, or t
  modified_base (462)..(462): a, c, t, g, unknown or other
  misc_feature (462)..(462): n is a, c, g, or t
  modified_base (482)..(482): a, c, t, g, unknown or other
  misc_feature (482)..(482): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccagggaaggggctggagtgggttggacgtttcaaaagtaaaatgatggtagagaaaatagactacggtgcaccgtgaaaggagattcacatctcaaganataattacaaaacgcggtagtatttagacaaatgaaacagacctagaaaaccgnggacacagcctactattacngtaccacagattaccggaatgactagtcgaacggtaaaggaggtaccttagtcggtctttttagaattacgtcggtacgggggaccccaggggtaccaaggttcggg

SEQ ID NO: 114424 - DNA, 642 bp, Homo sapiens
  misc_feature: GYAE6OF02GVFWI.15.86.H09.1.454.CMB.1.raw
  modified_base (472)..(472): a, c, t, g, unknown or other
  misc_feature (472)..(472): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttgggtaaacgccgtgggggtcccttagagtctccgtgtgtggcctctggattcactttcagtaatggctggatgtaggttcgggtccgcgaggctccggaaggggaaggggcgtgggaggtggggttggtacgtttaacgaaaaagtaaaagtgaagtggtagaagaaaatagaacgtacggtagacaccgtaggaaaggagtataccacatctacaagagaataactaacgaaaacgtgtagtattaganaaatagaacagacctaagaaaccgagaaccacgagtaccgtactattacgtacgtacacgagtacgtacgaagtcacgtagtacggtaaggtaaaggagtacttaagttgtacgttttaggaactttacggttccggtacggggacccgaagggttacctaaggttcggg

SEQ ID NO: 114425 - DNA, 640 bp, Homo sapiens
  misc_feature: GYAE6OF02G9BEB.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgagggacggggcgtgggagtggggttggacgtttacgaaaagtaaatgatggtagaagaaatagacgtacggtcgacgacccgtagaaaggtaagacttacaaccatactacgaagaagaataaactttaacaaaaacggtacgggtagttaatttaggaactaaagtagaaacaacgtaccgtaacggaaaaccggaggaaccaacgaacgcccgtacttacttactacgtaccacgagtacgttacggaagtgacagtacgacggtaaggaggtactagtgttactttagtagttacgtcggtaccgggaccgtagggtactagtcgg

SEQ ID NO: 114426 - DNA, 577 bp, Homo sapiens
  misc_feature: GYAE6OF02H4YWA.15.86.H09.1.454.CMB.1.raw
  modified_base (353)..(353): a, c, t, g, unknown or other
  misc_feature (353)..(353): n is a, c, g, or t
  modified_base (499)..(499): a, c, t, g, unknown or other
  misc_feature (499)..(499): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaaggggctggagtgggttggacgtttacaaaagtaaaangatggtagagaaaatagactacggtgcaccgtagaaaggagattcacatctcaagagaataattacaaaacgacggtagtatttgactaaatgaaacagacctaagaaaaccgagaaccacgacgccgtactattactcgtaccanagtattacggaatgacagtcgagtaaggaggtctatgtcttttgaacttagtcggtacgggaccgagggactagtcgg

SEQ ID NO: 114427 - DNA, 614 bp, Homo sapiens
  misc_feature: GYAE6OF02HUXAT.15.86.H09.1.454.CMB.1.raw
  modified_base (363)..(363): a, c, t, g, unknown or other
  misc_feature (363)..(363): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggctggaggtgggttggacgtttacaaaagtaaaatgatggngaagaaaatagactacggtgcaccgtagaaaggaagattcacatctacaagagataattacaaaaacgtacggtagttaatttgacaaattgaaacacgacctaaggaaaacccgaggaaccacgacgaccttactattacctacgtaaccagagtacttacggaagtcgacatacggaacggttaaaggaggtctaagtcgttcgttttagattagtccggtacggggcccaaggggactaagttcgggg

SEQ ID NO: 114428 - DNA, 676 bp, Homo sapiens
  misc_feature: GYAE6OF02IIMRT.15.86.H09.1.454.CMB.1.raw
  modified_base (302)..(302): a, c, t, g, unknown or other
  misc_feature (302)..(302): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctctgtgtggcctctggattcactttcagtaatggctggatgagttggtccncaggctccgagggagggctggagtgggtgacgttacaaaagtaaatgatggtagaagaaaatgactacggtgacgaccgtagaaaagagtattcgcctaatctacgaagtagaactaaattacgaaaaaacggtacggtagttaatttacgacgtaaaaagtcgaaaccaacggtaccctaacgggtaaaaaacccgaggaaacccaacgaacggtacccgtacttaaagttaccgttacggtaacccaacgtaacggtaacgtttacgggaaagttcgactaacgtacggtaacggtaaggacggtacttaagtgttaccgttttagaacgttagtacggttcggggacccgtaagggacctaaggttccggg

SEQ ID NO: 114429 - DNA, 663 bp, Homo sapiens
  misc_feature: GYAE6OF02GW22C.15.86.H09.1.454.CMB.1.raw
  modified_base (341)..(341): a, c, t, g, unknown or other
  misc_feature (341)..(341): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtgcctctggattcactttcagtaatggctggatgagttgggtccgccagctcgagggaagggcgtggaggtgggttggacgtttanaaaagtaaaatgagtggtagagaaaatgacgtacggtgacgtaccgtagaaaaggaagattcaaccatctagaaagtagaataacttacgaaaaaacgtaggttagttaatttagaaacgtaaatacgtaaacaacgaccgtaagaaaaacccggaggaaccgacgaacggtaccgttacgttaacgtttaaccgtaccgttaaccgaacaagtaacgttacggaaaggtcgaccgtaagtacggtaaccggtaaagggacggtactaagttggtcttttagattaacgtccggttcgggaccgaagggtactaaggttcgg

SEQ ID NO: 114430 - DNA, 565 bp, Homo sapiens
  misc_feature: GYAE6OF02JIAKZ.15.86.H09.1.454.CMB.1.raw
  modified_base (217)..(217): a, c, t, g, unknown or other
  misc_feature (217)..(217): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (503)..(503): a, c, t, g, unknown or other
  misc_feature (503)..(503): n is a, c, g, or t
  modified_base (544)..(544): a, c, t, g, unknown or other
  misc_feature (544)..(544): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggganccttgggtaaagcctgggggtcccttagagtctcctgtgtggcctctggattcactttcagtaatggctggatgagttgggtccgccaggctccagggaaggggctggagtgggttggacgtttcaaaagtaaaatgatggngaagaaatagactaggngacaccgtagaaaggagatcacatcanaaganaataatacaaaacgcggtagtattagacaaatagaacagcctaagaaaccgngaaccanagcctactattactactaccacagacttacggagtnacatacgacgtaaaggcgtatatgtctttagatagttccgngggtacccagggactagtcgg

SEQ ID NO: 114431 - DNA, 696 bp, Homo sapiens
  misc_feature: GYAE6OF02JGHF5.15.86.H09.1.454.CMB.1.raw
  modified_base (476)..(476): a, c, t, g, unknown or other
  misc_feature (476)..(476): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtccttagagtctctgtgtggcctctggattcactttcagtaatggctggatgagttgggtccgcgaggcctcgagggaagggcgtggaggtgggttggacgtttacgaaaagtaaagtgagtggtagaagaaaatagacgtacggtagaccgaaccgtagaaaggaagtattacaacctatactagaagagtaataaacgtaacgaaaaacggtggtagttaatttagaactaaagtanaaacgacgacctaagaaaaccgacgacgaaccacgtaccgtacttaacttacgaccgttaacccaataacggtaacgtttacgggaaacggttacgaaccgtaagtaccggtaaacggtaaagggtaacggtaaccggttaattcgggtaacctttttaggaaacgtttagttaccgggttaccggggaaccccgtaaggggtaaccagggtttaccggg

SEQ ID NO: 114432 - DNA, 721 bp, Homo sapiens
  misc_feature: GYAE6OF02GZNU3.15.86.H09.1.454.CMB.1.raw
  modified_base (329)..(329): a, c, t, g, unknown or other
  misc_feature (329)..(329): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttggtaaagccgtgggggtcccttaggagtctcctgtgtggcctctggattctactttcagtaatggctggatgaggttggtccgcgaggctccgagggaggggctggnggtgggttggtacgttacaaaagtaaaatgagtggtagaagaaaagtagacgtacggtgacgaccggtaggaaaggaagtacttacaacctactactacgaaagagtaattaactaacgaaaaacggtcggttaagttaagtttagaactaaaagtacgaaacgacgtaccgtaaggaaaaaccggtacggaacaaccgacgtacccgttattaacgttaaccgtacgtaacccaagtacggttaacgttaccgggaaggtacgaaccgtaacgtaccgggtaaacggtaaaggggaacggtaacttaacggttacggttaacgtttttaggaacgtttacggttccgggtacgggggtaacccccgtaaggggtacctaagggttccgggg

SEQ ID NO: 114433 - DNA, 612 bp, Homo sapiens
  misc_feature: GYAE6OF02FKHQ4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtccccttagagtctcctgtgtggcctctggattcactttcagtaatggctggatgagttgggtccgccaggctccagggaaggggctggagtgggttggacgtttcaaaagtaaaaatgatggtgaagaaaatagactaggtgcacccgtgaaaggaagattcaccatctcaagagataattacaaaaacgacggtagtaatttgactaaatgaacagacctagaaaaccgaggaaccacagcccgtatacttactagtaccacagattccggaagttcgctactacgacggttaaaggaggtcctaagttcggtacgtttttagaacttagttccggttagggggacccccgtaaggggacctaaggttccgggg

SEQ ID NO: 114434 - DNA, 721 bp, Homo sapiens
  misc_feature: GYAE6OF02G7M1A.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgaggttggtccgccaggctccgaggggaaggggctggaggtgggttggacgtttacaaaagtaaaatgatggtagaagaaaatagacgtacggtgaccaccggtagaaaaggaagtattacaacctatactacgaagagtaattaacttaacgaaaaacggtcggttagttaatttaggaactaaaagtacggaaaccacggtacccgttaaggaaaaacccggagggtaaaccacgacggtacccgttacttaacgtttaccgtacgttaacccacgtaagtaacgtttacgggaagtacgaccgtaagtacccggtaaacgggtaaagggtacggtacttaagttcggttaccgtttttaggaagtttaccgtttccggggtaacccgggggtaccccgtaagggggtaacctaagggtttacccgggg

SEQ ID NO: 114435 - DNA, 686 bp, Homo sapiens
  misc_feature: GYAE6OF02IGGN5.15.86.H09.1.454.CMB.1.raw
  modified_base (186)..(186): a, c, t, g, unknown or other
  misc_feature (186)..(186): n is a, c, g, or t
  modified_base (333)..(333): a, c, t, g, unknown or other
  misc_feature (333)..(333): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtntgcatctgccttgcgtgggacgcctcgatcaagctcacctgccaccctaagtagtgagcactacgaacctacaccatcgaatggtatcaacagagaccagggacgtcccccagtatataatgaaagttaagagtgatggacagccanaccgaagggggacggactacccgatcgcttcatggctccagttctcggggctcggaccgtcctactccgaaccactcctaccaaccctccacgttccaggaccgtagtcggaggtcgtagtacgtataccacgttggagggtagaacggacgacccgaaaccgtaaaccgtaaagttttacggaacgttacggggaacccgttaaacggggtaccgggggtttttacgggggttaccgggttttccggggggaacccgggggtaaccggggtaaacccggtaacgggtacccggttaccggggttaaccccccgggtttaccggtttaaccgggttacccggaaaccccgggg

SEQ ID NO: 114436 - DNA, 588 bp, Homo sapiens
  misc_feature: GYAE6OF02G5XGO.15.86.H09.1.454.CMB.1.raw
  modified_base (377)..(377): a, c, t, g, unknown or other
  misc_feature (377)..(377): n is a, c, g, or t
  modified_base (548)..(548): a, c, t, g, unknown or other
  misc_feature (548)..(548): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtttggcctctggattcactttcagtaatggctggatgagttggtccgccaggctccgaggaaggggctggagtgggttggacgtttcaaaagtaaaatgatggtagagaaaatagactacggngcacccgtgaaaggaagattcacatctacaagagaataatacaaaacgacggtagtatttagacaaatgaacagacctaggaaaaccgaggaacaacgacgaccgttactaacgttactgtaacccacaagtattacgggaagtgcaatcgaagtaggaggtctagtcgtntttagattagtcggtcgggacccagggaacagtggtaccg

SEQ ID NO: 114437 - DNA, 567 bp, Homo sapiens
  misc_feature: GYAE6OF02FLEBB.15.86.H09.1.454.CMB.1.raw
  modified_base (524)..(524): a, c, t, g, unknown or other
  misc_feature (524)..(524): n is a, c, g, or t
  modified_base (545)..(545): a, c, t, g, unknown or other
  misc_feature (545)..(545): n is a, c, g, or t
tcagtctacgtagccacgaccggtgctcgatttagtgctatagacttgggtttgggggggggagaggagccccagccttgggatcccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggcctccaggggaaggggctggagtgggttggacgtttacaaaagtaaaatgatggtagagaaaatagactacggtgcaccgtgaaaggagatcacatcacaagagataatacaaaacgacgtagtatttgacaaatagaacagactagaaaaccgaggacacagccgtactattactagtaccacagtattacggaatgacagacgacgtaaaggnggactatgtcttttagattancgtcgggcccagggacagtcgg

SEQ ID NO: 114438 - DNA, 576 bp, Homo sapiens
  misc_feature: GYAE6OF02IJPDY.15.86.H09.1.454.CMB.1.raw
  modified_base (500)..(500): a, c, t, g, unknown or other
  misc_feature (500)..(500): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgcaggctccagggaaggggctgggagtgggttggacgtttacaaaagtaaaatgatggtagaagaaaatagactacggtgcaaccgtgaaaaggaagatcacatctacaagagataattacaaaaacgacggtagtaatttagacaaagtgaaacagacctagaaaaccgaggacaacagccgtactattactagtaccanagattcgaaagtcgcatcgacgtaaaggaggctaatgtcttttagattatcgtagggccccagggacctaagtcgg

SEQ ID NO: 114439 - DNA, 673 bp, Homo sapiens
  misc_feature: GYAE6OF02IQSL1.15.86.H09.1.454.CMB.1.raw
  modified_base (309)..(309): a, c, t, g, unknown or other
  misc_feature (309)..(309): n is a, c, g, or t
  modified_base (349)..(349): a, c, t, g, unknown or other
  misc_feature (349)..(349): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaaagccgtgggggtcccttagagtctcctgtgtggcctctggattcactttcagtaatggctggatgagttcggtccacgngctcgagggacgggcgtggaggtgggttggtacgtttaanaaaaagtaaaagtggagtggtagaaagtaaagtagacgtacggtcgaccgaaccggtaaggaaaaggaagtacttaccaacctacttactacgaaagagtaaacttaaagttaaccgaaaaacggtacggttagttaatttagaactaaaatcgaaacacgacgtaaacgaaaaccggagacctaagaccgtaccgttataacgttactacgtaaccaacgtacgtaagttaccggaatcgaactacgtacggtacggtaaaggcgtcttaagtcgttactttagaagtttcgtaccggtgggacccgaaggtacaggttccgg

SEQ ID NO: 114440 - DNA, 699 bp, Homo sapiens
  misc_feature: GYAE6OF02F0VEG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctgggagtggggttggacgtttcaaaagtaaaatgatggtgaagaaatagactacggtgacaccggtagaaaacgggaagagttacaaccagtacctacaagagaataaattacgaaaaaacgtacggttagttaattttaggactaaaattaggaaactacggtaccctaaggaaaaacccggaggaaccaacgacggacccgttacttaacgttacctacggttaacccactaaggtacttaccgggaagtcggactaagtaccgggtaacgtaaaggggacgggttccttaaggttcggttacctttttagggtaacttaccggttacgggttacgggggaccccccgtaggggtaaccctaggtttacccgggg

SEQ ID NO: 114441 - DNA, 612 bp, Homo sapiens
  misc_feature: GYAE6OF02H8BAI.15.86.H09.1.454.CMB.1.raw
  modified_base (262)..(262): a, c, t, g, unknown or other
  misc_feature (262)..(262): n is a, c, g, or t
  modified_base (339)..(339): a, c, t, g, unknown or other
  misc_feature (339)..(339): n is a, c, g, or t
  modified_base (447)..(447): a, c, t, g, unknown or other
  misc_feature (447)..(447): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttaggagtctcctgtgtggcctntggattcactttcagtaatggctggatgagttgggtccgccaggctccagggaagggctggagtggtggacgtttanaaagtaaaatgatggtgagaaagtagactaagtgcaccgtgaaaggaagatcgacagtctacaagagaataatacaaaacgtcggtagtaatttgacaaagtgaaacngtacagaaaaccgagaacacgtagccgtactaacttacggtactaaccaccgaagtaacgtttacgggaaacgtggaccgaagtccggaacgttaaaagggacggactaagtggtacttttaggacttaagttcggacggggtacccaaggggaccaagttcggg

SEQ ID NO: 114442 - DNA, 637 bp, Homo sapiens
  misc_feature: GYAE6OF02HFDKG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcgaggctccgaggggaaggggcgtgggaggtggggttggacgttttacgaaaaggttaaaatgagttgggtagaagaaaatagactacggtgacgaccgtaggaaaggaagattacaccatacctacaagagataattacaaaaacggtcggtagttatttgaacaaatgaaacagacctaaggaaaaccgagaccagacgccgtatattacgtcgtaaccagagtattacgggaagtcggacagtacggaaccgtaagggtacggacttattaggttacttttaggaactttagtaccgggtcggggaccccgtaaggggacctaaggttccggg

SEQ ID NO: 114443 - DNA, 810 bp, Homo sapiens
  misc_feature: GYAE6OF02I449N.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttcctgctgctatacttaaaggtgtccagtgtgaagtgcgtaggtggtggagtcgtgggggacgtcgttaggtaaagccggtcgggggtcccttagagttcgtccgtggtggtggcctcgtggtattcctactttcaagttaagtggtcgtggagttggtaggttcgggtcccgaccgtagggtccgtaccggaacgggggtaacggggcgtagggtagggttcggggttacggtacgttttaaacgaaaaaaggttaaaaagtgggtaagttagggtaaggtaaagtaaaaggtacgtaacggttaacggtacgacccgtaacggtaacggaaaaggtaacgtacgtaccgaactaactctaacgaaagtaataacgttaaacgtaaaccgtaaaacggtacggtaactttaagtttacgaacgtaaagtaacgaaacgtacgaaccgtaaacggaaaaccgtaacgacgtaacgacgtaccgtacgttaacttaacgtacgtaaccgaacgtaacggttacgttaacggtacgtaacgtacgtaacggtaccgtaacgggttaaggacggtacgttaacgtacgggtttaacgtttagtaacgttaccggttaccggtccggggttaacccgaagggttacgaacggtttccggg

SEQ ID NO: 114444 - DNA, 625 bp, Homo sapiens
  misc_feature: GYAE6OF02HMB6T.15.86.H09.1.454.CMB.1.raw
  modified_base (468)..(468): a, c, t, g, unknown or other
  misc_feature (468)..(468): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctcagggaagggctggagtgggttggacgtttacgaaaagtaaaatgatggtagaagaaaatagactacggtgcaccgtagaaagagattcaccatctacaagagataattacaaaaacggtcggtagtatttgacaaattagaacagcctaggaaaaccgnggaacacgagtaccgttactattacgtagtaccctacgaagtattacggaagttcgctaagtccggaacggtaaagggaaccggtcttaagtcggttactttttaggacttacggttcggtaccggggaccccgtaaggggtacctaaggtccgggg

SEQ ID NO: 114445 - DNA, 761 bp, Homo sapiens
  misc_feature: GYAE6OF02GOX1T.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtgggggtcccttagagtctcctgtgtggcctctggattcactttcagtaatggctggatggtagttcgggtcccgccgaggcctaccggaggggaagggggctgggaggtggggttggtaacgtttacgaaaaaagttaaaatggtaagtagggtagaaagtaaaaagtacggtaaccgttaacgggtacgaccgtaacccggtaaggaaaaagggaaacggtaacttaccgaaccgtaattaccgtaacgaaagaacgtaaatttaaaacgttaaaccgaaaaaaacgggttacggttaaggtttaacgttttaaggaaccttaaaaagtacggaaaacctaagggtacccctaaaacgggaaaaaacccggagggtaaacccaacgtaacggtacccgttaacttaacgtttaacgtacggtaaacccaacgagtaacgttacggaagtgacaagtacgaacgtaaggacgtattagtagttactttagaagttagtcggtccgggacccagggtacaggttccgg

SEQ ID NO: 114446 - DNA, 573 bp, Homo sapiens
  misc_feature: GYAE6OF02GSTJ4.15.86.H09.1.454.CMB.1.raw
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
  modified_base (499)..(499): a, c, t, g, unknown or other
  misc_feature (499)..(499): n is a, c, g, or t
  modified_base (511)..(511): a, c, t, g, unknown or other
  misc_feature (511)..(511): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgaggggaaggggcgtgggagtgggttggtacgtttacaaaagtaaaatgagtggtagaagaaaatagactacggtgacgaccgtagaaaggagatacaccatcacaagagataatacgaaaacgcggtatagtttnanaaatgaacngcctagaaaaccgagacacagcctatattacgtgtaccanagtatacgaatnacagtcgagtaaggnggtntatcgtacttttgattcgtcggtcgggaccagggtacagtcgg

SEQ ID NO: 114447 - DNA, 570 bp, Homo sapiens
  misc_feature: GYAE6OF02HHSMS.15.86.H09.1.454.CMB.1.raw
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (460)..(460): a, c, t, g, unknown or other
  misc_feature (460)..(460): n is a, c, g, or t
  modified_base (517)..(517): a, c, t, g, unknown or other
  misc_feature (517)..(517): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatggagttgggtccgccagggctccgagggaggggctggagtgggtggacgtttacaaaagtaaaatgaatggtagagaaatgactacggtgcaccgtagaaagganattcacatctacaagagataatacaaaacgngtagtatttgactaaatagaacagacctagaaaccgngacacagccgtatatactgaccacagattacggagtgacagtacggacgtaaagggngtacgtagtcgtagtttgattacgtacgtcgggacccagggtacagttacggg

SEQ ID NO: 114448 - DNA, 605 bp, Homo sapiens
  misc_feature: GYAE6OF02IYTQ9.15.86.H09.1.454.CMB.1.raw
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (484)..(484): a, c, t, g, unknown or other
  misc_feature (484)..(484): n is a, c, g, or t
  modified_base (533)..(533): a, c, t, g, unknown or other
  misc_feature (533)..(533): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttcctgctgctatacttaaaggtgtccagtgtgaagtgcaggtggtggagtcgtggggagccgttggtaaagccgtgggggtccttagagtctcctggtgtcggcctcgtaggattctactttcagtaatggctggatggagttggtcgcaggctccggagggagggntggagtggtagacgttanaaagtaaatgaatggtgaagtaaatgactacggtgacaccgtagaaagagatacgactaagtcgtacaagtagtaataagtaacaaaaaggtcggttagtaacgttagaactaaagtacggaacagtaccaaggtaaaaccgganacgaacgtaggcccttagtattaccgacgtaccagtatcgttagaagtnacaagtccgaaggtaacgtgaacttatggtacctttagactagtccgtgggacccaagggtacaaggttcgg

SEQ ID NO: 114449 - DNA, 628 bp, Homo sapiens
  misc_feature: GYAE6OF02JGG74.15.86.H09.1.454.CMB.1.raw
  modified_base (403)..(403): a, c, t, g, unknown or other
  misc_feature (403)..(403): n is a, c, g, or t
  modified_base (572)..(572): a, c, t, g, unknown or other
  misc_feature (572)..(572): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagccgtgggggtcccttagagtctcctgtgtggcctcgtggattcactttcagtaatggctggatgagttggtccgcaggctccgagggaaggggctggagtgggtggacgtttacgaaaagtaaaagtgagtggtagaacgtaaaatagacgtacggtgaccaccgtagaaaggaanattcaacatactacgaaagagtaataattaacaaaaacggtacgttagttaagtttacgaacgtaaatgaaacagactaagaaaaccgagacacgagccgtactaattacgtacgtaccataagtacgttacggaacgtgactacgtacggaacgttaaagggacggtnttaatcggttaactttgaacttcgtacgtacggggacctaagggtacgagttcggg

SEQ ID NO: 114450 - DNA, 804 bp, Homo sapiens
  misc_feature: GYAE6OF02IMY7G.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtggggagccttggtaaagccgtggggggtcccttaggacgtctccgtgtggtggcctcgtggatttcgactttcagtaatggctggatggagttcgggtccgcaggctccgaggggaagggctggaggtgggtagagtttacgaaaagtaaaatgagtaggtagaagaaaatagactaacggtgaccaacccggtagaaaacggaacgaattaccgaactataccgtaacgaaaggtaagtaataaacgtttaacaaaaaaccgggtaccgggtttaagttaagttttacggaaacgtaaaagttagaaaccctaaggtacccgttaaacggaaaaaacccgagggaaaaccctaacggaaccgtaccggtttaaccgttaaacgttaaccgttaaccgggtaacccaaaccgtaaggtaaaccgttttaacggggaaacgtaccggtaactaaaccgttaccgggtaaaaccggtaaaacgggtacgggtaacgttaaacgtttcggttaaccgtttttaaggaaaccgttttaacggtacccgggttaccggggtaaccccccggtaaggggttaaaccgtaaggtttccggggg

SEQ ID NO: 114451 - DNA, 567 bp, Homo sapiens
  misc_feature: GYAE6OF02FSXBB.15.86.H09.1.454.CMB.1.raw
  modified_base (399)..(399): a, c, t, g, unknown or other
  misc_feature (399)..(399): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
  modified_base (515)..(515): a, c, t, g, unknown or other
  misc_feature (515)..(515): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccagggaaggggctggagtgggttggacgtttcaaaagtaaaatgatggtgagaaatagactaggtgcacccgtgaaaggagattcacatcncaagagataatacaaaacgacggtagtatttgacaaatgaacagacctagaaaaccgaggacacagccgtactattacngtaccanagattacggaagtgacagtcgacgtaaggnggactagtgtcttttagattacgtcgtcggggacccaggggactagttcggg

SEQ ID NO: 114452 - DNA, 589 bp, Homo sapiens
  misc_feature: GYAE6OF02IWQ49.15.86.H09.1.454.CMB.1.raw
  modified_base (556)..(556): a, c, t, g, unknown or other
  misc_feature (556)..(556): n is a, c, g, or t
  modified_base (565)..(565): a, c, t, g, unknown or other
  misc_feature (565)..(565): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagttctcctgtgtggcctctggattcactttcagtaatggctggatgagttgggtccgccgaggctccgagggaaggggctgggaggtgggtggtacgtttacaaaagtaaaatgaagtggtagaagaaatagactacggtgacacccgtagaaaggaagatacgacatctacaagagaataattacaaaacgacggtagttatttagataaatgaacagaccctaaggaaaacccgaggaccacgacgcctactattacctacgtaccacgagtagttacggagtgcagtacgacgtaaggagctatcgtntttagattntcgtcgggaccagggactagtcgg

SEQ ID NO: 114453 - DNA, 593 bp, Homo sapiens
  misc_feature: GYAE6OF02JAHIV.15.86.H09.1.454.CMB.1.raw
  modified_base (477)..(477): a, c, t, g, unknown or other
  misc_feature (477)..(477): n is a, c, g, or t
  modified_base (552)..(552): a, c, t, g, unknown or other
  misc_feature (552)..(552): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagccgtgggggtcccttagagtctcctgtgtggcctctggattcactttcagtaatggctggatgaggttgggtcccgcgaggctccgaggggaaggggctggagtgggttggacgtttacaaaagtaaaatgatggtagaagaaaatagacgtacggtgcaaccgtagaaaggagacttcaaccatcacaagagataatacaaaacgcgtgtaatttgactaaatacgaacacgtacctaaggaaaaccgnggaaccacacgcccgtattaacttacgtacgtaaccaacgagtacttacggaaagtcgacagtacgagtaaaggngctatgtactttagattgtcgcgggaccagggactagtcgg

SEQ ID NO: 114454 - DNA, 569 bp, Homo sapiens
  misc_feature: GYAE6OF02IN6VV.15.86.H09.1.454.CMB.1.raw
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (435)..(435): a, c, t, g, unknown or other
  misc_feature (435)..(435): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagcctgggggtcccttagagtctcctgtgtggcctctggattcactttcagtaatggctggatgagttggtccgcaggctcgagggaaggggctggagtgggttggacgtttcaaagtaaatgatggtnagaaatagactacggtnacaccgtgaaaggaanattacacatctanaagagaataattacgaaaacgtacggtagtatttganaaatagaacacgacctaggaaaccgagacgggacacgcctactattactacgtaccacagtagttacgaatcgacatacgacgtaaggaggtctatgtactttgattctcggtcgggaccgagggacagttcgg

SEQ ID NO: 114455 - DNA, 652 bp, Homo sapiens
  misc_feature: GYAE6OF02IB4Z8.15.86.H09.1.454.CMB.1.raw
  modified_base (263)..(263): a, c, t, g, unknown or other
  misc_feature (263)..(263): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccttggtaagccgtgggggtcccttagagtctctgtgtggcctntggattcacttttcagtaatggctggatgagttgggtccgcaggctcgagggagggctggaggtgggttggacgtttacaaaagtaaaatgaagtggtagaagaaaatgaactacggtcgacaccggtagaaaggaagtatacacctatactacgaagagtaataaacttaacgaaaaacggtacggttagttaatttgaactaaaatagaaacctaggtacctaagaaaaccgaggaaccacgacgccgtataattacgacgtaccagagtagttaccggaagtcgactagtaccgaaggtaaagggtacggtacttagttacgtaccgtttttagaactttacgtccgggtaccggggaccccgtaagggtaccgtaagttccgggg

SEQ ID NO: 114456 - DNA, 669 bp, Homo sapiens
  misc_feature: GYAE6OF02HXGJ9.15.86.H09.1.454.CMB.1.raw
  modified_base (262)..(262): a, c, t, g, unknown or other
  misc_feature (262)..(262): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctntggattcactttcagtaatggctggatgagttgggtccgccaggctccgagggaaggggctgggaggtggggttggacgttttacgaaaaagtaaaatgaagtggtagaagaaaatagacgtacggtgacacccgtaggaaaggaagtattaccactatctacaagagaattaattaacaaaaacggtacggttagttaatttgactaaaatgaaacacgacctaaggaaaaccgagaacacacgccgtacttaattaccgtagacccaacgtacgtagtttaccggaagtcgactaagtaccggtaacggtaaagggtacggtacttaacgttaggttacctttttaggaagtttacgttccgggtaccgggggtaccccgaagggggtacctaaggtttcccggg

SEQ ID NO: 114457 - DNA, 698 bp, Homo sapiens
  misc_feature: GYAE6OF02GAZ2A.15.86.H09.1.454.CMB.1.raw
  modified_base (396)..(396): a, c, t, g, unknown or other
  misc_feature (396)..(396): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttctttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggccgcaggctccgaggggaagggcgtgggaggtggggttggtacgtttacgaaaaagttaaaatgtaagtgggtagaagtaaaataggaactacggtnacgtaacccggtagaaaaggaagacttacaacctatctacaaagaagaattaaacttaacgaaaaaaccggtcggttagttaacgtttagaactaaagtagaaacacgtaccctaaggaaaaccgaggaacctaacgacggtacccttagttaactttaaccgtacgtaacccaacgaaggtaacgttacggaaagtcgaacgtaagtaccggtaacggtaaagggcggtacttaagtttccggtagtttttagattaacgttccggtaccggggtacccgaaggggtaccaaggttcgggg

SEQ ID NO: 114458 - DNA, 599 bp, Homo sapiens
  misc_feature: GYAE6OF02JCOL7.15.86.H09.1.454.CMB.1.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaggggctgggagtgggttggacgtttcgaaaagtaaaagtgatggtagagaaaatagactacggtgcaccgtgaaaggagatcacatcanaaganaatatacaaaacgcgtntattgacaaatgaacagacctaggaaaccgaggaccaacgacgacctctaattaccgagtaaccacagagttacggaagtnanacgtacgagtaaagggcgtacgtaattaggtcttttaaggaattcgttaccggtcggggaccccaagggggtaccaggtttaccggg

SEQ ID NO: 114459 - DNA, 662 bp, Homo sapiens
  misc_feature: GYAE6OF02IAK4C.15.86.H09.1.454.CMB.1.raw
  modified_base (381)..(381): a, c, t, g, unknown or other
  misc_feature (381)..(381): n is a, c, g, or t
  modified_base (434)..(434): a, c, t, g, unknown or other
  misc_feature (434)..(434): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtggggagccttggtaaagccgtgggggtccttagagtctcctgtgtcggcctctggattcactttcagtaatggctggatggagttcgggtccgccgaggtcctaccggaggggaacggggcgtagggaggttggggttcggtacggtttacgaaaagtaaaagtgatggtanaagaaatagactacggtgctaccgtgaaaggaagatcactatactacaaaganaagttaataacgaaaacgtacggttataagtttagactaaaagtcgaaacgtagtacccgtaagaaaacccggaggaaccacgtacgtaccgttacctaatttaccgtagtaaccacgaagttacgttacgaaacgtgacctaagtaccgacggttaaaggcggtacttagtacgttacgttttagaagttagttccggtaccggggcccaagggtactaggttacgg

SEQ ID NO: 114460 - DNA, 814 bp, Homo sapiens
  misc_feature: GYAE6OF02HPDOT.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaaagccgtgggggtccttagagtctcctgtgtggcctctggattcactttcagtaatggctggatgagttgggtccgccaggctccgagggaagggcgtggaggtggggttggtacgtttacgaaaagtaaaatgatggtagaagaaatagacgtacggtgacaccgtaggaaaaggaagtacgttacaacctatacctacgaaagagtaattaaacttaacgaaaaaaccggtacgggttagtttaacgtttagaactaaaagttacggaaactaacggtaccgttaaacggaaaaacccggacgggtaaaccaaccgaacggtaccccgttaaccgtttaacgtttaaaccgttacggttaaaccccgaaccgtaaacggttaacgttttacccggggtaaaacggttcggaacccgttaaacggttacccgggtaaaccgggtttaaaaggggtaacggggttaaccttttaaaggtttacgggtttaccgtttttttaagggaacgtttttaaccggtttacccgggttacccgggggggttaaccccccgtaaaggggggtaaccccgtttaagggtttacccggggg

SEQ ID NO: 114461 - DNA, 626 bp, Homo sapiens
  misc_feature: GYAE6OF02JH88M.15.86.H09.1.454.CMB.1.raw
  modified_base (242)..(242): a, c, t, g, unknown or other
  misc_feature (242)..(242): n is a, c, g, or t
  modified_base (317)..(317): a, c, t, g, unknown or other
  misc_feature (317)..(317): n is a, c, g, or t
  modified_base (348)..(348): a, c, t, g, unknown or other
  misc_feature (348)..(348): n is a, c, g, or t
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
  modified_base (527)..(527): a, c, t, g, unknown or other
  misc_feature (527)..(527): n is a, c, g, or t
tcagtctacgtagccacgaccggtgctcgatttagtgctatagacttgggtttgggggggaggaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggaagcctgggggtccctagngtctctgtgtggcctctggattcactttcagttaatggctggatgaggttggtcgcaggctcagggagggctggngtggtggacgtttcaaaagtaaatgataggngaagtaaatagactacggtgacaccgtagaaaggtaagattacgacatctacgaanacgaatactaagaaaacgtcggttaagtnttagacaagtacgaaacngtaccagtaaaaccgngaacanacgcccgtagttacttaacggtacttaaccgaacgacgtaagttacgggtaaancggtacagttaccgagggttaaacggacggcttaagtggttacctttaggtacttaacggtcggttaccgggacccgaacgggtacgtagttaccgggg

SEQ ID NO: 114462 - DNA, 738 bp, Homo sapiens
  misc_feature: GYAE6OF02FF64U.15.86.H09.1.454.CMB.1.raw
  modified_base (338)..(338): a, c, t, g, unknown or other
  misc_feature (338)..(338): n is a, c, g, or t
tcagtctacgtagccacgaccggtgctcgatttagtgctatagacttgggtttgggggggagaggagcaccagccttgggatccccaagtgttttcattcagtgatcaggactgaacacagaggactcaccatggagttcgggctgagcttgggtttccttgctgctatacttaaaggtgtccagtgtgaagtgcagggtggtggagtcgtgggggagtccgttagggtaaacgccgttcgggggggttacccttaggacggttccttccgtggtgtcgggtcccttcgtggtactttccacttttcagtaagtggcttggattggagttcgggtccnccgtaggtcctccggaaggggagggtctgggtaggttgggttacggacgttttaacgaaaagtaaaatggtaagtggtaagaagtaaaagtagacgtacggtcgacgtaacccggtagaaacggtaagacttacaacctattacaacaagtaagaactttaaacgtaacgaaaaaccggtcggttataagtttacgaactaaagtacgaaccacggtacccgtaaggaaaacccgtaggaaccacgacggtcccgttaacttacgtaccgttagaacccagtaacggtacgttacggaaacgtcgaactaacggttacgaaaccggtaggtactacgttagtacgtttagtttaagacgttaacggtccgggtacgggacccgtagggtaccttaacggg

SEQ ID NO: 114463 - DNA, 598 bp, Homo sapiens
  misc_feature: GYAE6OF02HOO18.15.86.H09.1.454.CMB.1.raw
  modified_base (423)..(423): a, c, t, g, unknown or other
  misc_feature (423)..(423): n is a, c, g, or t
  modified_base (511)..(511): a, c, t, g, unknown or other
  misc_feature (511)..(511): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtcccttagagtctcctgtgtggcctctggattcactttcagtaatggctggatgagttgggtccgcaggctccgagggaaggggctgggaggtggggttggacgtttacaaaaagtaaaaatgaagtggtagaagtaaaatagactacggtgaccaccgtagaaaggaagattcaacatctacaaganaataatacaaaaacgtacgtagtatttagacaaatgaacagacctagaaaacgagaacacgacgccgtactaacttactagtaaccanagacttcggaagtgctacgtcgacgtaaaggacggctaagtgtcttttagatacgttcggtacggggaccctagggactaagtcggg

SEQ ID NO: 114464 - DNA, 550 bp, Homo sapiens
  misc_feature: GYAE6OF02GS5GI.15.86.H09.1.454.CMB.1.raw
  modified_base (458)..(458): a, c, t, g, unknown or other
  misc_feature (458)..(458): n is a, c, g, or t
  modified_base (494)..(494): a, c, t, g, unknown or other
  misc_feature (494)..(494): n is a, c, g, or t
  modified_base (515)..(515): a, c, t, g, unknown or other
  misc_feature (515)..(515): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaagggggctgggagtgggttggacgtttacaaaagtaaaatgatggtgaagaaatagactacggtgcacccgtgaaaggagattcacatctcaagagataatacaaaacgagtagtattgacaaatagaacagacctagaaacgngacacagcctatatactagaccacagattcgaagtnacagtacgagtaaggagctangtctttagattatcgtagggcccagggacagtcgg

SEQ ID NO: 114465 - DNA, 763 bp, Homo sapiens
  misc_feature: GYAE6OF02H6ZSH.15.86.H09.1.454.CMB.1.raw
tcagtctacgtagccacgaccggtgctcgatttagtgctatagacttgggtttgggggggaggagggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttagggtaaagccgtgggggtcccttaggagtctccgtgtgtggcctgtggattcactttcagtaagtggcgtggagtgtacggttgggtccgccgaggctccggaagggaacgggcgtggaggtgggttggtacgtttaacgaaaaagtaaaaagtgtaagtggtagaagaaaagtagtaacgtaacggtgacctaacccggtagaaaaggaagacgttacgaccaacgttctacgaaaggagtaaagttaacttaaaccgaaaaaacggtaccggttaagttaattttaggaaacctaaaagtacggtaaacacgtaccgtaaaggaaaaaaccgggagaaaccgaacgtaagtcccgtaacttaattaaccgtaggttaacccaagtaacgttaacgttaacgggtaaaacggttgaccgtaaacgtaccggtaaacgggttaaaagggacggtaaccgttagtacggttacgttttaagtagttacggttccggttacgggggaacccccaaggggtaacccgtaagtttaccgggg

SEQ ID NO: 114466 - DNA, 590 bp, Homo sapiens
  misc_feature: GYAE6OF02GC9FF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttggtccgcaggctccgagggaaggggcgtggagtgggttggacgtttacgaaaagtaaaaatgaaggtagaagaaaagtagacgtacggtgacacccgtagaaaggaagatcaaccatactacgaaagagaataaattacaaaaacgtacggtagtattagacaaatgaacagacctagaaaaccgaggacacagaccgtatacttactgtaccagtagagttacggaagtgacagtcgaagtaagaggtactatgtacgtttgattagtcgtcggggaccagggtacagtggtacg

SEQ ID NO: 114467 - DNA, 793 bp, Homo sapiens
  misc_feature: GYAE6OF02H9I4V.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacgccgtggggggtcccttagacgtcctccgtgtgtggtcctcgtggtattctactttcagtaatggtctggatggagttcgggtcccgccgaggcctccgaggggaaggggctgggaggtgggttggtacgtttaagaaaagtaaaatgagtggtagaagtaaaatagacgtacggtgaccgtaacccggtaggaaaaggaagtaacttaccgaaccctagtaccttaacgaaacggtaagtaacttaaaagtttaaccgaaaaaaacccgggtagggtttaacgttaaacgtttagaaaccgtaaaaagttacggaaaacctaaccggtaacccgttaaaacgggaaaaaaccccggagggaaaccctaaaccggtaaccggtcccgtttaattaacgtttaccgttaccgtaaaccccaagtaacggtacgtttaaccgggaaagtaccgaacgtaacgttaccgggaacggtaaaagggtcgtaattaacgttggttacgttttagaacgttacgtaccgggttcggggaaccccgtaagggtacctaaggttccgggg

SEQ ID NO: 114468 - DNA, 633 bp, Homo sapiens
  misc_feature: GYAE6OF02G3MOV.15.86.H09.1.454.CMB.1.raw
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctcgtggattcacttttcagtaagtggctaggtagtggaggttgggtccgccgaggcctccgaggggaaggggctagggagtggggttggtaacgtttacgaaaaagttaaaagtgaagtggtagaagaaaatagacgtacggtagacaccgtagaaagagattcactatctanaaganataatacaaaagacgtagtattagataaatagaacagaccgtaagaaacgaggacacgaacgtccgtacgtaactttactacgttaaccaactagtaacttacggaagtagcgtaacgtcggaaacgttaagggacgtacgtaagttcggttacttttaggacttacgttacggtacgggtaacccgg

SEQ ID NO: 114469 - DNA, 705 bp, Homo sapiens
  misc_feature: GYAE6OF02IMLMG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggaggtctgggggagccttggtaaagccgtgggggtccttagagtctcctgtgtggcctctggattctactttcagtaatggctggatgaggttcgggtccgccgaggcctccgaggggaggggcgtgggaggtgggttggaacggtttacaaaaagtaaaaagtgaagtggtagaagaaaatagactacggtgacaccggtagaaaaggaagataccaacatactacgaagaataactaattaacgaaaaacggtacggttagttaaagtttacggaataaaagttagaaaccgaacgaccgtaaacggaaaaccgtaacggaacaaccgaacgtccgtacttaactttacgtacgtaacccaatacggtaacgttaccggtaagtacgacgtaacgtacggaacgggttaaagggacggtacgttagttacggttacctttttaggaagttacgtttccgggtaccggggtaccccggaagggttaccgtaagggtccggg

SEQ ID NO: 114470 - DNA, 616 bp, Homo sapiens
  misc_feature: GYAE6OF02F5ZGV.15.86.H09.1.454.CMB.1.raw
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagcctgggggtcccttagagtctcctgtgtggcctcgtggattcactttcagtaatggctggatgagttgggtccgccgaggctccgagggaggggcgtgggaggtgggttggacgtttacaaaagtaaaatgatggtagaagaaatgactacggtgccaccgtagaaaggagtatcacntacanaaganataatacgaaaacgtgtagtatttganaaatgaacagacctaaggaaaccgaggacacgagcctattactactacgtacactaagtacgttacggaagtcgactagtacgtaacggtaaaggacggtacgtaagttacgttacttttaggacgtttacgttcgggtaccggggtacccgaaggggtaactacggttccgg

SEQ ID NO: 114471 - DNA, 724 bp, Homo sapiens
  misc_feature: GYAE6OF02GD7VL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaaggtgtccagtgtgaagtgcaggtggtggagtcgtgggggagtccgttaggtaaagccgtgggggtcccttaggagtctcctgtgtggcctctggattcactttcagtaatggctggatggtaggttgggtccgcaggcctccgaggggagggcgtggaggtgggttgacgtttaacgaaaagtaaaagtgaagtggtagaagtaaaagtagaacgtacggtagaccgaaccgtaggaaaaggagtacttacacctatactacaagaagtaataataacgaaaaacggtcggttagttaagtttacgaataaagtagaaacacgaccttaaaggaaaaacccgagggaacccacacgtaccgtacttaacgttaccgtacgtaaccgaacaagttaccggttagaacggttgaccgtaaggtaacccggtaacgggtaaaagggcgggttaaccttaggttacggtttacttttaacggtaatttaacggttcccggggttaaccgggggaccccctaaaggggttaaccgtaggtttacccggggg

SEQ ID NO: 114472 - DNA, 528 bp, Homo sapiens
  misc_feature: GYAE6OF02G71KZ.15.86.H09.1.454.CMB.1.raw
  modified_base (185)..(185): a, c, t, g, unknown or other
  misc_feature (185)..(185): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtntgcatctgccttgctgggagcctcgatcaagctcacctgcaccctaagtagtgagcatcgaacctacaccatcgaatggtatcaacagagaccagggaacgtccccccaagtatataatagaaagttaagagtgatggcagccacaccgaggggacgggatcccgatcgctcagtggctccagttcgtgggtctcgaccgctacctcaccatctcccaacctccagtctagacgatgagctgagtatcactgtcggagagagccacactaatgatcggacaaggtacgggttgggtgttcgggacgggacgggacgaggccgtgaccgtcgtaggtcaaccgg

SEQ ID NO: 114473 - DNA, 622 bp, Homo sapiens
  misc_feature: GYAE6OF02FISOE.15.86.H09.1.454.CMB.1.raw
  modified_base (379)..(379): a, c, t, g, unknown or other
  misc_feature (379)..(379): n is a, c, g, or t
  modified_base (476)..(476): a, c, t, g, unknown or other
  misc_feature (476)..(476): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagcctaggtaaagccgtgggggtcccttagagtctcctgtgtggcctctggattcactttcagtaatggctggatgagttgggtccgccaggctccgaggggaggggctgggagtgggttggacgtttacaaaagtaaaatgagtggagagaaaatgactacggtncaccggtagaaaggagattacacatctacaagagaataatacaaaaacggtggtagttatttagacaaatacgaaactacgaccgtaagaaaaccgnggaacaacgagtcccgtacttaacttacgtagtacccacgtaagtacgtttacgggaagttggacctaagtacggtaacgtaagggacgtactagttgttacttttagacttactccgggtacgggaccaacgggtacagttcggg

SEQ ID NO: 114474 - DNA, 651 bp, Homo sapiens
  misc_feature: GYAE6OF02H47SI.15.86.H09.1.454.CMB.1.raw
  modified_base (302)..(302): a, c, t, g, unknown or other
  misc_feature (302)..(302): n is a, c, g, or t
  modified_base (425)..(425): a, c, t, g, unknown or other
  misc_feature (425)..(425): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccnccgaggctccgagggaaggggctggaggtgggttggacgttttacaaaagtaaaatgatggtagaagaaaatagactacggtcgacacccgtgaaaggaagattacaacctatctacaagganaattaatacgaaaaacgtaggttacgttaatttacgataaatgaaacacgaccgtaacaaaaacccgggaggaaaccaaccaacgtcccgactttaacgttaacctacggtaacccacgaactacgtttaacgggaacgtgacgtactacggaaggtaaacggaggtctagttgtaccttttagacgttagttcgacggggttacccagggtaccgaggttccggg

SEQ ID NO: 114475 - DNA, 609 bp, Homo sapiens
  misc_feature: GYAE6OF02HAITU.15.86.H09.1.454.CMB.1.raw
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctccgaggggagggctgggagtggggttggacgtttacaaaagtaaaatgatggtagaagaaaatagacgtacggtgaccaccgtaggaaaggaagattacaacatcacaaganaataataanaaaacgtacgtagttattagactaaatgaacagcctaagaaacgagaacacacgtaccgtataacttactacgtaacccacgaagtacgttacggaagtgaccgagtaccggacgtaaaggnggtacctagttgtactttagacttacgtcggtacggggcccaagggtaccgagttcggg

SEQ ID NO: 114476 - DNA, 870 bp, Homo sapiens
  misc_feature: GYAE6OF02ISLB9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttagggtaaacggtccggtcggggggttacccttaagggtaggttccgttcccgttggttcggtcgggtcccttcgttgggtaactttccgtaccttttacgaagttaaagtggtcgtggagttggtaggtttcggggtcccgccgagggccgtaccggaagggggaacgggggtctaggggaggttggggttaggtaacggtttaacgaaaaaaggttaaaaagtgaagttgggtaagaaagtaaaaagtaggtaaccgtaacggtacgaccgtaacccggtaaggaaaagggtaaacggtaacttaccgaacctaagtacctaacgaaagtaagtaacttaaaacgttaaccgaaaaaaaccggtacggttaagtttaacttacgaacgtaaaagttacgaaaacgacgtaaccgtaaacggaaaaaccgacggaaacccgaacgaacggtacccgttaactttaacgtttaccgacgttaacccaacgtaaaggtacgtttaccgggaaagttcggaaccgtaacgttaaccggtaaacggtaaaagggtcggtaacttaacgtacggtttaaccgtttttaagagtttaacggtcccgggtacccggggtaacccgtaaacggggtaacctaagggttcccgggg

SEQ ID NO: 114477 - DNA, 555 bp, Homo sapiens
  misc_feature: GYAE6OF02GOZBF.15.86.H09.1.454.CMB.1.raw
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (464)..(464): a, c, t, g, unknown or other
  misc_feature (464)..(464): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
tcagtctacgtagccacgaccggtgctcgatttagtgctatagacttgggtttggggggggagaggagccccagcctagggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagcctgggggtcccttagagtctcctgtgtggcctctggattcactttcagtaatggctggatgagttgggccgcaggctccagggaggggctggagtgggtggacgtttacaaaagtaaaatgatggtagagaaaatgactaggngcaccgtagaaaggagatcacatctnaaganataatacaaaacgcgtagtatttgacaaatgaacagacctagaaacgagacacagccgtntatactgtaccanagtatacgaagtnacatcgacgtaaggaggtctaagtgtacttttagattatcggtgggacccagggtactaggtcgg

SEQ ID NO: 114478 - DNA, 625 bp, Homo sapiens
  misc_feature: GYAE6OF02GSD0Q.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgagggaaggggctggagtgggttggacgtttacaaaagtaaaatgatggtagaagaaaatagactaggtgcaccgtagaaaggagattcacatctacaagagaataatacaaaaacgcggtagtatttagactaaatgaaacagacctaagaaaaccgagaaccacacgtccgtactacttactagtacccaacgtagtaagttacggaaagtcgacaagtaccgaacggtaaaggacgggtacttaagttcgtacgttttagtaacttacgttccggttacgggggaccccaaggggtacctaaggttcggg

SEQ ID NO: 114479 - DNA, 629 bp, Homo sapiens
  misc_feature: GYAE6OF02IM3GB.15.86.H09.1.454.CMB.1.raw
  modified_base (467)..(467): a, c, t, g, unknown or other
  misc_feature (467)..(467): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccttagagtctcctgtgtcggcctctggattcactttcagtaatggctggatgagttcgggtccgccaggctccgagggagggctgggaggtggggtgacgtttacaaaagtaaaaatgaatggtagaagaaaatagactacggtagacacccggtagaaaaggaagatttacacatctacaaagagaataatacaaaaacgacggtataatttgaactaaagtcaaacanacctaagaaaaaccgaggaacaacgagaccctactaattaacctagtaacccagtaagacttacgggaaagtcgaacatacggaacgttaaaagggcggaacttaatcggttacttttaggaattacgtacggtccggggacccaagggaacctaagtcggg

SEQ ID NO: 114480 - DNA, 573 bp, Homo sapiens
  misc_feature: GYAE6OF02IPS58.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtcgccaggctccgagggaggggctggagtggggtggacgtttacaaaagtaaaatgatggtagagaaatagactacggtgacacccgtagaaaggaagaattcaaccatactacaagagaataattacaaaaacgacggtagtatttgacaaatgaacagacctagaaaccgagacacagctctatactacgtaccacagattacggaagtgacatacgacgtaaaggaggcttatgtcgtttagattagtcgtcgggaccgacgggacaagtcggg

SEQ ID NO: 114481 - DNA, 671 bp, Homo sapiens
  misc_feature: GYAE6OF02JA918.15.86.H09.1.454.CMB.1.raw
  modified_base (420)..(420): a, c, t, g, unknown or other
  misc_feature (420)..(420): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttaggagtcgtcctgtgtcggcctctggattcactttcagtaatggctggatgagttgggtccgcaggctccaggggaaggggctggaggttgggttggacgtttacgaaaagtaaaatgatggtgagaaatagactaggtgacacccgtagaaaggagattcactatactacgaaganaataacgttacaaaacggtacggtagttaatttaggactaaaagtagtaaacgacggaccgttaaggaaaaccggacggaaccaacgacgtaccgtacttaacttaaccgtacgttaacccaagtacgtaacgttacgggaaacgtagaacgtacgtaaccgtacggtaaacgggacggtacgttaattcgtaccgttttagaacgttacgttaccgggttacgggacccgtaaggggtactaggtacggg

SEQ ID NO: 114482 - DNA, 627 bp, Homo sapiens
  misc_feature: GYAE6OF02HEYUG.15.86.H09.1.454.CMB.1.raw
  modified_base (421)..(421): a, c, t, g, unknown or other
  misc_feature (421)..(421): n is a, c, g, or t
tcagtctacgtagccacgaccggtgctcgatttagtgctatagacttgggtttggggggggagaggagccccagccttgggatccccaagtgtttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgccgaggcctccgaggggaggggctgggaggtgggtggacgtttacgaaaaagtaaaatgaatggtagaagaaaatagacgtacggtgcaccgtagaaaggagacttcaacatctanaagagataactaacgaaaacgtggtagttaattagacaaagtgaacagcctaagaaaccgagaacaccagccgtatacttactagtaccatagtagttacggaagtgacctagtaccggaacggtaaggacggtacgttaagtcggttacgttttagaagttacgttcggtaccggggaccccgtaaggggtactaaggttccggg

SEQ ID NO: 114483 - DNA, 735 bp, Homo sapiens
  misc_feature: GYAE6OF02HMY3B.15.86.H09.1.454.CMB.1.raw
tcagtctacgtagccacgaccggtgctcgatttagtgctatagacttgggtttgggggggagaggagccccagccttgggatccccaagtgtttttcattcagtgatcaggactgaacacagaggactcaccatggagttcgggctgagctgggttttccttgctgctatcttaaaaggtgtccagtgtgaagtgcaggtggtggagtctggggagccgttggtaaagccgtgggggtcccttagagtctcctgtgtggcctctggattcactttcagtaatggctggatgagttcgggtccgcaggcgtccgaggggaaggggcgtggaggtgggtaggtacgtttacaaaagttaaaatgatagggtagaagaaaagtagacgttacggtgaccgtaaccggtaggaaaaggacgtaattaccgaaccattcgtacaaagtaagaattaaactaaccgaaaaacggtacgggttagtttaagtttacgaactaaaatacgaaacgacgttacccgtaaaggaaaacccggaaggtaacccaacgtaacgggtacccgttacgttaaacgtttaccgtacgtaacccagtaaacgtacgttaacggtaaacggttcgaccgtaagttaccggaacggttaaagggaggtaaccttaagttcggtttacgtttttaacggatttacggtcccggttaccgggggacccgaaacggggtaccgtaaggtttccggg

SEQ ID NO: 114484 - DNA, 591 bp, Homo sapiens
  misc_feature: GYAE6OF02FOUKV.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgatggtagagaaaatagactacggtgcacccgtgaaaggaagattcacatctcaagagaataatacaaaaacgacggtagtatttgacaaatgaacagcctagaaaaccgagacacagccgtactattactagtaccactaagattacgggaatcggactagtacgacggtaaaggacggtctaagttggtaccttttaggattacgtcgtacgggggacccaggggtacaggttcggg

SEQ ID NO: 114485 - DNA, 636 bp, Homo sapiens
  misc_feature: GYAE6OF02IIUQ2.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatctaaaaggtgtccagtgtgaagtgcaggtggtggagtcgtgggggagccttggtaaagccgtgggggtccttagagtctcctgtgtggcctctggattcactttcagtaatggctggatgagttgggtccgcaggctcgaggggaagggcgtggaggtgggttggtacgttacaaaagtaaaatgagtaggtagaagaaagtagacgtacggtgaccaccggtagaaaggaagattcacatactacaagagataataacaaaagtacggtatatttagactaaatagaaacacgtaccaagaaaaccgacgtacaaccgacgtaccgtacttaattactacaaccaactagtacgttacgaagtcgactaacgtacggaaccggttaaaggacggtaactagttacggttacttttaggtaacttagtaccgggtacgggacccggtaacggtacgtaggttaccggg

SEQ ID NO: 114486 - DNA, 671 bp, Homo sapiens
  misc_feature: GYAE6OF02IQY6Q.15.86.H09.1.454.CMB.1.raw
  modified_base (613)..(613): a, c, t, g, unknown or other
  misc_feature (613)..(613): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttggtaaagccgtgggggtcccttagagtctcctgtgtggcctctggattcactttcagttaatggctggatggaggttgggtcccgcgaggcctacgaggggaaggggcgtgggaggtggggttggtacgtttacgaaaaagtaaaatgagtggtagaagaaatagacgtacggtgacctaccgtagaaaggaagtattacacctatactacaagagtaattaattaacgaaaaacggtacggttagttaatttacgaactaaatacgaaactacggtaccgtaacggaaaaccgacggaaccacgaacgtcccgtacttaacgttacctacgtaacccaagtacgtacgttacgggtaagtcgacgtacgtacggtaacgggtaaacggnggtacttagtcgttcgttttagatttagtcggtccgggacccgaagggactaggtcgg

SEQ ID NO: 114487 - DNA, 651 bp, Homo sapiens
  misc_feature: GYAE6OF02F9OJY.15.86.H09.1.454.CMB.1.raw
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (475)..(475): a, c, t, g, unknown or other
  misc_feature (475)..(475): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcaggctccgagggaaggggctggagtgggttggacgtttacaaaagtaaaatgatggtagaagaaaatagactaggtncaccgngaaagganatcacatcanaaagagaataatacaaaaacgtacggtattattagactaaatgaaacgacgaccctaaggaaaaacccgnggaacaacgacgtaccgttacttaattacctacgtaaacccagtaaggtaacttaccgggaaagtcgaacgtacgttacggaaccggttaaaagggacgtaacttagttaggttcctttttaagaacttacggttcggtaccgggggtaccccaaggggtacctaacggttcgggg

SEQ ID NO: 114488 - DNA, 592 bp, Homo sapiens
  misc_feature: GYAE6OF02HKF51.15.86.H09.1.454.CMB.1.raw
  modified_base (471)..(471): a, c, t, g, unknown or other
  misc_feature (471)..(471): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttcaaaagtaaaatgatggtgaagaaaatagactacggtgacaccgtagaaaggaagattacacatctacaagagataattacaaaaacggtcggtagttaatttgacaaatgaaacagacctaagaaaaccgnggaacacgagcccgtataattactcgtaccacgagtagttacggaagtgacagtcgaacgtaaggacggactagtgtcttttagattacgtcggttcgggaccctaagggacaagttcggg

SEQ ID NO: 114489 - DNA, 669 bp, Homo sapiens
  misc_feature: GYAE6OF02HX164.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaagccgtggggggtcccttagagtctcctgtgtggcctctggattcatttcagtaatggtctggatgagttgggtccgccaggctccgagggaaggggctgggaggtgggttggacgtttacaaaagttaaaagtgaagtggtagaagaaaatagaacgtacggtgaccacccggtaaggaaaggaagtactacaaccctatactacgaaagagtaataaacttaacgaaaaacggtacgggtagtttaacgtttgaaactaaaagttacgaaacgacgtaaccgtaacgaaaaccggtaaggaaccaacgacgaccgttacttattaacctacgtaacctaacaggtacttacggagtcgactacgtacgacggtaaaggcgactagttgttactttagagttacgtcgggaccggtaccggtaagggacctaagtccggg

SEQ ID NO: 114490 - DNA, 665 bp, Homo sapiens
  misc_feature: GYAE6OF02H8W1P.15.86.H09.1.454.CMB.1.raw
  modified_base (306)..(306): a, c, t, g, unknown or other
  misc_feature (306)..(306): n is a, c, g, or t
  modified_base (412)..(412): a, c, t, g, unknown or other
  misc_feature (412)..(412): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtcggcctctggattcactttcagtaatggctggatgagttcgggtccnccaggctccgagggaaggggctgggaggtgggttggacgtttacgaaaagtaaaatgaatggtagaagtaaaatagaactacggtgacgacccgtaggaaaggaanattacaacctatacctacaaagagtaataaattacaaaaacggtcggtagtactttagactaaaatgaaccagtacctaagaaaccgtaggaacacgacgtaccgtacttaattacgtcgtaaccactaagtacgttagggaacgtcgactaagtaccggtaacgtaaagggacggtcgtaacgttccggttattttaaggaacgttacgtaccggtacggggaccctaagggggaacctaagggtttccggg

SEQ ID NO: 114491 - DNA, 679 bp, Homo sapiens
  misc_feature: GYAE6OF02H6FNK.15.86.H09.1.454.CMB.1.raw
  modified_base (266)..(266): a, c, t, g, unknown or other
  misc_feature (266)..(266): n is a, c, g, or t
  modified_base (358)..(358): a, c, t, g, unknown or other
  misc_feature (358)..(358): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctctgtgtggcctntggattcactttcagtaatggctggatgagttgggtccgcaggctccgagggaggggctggaggtggtggacgtttacaaaagtaaaatganggtagaagaaaatagacgtacggtgacaccggtagaaaggagacttacactatctacaagagaattaattaacaaaaaccggtcggtttagtaatttacgaacaaagttacgaaaccacgtaccgtaaacgaaaacccggaaggaaccacgtaacgacccgtacttaacgttaactaccgtaacccaacgtaacgaagttaccggaagtcgactacgtaccgtaacgggtaaaggacggactttaagtggttaaccgtttttaggaactttacgtaccggtaccggggtaccccgtaaaggggtaccaaggtttcccgggg

SEQ ID NO: 114492 - DNA, 596 bp, Homo sapiens
  misc_feature: GYAE6OF02FS3WF.15.86.H09.1.454.CMB.1.raw
  modified_base (487)..(487): a, c, t, g, unknown or other
  misc_feature (487)..(487): n is a, c, g, or t
  modified_base (515)..(515): a, c, t, g, unknown or other
  misc_feature (515)..(515): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttgggtaaagccgtggggggtcccttagagtctcctgtgtggcctctggattcactttcagtaatggctggatgagttgggtccgccaggctccgagggaagggggctgggaggtgggttggacggtttacgaaaaggttaaaatgagtggtagaagaaaatagactacggtgacaccgtaggaaaaggaagacttacaaccatctacaagagataattacaaaacgacggtatatttgacaaatgaacagcctaagaaaaccgngacacgagccgtatattacagtacccanagattcggaagtgacatcgacgtaaggagtctagtgtcgttttagagttatcggttacgggacccagggtaccaagtcggg

SEQ ID NO: 114493 - DNA, 687 bp, Homo sapiens
  misc_feature: GYAE6OF02FX47U.15.86.H09.1.454.CMB.1.raw
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
tcagtctacgtagccacgaccggtgctcgatttagtgctatagacttgggtttgggggggagaggagccccagccttgggatcccccaagtgttttcattcagtgatcaggactgaacacagaggactcaccatggagttcgggctgagctgggtttttccttgctgctatcttaaaaggtgtccagtgtgaagtgcaggtggtggagtctgggggagccttggtaaagccgtgggggtcccttagagtctcctgtgtggcctctggattcactttcagtaatggctggatgtaggttgggtccgccgaggctccgaggggaaggggcgtggaggtgggttggacgtttacgaaaaagtaaaatgaatggtagaagaaaatagactacggtnacgaaccgtgaaaggagattacaacntacacgaagagaataatacaaaaacgcggttagttatttgaactaaatgaaacacgacctaaggaaaacccgaggaccaacgacgtcccgttactaacgttacctacggtaacccaacgaagtaacgtttaccggggaaattccggaacgacgtaccggtaaccggtaaaagggacggttacttaagttacggtttccgttttaagaacgtttacgttaccgggttaccgggggaccccttaagggggaacccttagggtttacccggg

SEQ ID NO: 114494 - DNA, 601 bp, Homo sapiens
  misc_feature: GYAE6OF02H9T8A.15.86.H09.1.454.CMB.1.raw
  modified_base (261)..(261): a, c, t, g, unknown or other
  misc_feature (261)..(261): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctntggattcactttcagtaatggctggatgagttgggtccgccaggctccgagggagggctggagtgggtgacgtttacgaaaagtaaaatgatggtagagaaaatgactacggtgacaccgtagaaaggaagtattacactatctacgaagagaataattaacaaaacggtacggttagtatttagactaaatcgaacagacctaagaaaccgagaacacgagcctactacttactacgtaccaacgtagtacgttacggaagtgacaagtacggaacgtaaagggagctagtgtacgtttttagagttactacggtcgggtacccagggtaccagttcgg

SEQ ID NO: 114495 - DNA, 912 bp, Homo sapiens
  misc_feature: GYAE6OF02JPL8J.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttagggtaaaacgccgtggggggtccccttaaggacggttcctcccgttggtcggtcggcccttcgtgggtaactttcctaaccgttttcgaagttaaagtcgggtccttagggtaattaggtaacgggtttcggggtacccccgacccgtaacggggtccctacccgggaaaggggggtaacggggggtccgttaggggtaagggttgggggttaccgggtaaacggttttaaaccgaaaaaaaaggttaaaaaagttggaagttagggtaagtaaaaggtaaaaaatacggtaaaccgttacgggtacgacccgtaaacccggtaggaaaaacgggtaaagtaacttaccgaacccgtaacttaccgtaacgaaaggaagtaacttaaaacgttaaacgaaaaaaccggtaccgggtttaagttaaacgtttacggaaacgttaaaaagttaccggaaaacgaaccggtaacccgttaaaaggaaaaaacccggtaggaaacccgaaccgtaacgggtaccccgttaacttaaacgtttaaccgtaacgtaacccgaaagtaacggtacggttaaacgggtaaacgtcgaaccgtaagtaaccggtaacggtaaagggacgtacgttattcgggtacttttaagacgttacgttccgggtacgggacccgtaagggtactaggttcgg

SEQ ID NO: 114496 - DNA, 584 bp, Homo sapiens
  misc_feature: GYAE6OF02GP5UY.15.86.H09.1.454.CMB.1.raw
  modified_base (538)..(538): a, c, t, g, unknown or other
  misc_feature (538)..(538): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgagggaaggggctgggagtgggttggacgtttacaaaagtaaaatgatggtagaagaaaatagacgtacggtgaccgacccgtaggaaaaggagattccaacatctacaagagaataattacaaaaacggtcgtagttatttgactaaatgaaacagacctaagaaaccgagacacacgccgtatatactacgtaccacgagtattcgaagtcgacatacgagtaaggngctatgtacttttgattacgtcgtacgggccctagggactagtcgg

SEQ ID NO: 114497 - DNA, 566 bp, Homo sapiens
  misc_feature: GYAE6OF02FN455.15.86.H09.1.454.CMB.1.raw
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctgggagtgggttggacgtttcaaaagtaaaatgatggtgagaaaatagactacggtgcacccgtgaaaggagattcacatctacaaagagataattacaaaaacggacggtagtaatttgactaaatgaacagcctagaaaaccgaggacacagcctatattacngtaccanagattcgaagtgcatcgacgtaaggagctatgtcttttagattagtcgtacggggccctagggactaagtcggg

SEQ ID NO: 114498 - DNA, 642 bp, Homo sapiens
  misc_feature: GYAE6OF02HK7B6.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtgggggtcccttagagtctcctgtgtggcctctggattcactttcagtaatggctggatgagttgggtccgcgaggctccgagggaaggggctgggagtgggttggacgtttacgaaaaggtaaaaatgaagtgggtagaaggaaaatagaacgtacggtcgcacccggtagaaaggaagattcaacatctacaagagaataatacaaaacgcggtagtattgacaaatgaaacagacctaaggaaaaccgaggacacgacgtccgtactaagttactacgtaaccacgtagtaacgttacgggaaagttgaaccgagtaccgaagggtaaaggaggtactaagtcgttaccgttttaggaacttacgttccgggtccggggacccggtaagggtacgtaacggttcggg

SEQ ID NO: 114499 - DNA, 661 bp, Homo sapiens
  misc_feature: GYAE6OF02I45N8.15.86.H09.1.454.CMB.1.raw
  modified_base (512)..(512): a, c, t, g, unknown or other
  misc_feature (512)..(512): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaagccgtggggtcctagagtctctgtgtcgcctctgattctacttcagtatggctggatgtagtcggtccgcaggctcgaggggagggtcgtaggaggtgggttacggtacgtttaacgaaaaaggttaaaatggagtgggtagaaagtaaaagtagacgtacggtagaccgtaccggtaagaaaaggactaacgttacgaactactacgtacgaaagagtaataacgttaacgaaaacgtggttagttattagaactaaagtacgaactacgaccgtaagaaaaccgngaaccacgacgtccgtataactaccgtactaacactagtaacgttacgaagtcacgtaacgtaacgtaggtaaagggcgtacttaagttcgttaacttttaggactttacgtccgggtaccgggacccgtaagggtactaggttacggg

SEQ ID NO: 114500 - DNA, 618 bp, Homo sapiens
  misc_feature: GYAE6OF02JAMU2.15.86.H09.1.454.CMB.1.raw
  modified_base (346)..(346): a, c, t, g, unknown or other
  misc_feature (346)..(346): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttgggtaaagccgtggggggtcccttagagtctcctgtgtggcctctggattcactttcagtaatggctggatggagttgggtccgcgaggctccgagggagggctggagtgggtggacgtttanaaaagtaaatgatggtagagaaaatagacgtaggtgacaccgtagaaaggaagtatacacatctanaaganaataattaaccgaaaaacggtcggtagttagtttagaactaaatagaacagacctaagaaaccgagacacacgccgtactattactagtaacccagagtacgttacggaagtcgtacagtacgaacgtaacggagtactaagtcgttacgttttagagttacgtcggtaccggggacccgtaagggtacgtaggttacggg

SEQ ID NO: 114501 - DNA, 676 bp, Homo sapiens
  misc_feature: GYAE6OF02HEBO1.15.86.H09.1.454.CMB.1.raw
  modified_base (416)..(416): a, c, t, g, unknown or other
  misc_feature (416)..(416): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtccctagagtctctgtgtgcctctggattcacttcagtaatggctggatgagttcgggtccgccaggctccgagggaaggggcgtggaggtgggttggtacggtttaacaaaaaggtaaaatgagtaggtagaagaaaatagacgtacggtgacaccgtagaaagagatacacatctanaagagaataactaacgaaaaacgtcggtattattagaactaaatacgaacacgtaccgtaagaaaaccgaggaaccacgacgtacctacttaacttacctacgtaacccaagtaacgtaacgtttacgggaaacgtcgaacgtaacgttaaccgggaaacggttaaacgggacgggtacttaacgttcgggttactttttaggaacgtttacggttccgggtaccggggaccccggtaaaggggtactaaggtttccggg

SEQ ID NO: 114502 - DNA, 700 bp, Homo sapiens
  misc_feature: GYAE6OF02JKKR8.15.86.H09.1.454.CMB.1.raw
  modified_base (305)..(305): a, c, t, g, unknown or other
  misc_feature (305)..(305): n is a, c, g, or t
  modified_base (420)..(420): a, c, t, g, unknown or other
  misc_feature (420)..(420): n is a, c, g, or t
tcagtctacgtagccacgaccggtgctcgatttagtgctatagacttgggtttggggggtaggagggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtgggggtcccttaggagtctcctgtgtggcctctggattcactttcagtaatggctggatgagttgggtccncgaggctccgagggagggctggagtgggtggacgtttcaaaagtaaaatgaatggagtagaaaatagactacggtgacgtaccgtagaaaacggagacttacaaccagtacctanaaacgagaagttaactttacgaaaaaaccgtacgggttagttaagtttcgacgaaaagttagaaaccagtacccttaacggaaaaacccggtaggaaccgaaccaaggtacccgtacttaacgtttaccttaagtaccctaaacgtacgtaacgtttcgggaaagttccgtacgactacgggtaacgttaaacgggaggtacgttaacgtgttaacccgttttgtaacttacgttacggtaccggggtcccggtaaaggggtaccgtaaggtttaccggg

SEQ ID NO: 114503 - DNA, 785 bp, Homo sapiens
  misc_feature: GYAE6OF02GCKJM.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactaaacacagaggactcaccatggagttcgggctgagcgtggtttccgttgcgtgctatcttaaaggtgtccagtgtgagtgcaggtggtggagtctgggggagccttggtaaagccgtgggggtccttagagtctcctgtgtggcctcgtggattcactttcagtaatggctggatgaggtttcgggtccgccgaggcctaccgaaggggaacggggcgtagggaggttggggttaggtacgtttacgaaaaagtaaaagtgaagtggtagaagtaaaagtagacgtacggtgaccgaaccggtagaaacggaagtacttacgaacctaactaccgtacaaaggtacgtaaacttaaacgttaaccgaaaaaacgggtacggtttagtttaacgttttacggaactaaaagttcggaaacctacggtaacccgtaaacggaaaaacccggtaggaaacccaaccgtaacgaccccggttacctttaaacgttaccctaacggtaaccccgtaacgtaaggtaaccgtttacggggaaacgttacgaccgtaaagttacccgggaaacggttaaagggacggttaaccgttaggttacgtttacgttttaggaacgtttacgtacgggttaccggggaccccgtaaggggaacttaacgggttccggttaccgg

SEQ ID NO: 114504 - DNA, 610 bp, Homo sapiens
  misc_feature: GYAE6OF02GMCKP.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgcaggctccgagggaaggggcgtggagtgggttggacgtttacgaaaagtaaaatgagtggtagaagaaaatagactacggtgacgaccgtagaaaggagattcacatctacaagagaataatacaaaaacgtcggtagtaatttgacaaatgaaacacgacctaagaaaaccggagaaccacgacgccgtactaattacctacgtaaccacgaagtacgttacggaagtcgacagtacgaacgtaaaggaggtctaagttcgtcttttagattacgttcggtacggggacccagggtactaggttcgg

SEQ ID NO: 114505 - DNA, 115 bp, Homo sapiens
  misc_feature: GYAE6OF02F6XTY.15.86.H09.1.454.CMB.1.raw
  modified_base (114)..(115): a, c, t, g, unknown or other
  misc_feature (114)..(115): n is a, c, g, or t
tcagtctacgtagccacgaccggtgctcgatttagtgctatagacttgggtttgggggggagaggagccccagccttgggatccccaagtgttttcattcagtgatcaggactnn

SEQ ID NO: 114506 - DNA, 842 bp, Homo sapiens
  misc_feature: GYAE6OF02I8D7Z.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatggaggttgggtccgtccgagggcctccggaggggaacggggtcgtgggtaggtggggttcggtaccgtttaacgaaaaaggtaaaaagtggagttagggtaggtaaaggtaaaaattaggtaaacgtacggtcgtaccgtaacccgggtaaggaaaagggaacgtaacgttaccgaaacccgtaagttaccctaaccgaaaggtaacggtaaactttaaacgtttaaacccgaaaaaaacggtaccggggttaagtttaaagttttacgaaaccgttaaaaagtacggtaaaacctaacggtaacccgttaaacggaaaaacccggtaggaaacccgtaaccggaaacgttacccgtaacccgttaaaaggtttacccgttaacgtaaccccgtaacgtaaacggttaaccgtttaaggggaaacgtacggtacctaagggtaccgtaacggttaaaagggcggtaaacttaggttacggttaaccgttttacggaagttaccgtttccgggtaccggggtaaccctaagggggttacctaaggttccgggg

SEQ ID NO: 114507 - DNA, 609 bp, Homo sapiens
  misc_feature: GYAE6OF02GVIZJ.15.86.H09.1.454.CMB.1.raw
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattctactttcagtaatggctggatgagttggtccgccaggctccgagggaaggggctggagtgggttggacgtttacgaaaagtaaaatgatggtgaagaaatagactacggngaccaccgtagaaagagacttcactatcacaaganaataatacaaaacgtcggtagttattgacaaatagaacagacctaagaaaccgacgacacgagtacctacttacttaactacgtaaccacaaggtacgttacggaagtgactacgtacggagttaaaggacgtacttagttcgttacgttttagatacgttcggtaccggggaccctaagggtacctagtcggg

SEQ ID NO: 114508 - DNA, 667 bp, Homo sapiens
  misc_feature: GYAE6OF02H9M8S.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtctgcatctgccttgctgggagcctcgatcaagctcacctgcacctaagtagtgagcactcgaacctacacccatcgaatggtatcaacagacgaccagggacgtcccccagtatataactagaaagttaagagtagatggacagaccaacgaaccggaaacgggggacggacgtaccccggatccgcttacgagtacgggcctccgtaagttcgtcggggctggacccgtctacctccaccgtacttccaccctaacctccagtaccgtagacgtagtcgacggtcctaggtaacgtactacctaggttacgtagggacgagaccgacctaacgaacctaagttcgaacgtcggtaaccgaacgggttacgggtttacgggggtacgggtttaccggggacccggggtaaagggtacccgggtaacggtaccggttaccgggttaaccccgggttaccggtacgggtaccgtaaccccgggg

SEQ ID NO: 114509 - DNA, 616 bp, Homo sapiens
  misc_feature: GYAE6OF02FMYGW.15.86.H09.1.454.CMB.1.raw
  modified_base (433)..(433): a, c, t, g, unknown or other
  misc_feature (433)..(433): n is a, c, g, or t
  modified_base (449)..(449): a, c, t, g, unknown or other
  misc_feature (449)..(449): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgccagggcctccgagggaaggggctggagtggggtggtacgtttacgaaaagtaaaatgagtggagaagtaaaatagacgtacggtgccgaacccggtagaaaggaagtattaccaacatctacaaaganataatacgaaaaacgnggtagtatttgactaaatcgaacagcctaaggaaaccgagacacagcctactaatactgtaccacagtacttacggagtacgacagttacggaacgtaaggacggtactagtcgtacgttttagagttacgttcgtacggggtaccctaacgggactaggttacggg

SEQ ID NO: 114510 - DNA, 681 bp, Homo sapiens
  misc_feature: GYAE6OF02JUZD0.15.86.H09.1.454.CMB.1.raw
  modified_base (369)..(369): a, c, t, g, unknown or other
  misc_feature (369)..(369): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (490)..(490): a, c, t, g, unknown or other
  misc_feature (490)..(490): n is a, c, g, or t
tcagtctacgtagccacgaccggtgctcgatttagtgctatagacttgggtttgggggggaggagggaggccccagccttgggatccccaagtgttttcattcagtgatcaggactgaacacagaggactcaccatggagttcgggctgagctgggtttccttggctgctatcttaaaaggtgtccagtgtgaagtgcaggtggtggagtcgtggggagccttgggtaagccgtgggggtcccttagagtctctgtgtggcctcgtaggattcactttcagtaatggtctggatggtacggttgggtccgccgtaggcctaccggaagggggacggggtctgggtaggtgggttgggaaccggttttanaaaaaggtaaaatggaagtgggtcgaagtaaagtcgataacggtgacaccggtagaagagatcgacatcanaanacgataactaagaaaaccgtaggtacgttaattaggactaaaagtanaaacgacggtaacctaacgggaaaaccgaggaaccaacgttacggaccgtttactaaagttaccgtacgtaacccaagaagtaacgtttaccgggaaagtcgacttaaggacccgtaaggtaaaggtcggactttaagtatcgtttaagagttaacgtcggtcccggggaacctagggtataaccggtcgg

SEQ ID NO: 114511 - DNA, 717 bp, Homo sapiens
  misc_feature: GYAE6OF02FPK27.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtgggtgggagtcgtgggggagtccgttggtaaagccgtggggggtcccttagagtctcctgtgtggcctcgtggattctactttcagtatggtctggatggtagttcgggtccgccgaggtcctccgaggggaacggggtcgtgggaggtggggttggtaacgtttaacgaaaaaggtaaaatgagtggtagaagaaaatagaacgtaggtacgaccgtaaccgtaaggaaaaggaagtacttaccgaacctaatcccgtacaaaggacgtaaattaacgtaaaccgaaaaacggtcggttaagttaatttacggaactaaagtacgaaactaccgaccgtaaaggaaaaccggaggaacacgacgtaccgtattaacttgactaacccgatacggtattacgggaatcgtaacgagtaaccggaaggtaaaggcgtaaccgttagttacgttcgtttaagagtttaccggttccgggtacccggggacccggtaaagggtactagggtttcccggg

SEQ ID NO: 114512 - DNA, 602 bp, Homo sapiens
  misc_feature: GYAE6OF02JKZ21.15.86.H09.1.454.CMB.1.raw
  modified_base (382)..(382): a, c, t, g, unknown or other
  misc_feature (382)..(382): n is a, c, g, or t
  modified_base (413)..(413): a, c, t, g, unknown or other
  misc_feature (413)..(413): n is a, c, g, or t
  modified_base (444)..(444): a, c, t, g, unknown or other
  misc_feature (444)..(444): n is a, c, g, or t
  modified_base (496)..(496): a, c, t, g, unknown or other
  misc_feature (496)..(496): n is a, c, g, or t
  modified_base (531)..(531): a, c, t, g, unknown or other
  misc_feature (531)..(531): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctggagtgggtggacgtttacaaaagtaaaatgagtggtagtagaaaatagactacggtncaccgtgaaacggagatcactatcacaaganatataacaaacgcgtgtattgacaaatgaanagaccgttagaaaaccgtggaacacgaagcctactaattactacgtaccaanagagttaccgagtagactagacgtaacgtaaaggnggtacctagtacgtacgttttacgaagttacgttcggtaccggggacccgaggggtaactagttaccgggg

SEQ ID NO: 114513 - DNA, 794 bp, Homo sapiens
  misc_feature: GYAE6OF02IYVJN.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggaagtaacgtcgggtcgggtaccgtagtcgtcctcgtgtgtcgtcctgtagtcttacttacttacgtaagtaaggtgtcgtagtagtaggttacgggttccggtcccgtaccggacggtccctaccgggaagggggacggggtcggtacgggttaggggttcggggttacgggttaacggtttaaaacgtaaaaaaggttaaaagtaggtaagttaggtaaggaaaagtaaaagtacgtaacgtacgggtacgaccggtaccggtaaaggaaaggaactacgtaccaacctatactaacgaagtaagtacttaaaaccgtaaaacgaaaacggttcggttaagtttaacgtacgaaaacgtaaagtacgaaacgtacccgtacgtaaaaccggaaaccggtacgaaaccacgtaccggtaccgttaaacttagtttaaccgtaacgaaccctaaggtaacgttaaccggttaacggagtacgtacgtaagtaccggtaaaggtaagggcttaactggttactttcgttataacggtttcgtacccggggcggtaaccggacggtacgttacgg

SEQ ID NO: 114514 - DNA, 712 bp, Homo sapiens
  misc_feature: GYAE6OF02JAAIS.15.86.H09.1.454.CMB.1.raw
  modified_base (390)..(390): a, c, t, g, unknown or other
  misc_feature (390)..(390): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttggtaaaagccgtggggggttcccttaggagtctcctgtgtcggccgtcgtggattcactttcagtaatggcgtggatgaggtttgggtcccgccgtaggctccgaggggaaggggcgtgggtaggtggggttggtacggtttacgaaaaaggttaaaagtgaatggganaagaaaatagacgttacggtgacgaccgtagaaaggaagtattcgaacctagtacaccaagacgtaataacgtaacaaaaaacggtacgggttagttagtttacggaactaaagtacgaaacgtaacgaccttaacggaaaaaccgaggaaccgaacaacgtccgtacgttaacgttaacttaccgttaaccaacgtaaggtaacttaccgggtaaaggttcgaactagtaccgggtaacgtaaaggtacggacgttaagtcgttacgttttaggactttaggtccggttaccgggcccgtaaaggggacgtaaggttccgg

SEQ ID NO: 114515 - DNA, 677 bp, Homo sapiens
  misc_feature: GYAE6OF02FFSP7.15.86.H09.1.454.CMB.1.raw
  modified_base (404)..(404): a, c, t, g, unknown or other
  misc_feature (404)..(404): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccctttagagtctcctgtgtggcctctggattcactttcagtaatggctggatgtagttgggtccgccaggcctccgaggggaaggggctggaggttgggttggtacgtttacaaaaagtaaaatgatggtagaagaaaatagactaggtgcgaccgtagaaagganattcacatctacaagagaataattaacaaaacgtacggtagtaatttagactaaagtacgaaacacgaccttaaggaaaacccgaggaaccacgacggtacccgttacctaagtttacctagtaaccctaacgaagtacgtttaaccgggaagtttcggactaacggtaccggtaaccggtaaagggacggtacgtagtttacggtacttttttacgaagtttacgttaccgggttaccggggggcccctaagggggtaccttaaggttcggg

SEQ ID NO: 114516 - DNA, 620 bp, Homo sapiens
  misc_feature: GYAE6OF02HQYBL.15.86.H09.1.454.CMB.1.raw
  modified_base (561)..(561): a, c, t, g, unknown or other
  misc_feature (561)..(561): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagccgtgggggtcccttagagtctcctgtgtggcctctggattcactttcagtaatggctggatgagttggccgcaggctccgagggacgggcgtggaggtgggttggtacgtttacgaaaaagtaaaatgagtaggtagaagaaaagtagactacggtgaccaccgtagaaaggaagacttacacctatctacaagagaataaataacgaaaaacgtcgtagttaatttagactaaaatacgaacaacgacgaagaaaaccgagaacacgacgaccgtacttaacttactacgtaccacgaacgtaagtacgaagtcacgacgtacgaggtaaaggnggtactagtgttacgtttagtatacgtcggtacgggaccctaaggggactagttacggg

SEQ ID NO: 114517 - DNA, 639 bp, Homo sapiens
  misc_feature: GYAE6OF02GFUXF.15.86.H09.1.454.CMB.1.raw
tcagtctacgtagccacgaccggtgctcgatttagtgctatagacttgggtttgggggggagaggacgccccagccttgggatccccaagtgttttcattcagtgatcaggactgaacacagaggactcaccatggagttcgggctgagctgggtttccttgctgctatcttaaaaggtgtccagtgtgaagtgcaggtggtgagtctggggagccttggtaaagcctgggggtcccttagagtctcctgtgtggcctctggattcactttcagtaatggctggatgagttggtccgcaggctccagggagggctggagtgggttggacgtttcaaaagtaaaatgataggtgagaaaatagactacggtcgcacccgtgaaacggagattcaccatctcaagacataattacaaaacgacggtgtaatttgactaaatgaaacagaccgtagaaaacccgaggaaccaacacggacctacgtaacttacctaggtaaccccaacgacgtacgtttaccggggaaacgttcgacgtaacttaccggaaccggttaaagggacgggtactaacgttcggtacctttttaggaattacgttccggttacgggggaccctaaggggtactaacggttacggg

SEQ ID NO: 114518 - DNA, 689 bp, Homo sapiens
  misc_feature: GYAE6OF02I8VJN.15.86.H09.1.454.CMB.1.raw
  modified_base (441)..(441): a, c, t, g, unknown or other
  misc_feature (441)..(441): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttgggctgagctgggttttccttgctgctatcttaaaaggtgtccagtgtgaagtgcaggtggtggagtcgtgggggagccttggtaaagccgtgggggtcccttagagtctcctgtgtggcctctggattcacgtttcagtaagtggctggatgagttgggtccgtcgaggctccgaggggaaggggtccgtggaggtgggttggacggtttacaaaaagtaaaatggataggtagaagaaaatagactacggtgacgtacccggtagaaaggaagtattacgaccaattctacgaacgtaanaacttaactttaacgaaaaaacggtacggttagttaagtttacgaataaaacgtagaaactacggaacctaacggaaaacgtaccggaacaaccgacgtcccgttaccttaagtttaaccgtcgtaacccagtacggtaacgtttcggaacgtgtaccgattaccggaacggttaacggacggtactaagttgttcgttttaagagtttacgtaccggtagggtaccccggagggtacaggttccggg

SEQ ID NO: 114519 - DNA, 645 bp, Homo sapiens
  misc_feature: GYAE6OF02FZ52B.15.86.H09.1.454.CMB.1.raw
  modified_base (466)..(466): a, c, t, g, unknown or other
  misc_feature (466)..(466): n is a, c, g, or t
  modified_base (502)..(502): a, c, t, g, unknown or other
  misc_feature (502)..(502): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtcgtgggggagccgttggtaaagccgtgggggtcccttaggagtctcctgtgtggcctctggattcactttcagtaatggctggatgtagttgggtccgccgaggctccgagggaaggggcgtggaggtgggttggacgtttacgaaaagtaaaagtgaagtggtagaagtaaaatagtactacggtgccgaaccgtaggaaaacggaagacttacaaccatctacaagtagaattaattaacgaaaacgtcgggttntaatttgacaaagtgaaaccagcctaagaaaaccgnggaaccagaacgaccgtacttaagttaccaggttaacccacgaagtacgttacggaattcggacaagtacgtaacggtaaaggcgtcgttagtcgttcttttagattacgtcgtaccggggaccctagggtaactagtacggg

SEQ ID NO: 114520 - DNA, 741 bp, Homo sapiens
  misc_feature: GYAE6OF02GVVQO.15.86.H09.1.454.CMB.1.raw
  modified_base (269)..(269): a, c, t, g, unknown or other
  misc_feature (269)..(269): n is a, c, g, or t
  modified_base (670)..(670): a, c, t, g, unknown or other
  misc_feature (670)..(670): n is a, c, g, or t
tcagtctacgtagccacgaccggtgctcgatttagtgctatagacttgggtttggggggggagaggagccccagccttgggatccccaagtgttttcattcagtgatcaggactaaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggnttctactttcagtaagtggctggatggtaggttcggggtcccgccgaggcctaccggaagggggtaacgggggcgtaggggagggttgggggtttacgggtaaccggttttaacgaaaaaaggttaaaaagtggtaagttagggtaggaaaggtaaaaataggaacgtacggtacgaccgtaacccggtaaggaaaaggaagtaacttaccaacctagtactaacaaagagtaattaaacttaacgaaaacggtacggttagttaatttacgactaaaagtagaaacacgacccgtaacggaaaaccgaggaacctaacgacgtacccgttacttaacgttactacgtaacccacgagttaacgttaacgggaagttcgacgtaagtaccgaaggtaaggngtacgttagtacgtttacgtttagattacgtcgggtaccggggaccctaagggactacggtcggttaccgg

SEQ ID NO: 114521 - DNA, 600 bp, Homo sapiens
  misc_feature: GYAE6OF02H17E3.15.86.H09.1.454.CMB.1.raw
  modified_base (540)..(540): a, c, t, g, unknown or other
  misc_feature (540)..(540): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtccttagagtctcctgtgtggcctctggattcactttcagtaatggctggatgagttgggtccgcaggctccgagggaaggggctggaggtgggttggacgtttacaaaagtaaaaatgaatggtagaagaaaatagactacggtgcaccgtagaaaggaagtatcacatctacaaagagataattacaaaaacgacggtagtatttagacaaatgaaacagacctaagaaaaccgaggaacacgacgccgtacttaatacctagtaccaacagtaagttacgaagtgacagtacgaagtaaaggnggtactaagtggtcttttaggattacgtcgtaccggggacctaacgggaccaagttcggg

SEQ ID NO: 114522 - DNA, 587 bp, Homo sapiens
  misc_feature: GYAE6OF02FUIX5.15.86.H09.1.454.CMB.1.raw
  modified_base (321)..(321): a, c, t, g, unknown or other
  misc_feature (321)..(321): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgcaggctccagggaggggctggngtgggtgacgtttcaaaagtaaaatgatggtagagaaaatagactacggtgcaccgtgaaaggagattcacatctnaaganataatacaaaacgacgtgtatttgacaaatgaaacagacctaggaaaaccgaggacacgacgccgtactattaccgtagtacccacgagtattcggaaagtggacagtccgaacgtaaagggaggtactaattcgtacttttgaagttacgttcgtcggggaccccgaggggtacctaagtcggg

SEQ ID NO: 114523 - DNA, 628 bp, Homo sapiens
  misc_feature: GYAE6OF02IXJV1.15.86.H09.1.454.CMB.1.raw
  modified_base (327)..(327): a, c, t, g, unknown or other
  misc_feature (327)..(327): n is a, c, g, or t
  modified_base (381)..(381): a, c, t, g, unknown or other
  misc_feature (381)..(381): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtgcctctggattcactttcagtaatggctggatgagttgggtccgccaggctccgagggaggggcgtggnggtgggttggacgtttacaaaaagtaaaatgatggtgaagaaatagactaggtncaccgtgaaaggaagattcacatactcaaagagaataattacaaaaacgtcggtagtatttgacaaatgaacagacctaaggaaaaccgaggaacacgacgccgtactacttacgtacgtaaccacgtaagtacttacgggaagttcgacgtacgtaccggaacggttaaaggacggtacgttaatcggttactttttaggattacgttccggtacggggtacccgaaggggtacctaagttcgggg

SEQ ID NO: 114524 - DNA, 641 bp, Homo sapiens
  misc_feature: GYAE6OF02G6QUR.15.86.H09.1.454.CMB.1.raw
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
tcagtctacgtagccacgaccggtgctcgatttagtgctatagacttgggtttggggggggagaggagccccagccttgggatccccaagtgttttcattcagtgatcagggactgaacacagaggactcaccatggagttcgggctgagctgggtttccttgctgctatctaaaaggtgtccagtgtgaagtgcaggtggtggagtcgtggggggagtccgttgggtaaagccgtggggggtcccttagacgtctcctgtgtggcctctggattctacttcagtaatggctggatgagttggcgccaggctcgaggacgggntggagtggtgacgttanaaaagtaaangatggtagaagaaatagacgtaggtgaccgtaaccgtagaaaaggtaagtacgttaccaactattacgacgaaagtagaattaaacgttacgaaaaaacggtcggttacgttaatttaggactaaaagtcgaaacgacgtactaaacgggaaacgacgaacacgagtcctagttaatacctgacctacagtactacggtaagtcgacgaactcggaacgtaacggaggtacttagttcgtacgtttagaacttacggtcgttaccggggacctaagggacctaggttcggg

SEQ ID NO: 114525 - DNA, 791 bp, Homo sapiens
  misc_feature: GYAE6OF02HMMYI.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggttttccttgctgctatcgttaaaaggtgtccagtgtgaagtgcgaggtggtggagtcgtggggagtccgttgggtaaagccgtagggggtacccttaggacgttctccgtgtgtcggcctgtggtattctacgtttcgagtaatggtctaggagttggtaggttcgggtccgccgaggtccttaccggaaggggtaagggtccgtgggtacggtggggttacggtacgtttaacgaaaaaggtaaaacgtggaagttaggtaagaaacgtaaaagtagaacgtacggtacgacctaaccggtagaaaaggtatacttacgaacctactacgtaacgaacgagtaacgttaacgttaagaaaaacggtcggttagttaagtttacgaactaaaagtcggaaaccgtaaggtacccgttaaaaggaaaacccggagtaacccgaacgtacggtacccttacgttaaacttacccggtagttaaccccgaaagttacggtaacgtttaccgggtaaaagtcgtaaccgaaggtttaacccggaacgggtaaaacgggtgttaacccttaggttacgttacgtttaacggattacgggttcgggaaccgggtaccccgaagggtacctaaggtttcccgggg

SEQ ID NO: 114526 - DNA, 629 bp, Homo sapiens
  misc_feature: GYAE6OF02HIZ3K.15.86.H09.1.454.CMB.1.raw
  modified_base (396)..(396): a, c, t, g, unknown or other
  misc_feature (396)..(396): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaagtggcttggatggtagttgggtcccgccaggctccgaggggaacggggctggaggttgggttaggtacgtttacgaaaaaggtaaaatgatgggtagaagaaaatagacgtacggngaccgaccgtagaaaggagattcactatcacaagataataatacgaaaaacgcggtagttagtttagactaaagtacgaacagtacctaaggaaaacgagaaccacgacgacctactaattactacgtaccanagtacttacgggaagtcgactagtacgaacggtaaggacggtactagttcgttactttagattacgtacgtacggggtacccaagggtactaggttcggg

SEQ ID NO: 114527 - DNA, 635 bp, Homo sapiens
  misc_feature: GYAE6OF02ICTXC.15.86.H09.1.454.CMB.1.raw
  modified_base (362)..(362): a, c, t, g, unknown or other
  misc_feature (362)..(362): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccgaggctccgagggagggctggagtgggtggtacgtttacaaaagtaaaatgatgggtanaagaaatagactacggtgcgacccgtagaaaggaagtatacacatctacaagagataatacaaaaacgtacggttagtatttagaactaaagtacgaaacagacctaaggaaaaacccgaggaacacacgctactattacctagtaccacaagagttacggaagtcgacgtagacgtaacgggtaaaggacggtacgttattaggtacctttttaggaacttacggttaccgtaccggggggtaaccccagggggttaaccaagttaccgggg

SEQ ID NO: 114528 - DNA, 772 bp, Homo sapiens
  misc_feature: GYAE6OF02IA5XJ.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaagccgtgggggtcccttagagtctctgtgtggcctctggattcactttcagttaatggtctggatggagttgggtccgccaggcctaccgaggggaacggggctgggaggtgggttggacgtttacaaaagtaaaagtgagtgggtagaagaaaagtagacgtaacggtcgacgtaaccggaggaaaggaagtacttaccacgtaactactacgaagaagtaacttaaactttaacgaaaaacggtacgggtttaagtttaagtttaacggaacgtaaaagtaggaaacctaacggtaacccgttaaaggaaaaaaccccggtagggaaacccaaccgtaacgtaccccggtttaaacttaacgtttaacccgtacgggttaacccctaacgtaacgttaacggtttaaccgggaaacggttcgaacccgttaagtaacccgggtaaacgggttaaaaggggtaacggtcgtttaacgttcggttaccgtttttagaacgttacgttccgggaaccgggtacccgaagggtactaggtaccgggg

SEQ ID NO: 114529 - DNA, 713 bp, Homo sapiens
  misc_feature: GYAE6OF02JSE4H.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggtccgcgaggctcgagggagggcgtggaggtgggttggacgtttagaaaagtaaaagtgagtggtagaagaaaagtagacgtaacggtgacgacccgtaggaaaggaagtacttcactatactacgaagagtaattaattaacgaaaacggacggttagttaactttaggaactaaaagttacgaaacgtacgaccgttaacggaaaaaccggtaacgaacgaaccgtaacggtacccgtaacgttaacttaccgtacgttaaccaacgaagtacgttaccggaaagtcgaacgtaacgtaccggaaaggttaaacgggaagggttccttaaggttcgttaacgttttaggtaacgttaaccgttaccgggttacccgggggtaccccgtaaagggggtaaccttaaggttccgggg

SEQ ID NO: 114530 - DNA, 793 bp, Homo sapiens
  misc_feature: GYAE6OF02HF8TJ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgtgacgtgctatacgttaaagtgtccagtgtgaagtgcgaggtgggtggagtcgtgggggacgtccttagggtaaaggcccgtggggggttccccttaggacgttcctccgtggtggtcggtccgttcgtggtattcctacttttcgaagttaagtgggcttggaagttggtaggtttcgggtccccggcctacgggtcctacccgggaagggggaaggggcggtgggtagggttggggttacgggtaacggtttaacgaaaaaaggttaaaaagtggtaaagttagggtaagtaaaaggtaaaaactaaggtaaccgtacgggtacgaacccgtaaacccgggtaaggaaaaacgggtagtaaacgttacccaactacttacccgtagaaacgtaagtaacttaaacgttaaccgaaaaaacggtggttaagttaacgtttagaactaaagagaactacgaccgtaagaaacccggagacaacgcgaccgtactagtcaccgtgaaaccctagaatcgttacgggaaattcgacgttaacgacggtaacggtaaacggtgaccgtttaagtcggtttaccgtttaggaactttacgggtaccggttacccggggaccggtaagggtacctacgggg

SEQ ID NO: 114531 - DNA, 567 bp, Homo sapiens
  misc_feature: GYAE6OF02GTVW3.15.86.H09.1.454.CMB.1.raw
  modified_base (460)..(460): a, c, t, g, unknown or other
  misc_feature (460)..(460): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgcagcctctggattcgtctttagcagctatgccatgagctgggctcgccaggctccgagggaagggctggagtgggtctcgtgcttatcctggcaggtggtgatatcgaatactacgcagactcgtaggaacgggccggtttcacgtgtttaccagacgtaacaattaccaaagaacaacacttagtattctgacagatgaccagccngagacgcgaggacacggctaatattactgtagaccggaaacgccaaaggtacttttagggtagttacggtttaatttacgttacctttagtacctttcgttacgggg

SEQ ID NO: 114532 - DNA, 670 bp, Homo sapiens
  misc_feature: GYAE6OF02GM546.15.86.H09.1.454.CMB.1.raw
  modified_base (490)..(490): a, c, t, g, unknown or other
  misc_feature (490)..(490): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggttttccttgctgctatcttaaaaggtgtccagtgtgaagtgcaggtggtggagtcgtgggggagtccgttaggtaaaagcccgttgggggggttcccctttaggacggttccttcccgtggtgtcggcctcgtggtattcactttcgaagtaatggctggatggtagttcgggtcccgcgaggctccgaggggaagggctgggaggtgggttggtacgtttacaaaaagtaaaatgagtggtagaagaaaatagacgtacggtgaccaccgtagaaaaggaagattacacatactaagagaataatacaaaacggtgtagtaatttgaactaaagtnaaacgagaccgtaagaaaaccggagaccaacacgtccgtataacttacgtactaaccacgaagtaacttaccggaagtcgaacgtaacgtacggaacggtaaggacggtacttaagtacgttacgttttagaacttagtaccggttcggggacccaagggtaacctaggtggttacccgg

SEQ ID NO: 114533 - DNA, 597 bp, Homo sapiens
  misc_feature: GYAE6OF02I1OJ5.15.86.H09.1.454.CMB.1.raw
  modified_base (216)..(216): a, c, t, g, unknown or other
  misc_feature (216)..(216): n is a, c, g, or t
  modified_base (374)..(374): a, c, t, g, unknown or other
  misc_feature (374)..(374): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggganccttggtaagctgggggtccttagagtctctgtgtgcctctggatcacttcagtatggctggatgagttgggtccgcaggctccgagggaaggggcgtggagtgggttggacgtttacgaaaagtaaaatgagtggtagaagaaaatagacttacggngacaccgtagaaaggagattacactatctanaaganataactacaaaacgtacgtagtaatttagactaaagtagaacagacctaagaaaacgagacaacgagaccgtactattacctagtaccatagtacgttacggaagtgacagtacggaacgtaaggacggcttagtgttactttagaacttacgtcggtaccgggacccgaacgggtactagttcggg

SEQ ID NO: 114534 - DNA, 733 bp, Homo sapiens
  misc_feature: GYAE6OF02G7G0U.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttggtaaagccgtggggggtcccttagagtctcctgtgtggcctctggattcactttcagtaatggctggatgagttgggtccgcgaggctccgagggaggggctggagtgggttaggacgtttacaaaagtaaaatgtagtggtagaaagaaaagtagaacgttacggtagaccgtaacccggtaggaaaagggtaagtaacgtttaccaaccgtaattacccgttacgaaaggtaagtaatttaaacgttaacgaaaaaaccggtccgggtttaagtttaatttacgggaaacttaaagtacgtaaaccgagaccccgttaaggaaaaaccggaggaacctacgaggtcccgttaattagttaaccgtaccgtaccgtaacgtaggtaaccgtttaccgggaagtgtaccgaacttacggaacgggttaaagggcggtacttaggtttcggtacttttttagggacttaaggtccggttacgggggacccctaaggggtacaagggttcgg

SEQ ID NO: 114535 - DNA, 612 bp, Homo sapiens
  misc_feature: GYAE6OF02ILU72.15.86.H09.1.454.CMB.1.raw
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (489)..(489): a, c, t, g, unknown or other
  misc_feature (489)..(489): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgagggaggggctgggaggtgggttggacgtttacaaaagtaaaatgatggtagaagaaaatagactacggtgcaacccgtagaaaggaagattacacatctanaaganaataattacaaaagngtagtattaganaaatgaaacagaccgtaagaaaaccgagaaccaacacgacctntaattactagtaacccagtaacgtacttacggaagttgactagtacggacgtaaaaggcggtacttaagtgttacttttagagttacgtccgtacggggacccaagggtaccgtaagttcggg

SEQ ID NO: 114536 - DNA, 658 bp, Homo sapiens
  misc_feature: GYAE6OF02G2BX9.15.86.H09.1.454.CMB.1.raw
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
  modified_base (418)..(418): a, c, t, g, unknown or other
  misc_feature (418)..(418): n is a, c, g, or t
  modified_base (545)..(545): a, c, t, g, unknown or other
  misc_feature (545)..(545): n is a, c, g, or t
  modified_base (616)..(616): a, c, t, g, unknown or other
  misc_feature (616)..(616): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcggtggtttcgtgacgtgctatacgtaaaagtgtcagtgtgaagtgcaggtggtggagtcgtggggganccttggtaaagtccgtggggggccctttagagtctcctgtgtggcctntggattcactttcagtaatgctggatgagttggccgcgtaggctcgagggagggctggagtgggtggacgtttacgaaaagtaaaatgataggtgaagaaaatgaacgtacgtgacctaccggtagaaacggagattaccgactactcctanaaggtaatactaaattaaccgaaaaagtcggtagtttaagtttagaaactaaagtacgaacgacgtacctaaggaaaaccgagaaccacgagtacccggtactaacgttaacgacgttaacccgaanaacggtacttaacgggaagtcgactagtacccggaacggtaaaggacggtacgttatagttccgttttaanacgtacgttacgggaccgggtaccgtaaggtacgtaaggtcg

SEQ ID NO: 114537 - DNA, 639 bp, Homo sapiens
  misc_feature: GYAE6OF02J0V8C.15.86.H09.1.454.CMB.1.raw
  modified_base (423)..(423): a, c, t, g, unknown or other
  misc_feature (423)..(423): n is a, c, g, or t
tcagtctacgtagccacgaccggtgctcgatttagtgctatagacttgggtttgggggggaggaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccgttggtaaagccgtgggggtcccgttagagtctcctgtgtggcctcccctggattcacttttcagttaatggctggatgagttgggtccgcctaggctccgagggaaggggcgtggagtgggttggacgtttacgaaaagtaaaagtagagtggtagaagaaaatagtaactacggtgaccaccgtagaaagaagatacgacatntacaagagataataacaaaacgcgttatagttagctaaatacgaactagaccctaggaaaacccgagtaacaccaagccgtactaattaccgtataccacgaagacgtttacggaagttcgactaagtaccgaagtaaaggtacgacttaacgtgttaacgttttacgtagttaacttccgggtaaccggggccctaaaggggacctaagttcggg

SEQ ID NO: 114538 - DNA, 897 bp, Homo sapiens
  misc_feature: GYAE6OF02JYCI3.15.86.H09.1.454.CMB.1.raw
  modified_base (316)..(316): a, c, t, g, unknown or other
  misc_feature (316)..(316): n is a, c, g, or t
  modified_base (783)..(783): a, c, t, g, unknown or other
  misc_feature (783)..(783): n is a, c, g, or t
tcagtctacgtagccacgaccggtgctcgatttagtgctatagacttgggtttggggggggtaggagggagccccagccttgggatccccaagtgttttcattcagtgatcaggactgaacacagaggactcaccatggagttcgggctggagctgggttttccttggctgctatcttaaaaggtgttccagtgtcgaagtcgcgtaggtggtggaggtcgtgggggagtccttgggtaaagccgttcggggggtcccttaggtagttccgttccgtggtggtcggtcccgtacgttgggaattcctaccttttanacgttaagtggccgtggtaagttggtagggttcgggtccggcccagggtcccgtccgaagggggaacgggggtcgtagggtagggttggggttaaggttaccggtttaacgtaaaaaggtaaaaaacgttggtaagttaggggttagaaaaggtaaaaacgttaagggaaacgttaacgggttacggaccgtaacccggggttaagggaaaaacgggtaagtaacgtttaaccgaaaccccgaggttaaccctacgtaaaagggacgtaattaaacgtaacgtaaaaaccggaacgggtttaagttaaacgtttacgaacgttaaaagtaacgaaagtaccgaaccgttaacggaaaaacccggtaacggaaccaaccggaagttacccgtacgtttaaacgttaaccgtttacgaacccgttaaagacgttaacgttaacgggtaaccgtacgggacttaaacggngggtaaacccggttaaagggtaacggtcgttaaaccgttggttaacccgttttagaactttaggttacccggacggggtttaacccggaagggttaccgtaagtttacccgggg

SEQ ID NO: 114539 - DNA, 564 bp, Homo sapiens
  misc_feature: GYAE6OF02GQ2WW.15.86.H09.1.454.CMB.1.raw
  modified_base (487)..(487): a, c, t, g, unknown or other
  misc_feature (487)..(487): n is a, c, g, or t
  modified_base (517)..(517): a, c, t, g, unknown or other
  misc_feature (517)..(517): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtgatggagtctgggggagccttggtaaagcctggggggtcccttagagtctcctgtgtggcctctggattcactttcagtaatggctggatgagttgggtccgcaggctccgagggaggggctggagtgggttggacgtttacaaaagtaaaatgatggtgagaaaatagactacggtgcaccgtgaaaggagattcacatctcaagagataattacaaaaacgacggtagtatttgacaaatgaaacagacctagaaaccgagaccacagcgtctattactgtaccanagtattcggaagtgacatcgaacgtaaggnggacttatgtacttttgattactcgtcggggacctagggactaacgg

SEQ ID NO: 114540 - DNA, 604 bp, Homo sapiens
  misc_feature: GYAE6OF02GIFF8.15.86.H09.1.454.CMB.1.raw
  modified_base (387)..(387): a, c, t, g, unknown or other
  misc_feature (387)..(387): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgaggggaaggggcgtggaggtgggttggacgtttacaaaaagtaaaatgatggtagaagaaaatagactacggtnacgaccgtagaaaggaagattacaccatctacaagagaataactaacaaaaacgtcggtagttatttagactaaaatagaaacagacctaagaaaaccgaggacacagcctatattactgtaaccanagattacgaagtcgcagtaccgaaggtaaggaggtctagtgttcgttttagattacgtcggtacggggccctaaggggaaccaggttcgg

SEQ ID NO: 114541 - DNA, 589 bp, Homo sapiens
  misc_feature: GYAE6OF02GGLZX.15.86.H09.1.454.CMB.1.raw
  modified_base (499)..(499): a, c, t, g, unknown or other
  misc_feature (499)..(499): n is a, c, g, or t
  modified_base (531)..(531): a, c, t, g, unknown or other
  misc_feature (531)..(531): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccgagggaaggggctggagtgggttggacgtttcaaaagtaaaatgatggtagagaaaatagactacggtgacaccgtagaaaggaagattacaccatctacaagagtaataatacgaaaaacgcggtatagtttagacaaatgaaacagcctagaaaccgagacacacgccgtatacttactgtaccanagtattacgaagtcacatcggaacgtaaaggnggtacttaatgtacgttttagattagtccggtacgggacccgagggtacaggttcggg

SEQ ID NO: 114542 - DNA, 684 bp, Homo sapiens
  misc_feature: GYAE6OF02JXEYD.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctggtgtggcctctggattctacttttcagtaatggctggatggagttcgggtccgccaggctaccgaggggaagggcgtggaggtgggttggacgtttacgaaaagtaaaatgagtggtagaagaaatagtacgtaggtgacgaccggtagaaggaagattacacagtctacgaagagaattaagtacgaaaacggcggttagttagtttagactaaagttacgaactagaccgtaggaaaaccggaggtaacacgaacggtacccttagttaacttaccgtacggttaacccaagttacggtaactttaccggggaaagttcgacgtaacgtacgggtaaccggtaagggacggtaccttagtaggttaccgtttttagaagttacggttacggttaccggggaacccgtaacggggtaacaggtttaccggg

SEQ ID NO: 114543 - DNA, 703 bp, Homo sapiens
  misc_feature: GYAE6OF02IS579.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctctgtgtgcctctggattcactttcagtaatggctggatgagttggtccgcaggctcggagggaggcgtaggtgggtgggtacggttacgtaaagtaaaaagtaaagagtaggtagtaagaaagtaaagtacgacgtacgtacgaccgtaacggtaaggaaaggtaagttactacctacgtaactactaacgaagtaacgtaaattaacgtaaaaccgaaaacggtaggttagttagttacgaaattaaagaagaacgacgtacgtaaacggaaaccggagaacgacaccgtaccgttacttaagttacgttaccacgaacgagttaacgtaacgtacgtcgaactacgtaaccggtaaaggaaagggtacgttaacgttaacttcggttttaacgttagtaactttacggtaccgggtccgggtaccggaacgggtaccgtaggttccggg

SEQ ID NO: 114544 - DNA, 640 bp, Homo sapiens
  misc_feature: GYAE6OF02HMDJC.15.86.H09.1.454.CMB.1.raw
  modified_base (426)..(426): a, c, t, g, unknown or other
  misc_feature (426)..(426): n is a, c, g, or t
  modified_base (545)..(545): a, c, t, g, unknown or other
  misc_feature (545)..(545): n is a, c, g, or t
  modified_base (580)..(580): a, c, t, g, unknown or other
  misc_feature (580)..(580): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttgggtaaagccgtgggggtcccttagagtctcctgtgtggcctcgtggattcacttttcagtaagtggctggatgtagttcgggtccgccaggctccgagggtaaggggcgtggaggtgggttggtacgtttacaaaagtaaaagtgagttggtgaagaaaatagtactatggtagacaccgtagaaaggagattcaacatacanaacgagtataataacaaaacgcgttagtattagacaaatacgaacagaccgtaacgaaaacgacgaccaactacaccggttactagttaacctgaaccctacgagtagttacggaagtnacgtaataccggaacgtaaagggcgtacctttagngtttaaccgtttgtaacgttacgtaccggtccggggtacccgtaacgggtacttaacggg

SEQ ID NO: 114545 - DNA, 676 bp, Homo sapiens
  misc_feature: GYAE6OF02FXEM7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaggggctggaggtgggttggtacgtttacgaaaagtaaaatgatggtagaagaaatagactacggtgacaccgtaggaaaggaagtacttacacctatctacgaagagaataagtaacaaaacggtacggtagttagtttagataaagtagaaacacgaccgtaagaaaaccggagaacaccgaacgtaccgttacttaactttaccgtacgtaacccaacgaagtaacgtttaccgggaagttacgacgtaacgtaaccggaacggtaaagggacggttaccgttaattcggttaaccgtttttagaacttacggttaccggttaccgggggaccccgaaggggtaccttaaggttccggg

SEQ ID NO: 114546 - DNA, 588 bp, Homo sapiens
  misc_feature: GYAE6OF02FS1DV.15.86.H09.1.454.CMB.1.raw
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (452)..(452): a, c, t, g, unknown or other
  misc_feature (452)..(452): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagtctacgtagccacgaccggtgctcgatttagtgctatagacttggggtttggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtcgtgggggagccttggtaaagccgtggggggtcccttagagtctcctgtgtgcctctggattcactttcagtaatggctggatgagttgggtccgccaggctccaggggaaggggctggagtgggttggacgtttacaaaagtaaaatgatggtgaagaaaatgactacggtagcaccgtagaaaggagtattcaccatctanaaganataatacaaaacgcggtagtaattgacaaatgaacngactagaaaccagacacagcctntatactgtaccanagtattacgaagtgacagtaccgaggtaacggacggtactaagtcgtactttttaggaattacgtcggtacgggggaccccaggggaacctaagttcggg

SEQ ID NO: 114547 - DNA, 676 bp, Homo sapiens
  misc_feature: GYAE6OF02GX67A.15.86.H09.1.454.CMB.1.raw
  modified_base (467)..(467): a, c, t, g, unknown or other
  misc_feature (467)..(467): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtggtttccttgctgctatcttaaaaggtgtccagtgtgaagtgcaggtggtggagtcgtggggagccttggtaaagccgtgggggtccctagagtcctcctgtgtggcctctggattcacttttcagtaatggctggatggagttggtccgtccgaggcgtccgaggggaaggggcgtggtaggtgggccgtgggtacgtttacaaaaaggtaaaatgtaagtggtagaagtaaatagactacggtgacacccggtagaaaggaagtacttcacctatcgtacaacgagataactaacaaaacgacggttataacgttntactaaagacgtaacacgtaccgtaagaaaccgaggtacacgacgtccgtacgtaattaccgtacgtaacccaagtacgttaacgttacgggaaacgttcgactaacggacccgtaaaggttaaacgggaacggttacgttacgttaacgttcgttttaaggtacttaccggttacggtacgggtaccccggtagggaacttaaccggg

SEQ ID NO: 114548 - DNA, 583 bp, Homo sapiens
  misc_feature: GYAE6OF02G76VN.15.86.H09.1.454.CMB.1.raw
  modified_base (400)..(400): a, c, t, g, unknown or other
  misc_feature (400)..(400): n is a, c, g, or t
  modified_base (423)..(423): a, c, t, g, unknown or other
  misc_feature (423)..(423): n is a, c, g, or t
  modified_base (471)..(471): a, c, t, g, unknown or other
  misc_feature (471)..(471): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtcccttagagtctcctgtgtggcctctggattcactttcagtaatggctggatgagttgggtccgcgaggctccgagggaagggcgtggagtgggttggacgtttacaaaagtaaaatgatggtagagaaagtagactacggtgacaccgtgaaaggagatcactanctacagagataattacaaaacgnggtagtaattgataaagtagaacagaccgtagaaaaccggtagaccanacgccttactattactagtaccagacgtattcggaagttgactagtacgacggtaaggaggtcttagtgtctttagattcgtcggtcgggacccgtagggaccaggttccgg

SEQ ID NO: 114549 - DNA, 622 bp, Homo sapiens
  misc_feature: GYAE6OF02GMCMR.15.86.H09.1.454.CMB.1.raw
  modified_base (393)..(393): a, c, t, g, unknown or other
  misc_feature (393)..(393): n is a, c, g, or t
tcagtctacgtagccacgaccggtgctcgatttagtgctatagacttgggtttgggggggagaggagccccagccttgggatccccaagtgtttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggtccgcaggctcgagggagggctggagtgggtgacgtttagaaaagtaaaatgagtgtagaagaaatagacgtacggtgacaccgtagaaaggaanattacacatcacaagagataatacaaaaacggacggttagttaatttgactaaagtacgaaactacgaccgtaacgaaaaccgaggaccaacgacgccgttactaagtttacctacgtaaccgacagtacgttacggaagtcgacagtacgaggttaacggaggtcttaagtcggttacttttagagtttaacgtccggtacgggggcccaacgggtactagttccggg

SEQ ID NO: 114550 - DNA, 591 bp, Homo sapiens
  misc_feature: GYAE6OF02H9SEA.15.86.H09.1.454.CMB.1.raw
  modified_base (392)..(392): a, c, t, g, unknown or other
  misc_feature (392)..(392): n is a, c, g, or t
  modified_base (484)..(484): a, c, t, g, unknown or other
  misc_feature (484)..(484): n is a, c, g, or t
  modified_base (514)..(514): a, c, t, g, unknown or other
  misc_feature (514)..(514): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaaagcctggggggtcccttagagtctcctgtgtggcctctggattcatttcagtaatggctggatgagttgggtccgccaggctccaggaggggctggagtgggtggacgttcaaagtaaatgatggtagagaaatagactacggtgcacccgtagaaggaagatacacanctacaagagataattacaaaacggaggtagtaatttagactaaaatgaaacacgcctaaggaaaaccgaggaactacagtacctatattacncgtaaccagagtattacggaagtgactaanacggtacgtaaagggacggctaagttcgtacttttagattagtcgtacggggaccccgagggtaccgtaggttacgg

SEQ ID NO: 114551 - DNA, 633 bp, Homo sapiens
  misc_feature: GYAE6OF02GLX6N.15.86.H09.1.454.CMB.1.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (413)..(413): a, c, t, g, unknown or other
  misc_feature (413)..(413): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccgttggtaaagccgtggggggtcccttagagtctcctgtgtggcctctggattcactttcagtaatggctggatgagttgggtccncaggctcgagggaggggcnggagtgggttgacgtttacaaaagtaaaatgatggtagaagaaaatagactacggtgacaccgtagaaaggagattacacatcacaaganataatacaaaacgtggtatatttgactaaatgaacngctaagaaaccgnggaaccacacggaccttactacgttactacgtaccctaacgacggttaacgttacgggaaagtcgtacgaagtaccgggtaacggtaagggacggtacttaacggtcggttaccgttttagacgtttacgtccggtacgggggtaccccaaggggtacctaggttccgggg

SEQ ID NO: 114552 - DNA, 582 bp, Homo sapiens
  misc_feature: GYAE6OF02F5NWL.15.86.H09.1.454.CMB.1.raw
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
  modified_base (497)..(497): a, c, t, g, unknown or other
  misc_feature (497)..(497): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaagccgtgggggtcccttagagtctcctgtgtggcctctggattctactttcagtaatggctggatgagttgggtccgccaggctccgagggaagggggcgtgggaggtgggttggacgtttacgaaaagtaaaatgatggtgaagaaatagactaggtgacaccgtgaaaggagattacacatctacaganataatacaaaacgaggtntattganaaatagaacagaccgtagaaaccgaggacacagccgtactaacttactagtacccanaagtagttacggaagtgacatacggacgtaaagggcggtactatgtcttttagattacgtcgtcgggcccgagggtacaggtcgg

SEQ ID NO: 114553 - DNA, 557 bp, Homo sapiens
  misc_feature: GYAE6OF02F6Y6G.15.86.H09.1.454.CMB.1.raw
  modified_base (186)..(186): a, c, t, g, unknown or other
  misc_feature (186)..(186): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagccccccgtntgcatctgccttgctgggagcctcgatcaagctcacctgcaccctaagtagtgagcatcgaacctacaccatcgaatggtatcaacagagaccagggaagtcccccccagtatataatgaaagttaagagtgatggcagccacaccaagggggacgggatccccgatcgcttcagtgggctccagttcgtggggctggaccgctacccgtcacccatccgtccaaccctccacgtctcgacgatggcgctgagtactcacttggtagagagacgccacacaattgatggaccgaaggtacgggttgggtggttccggggacgggtacgggacgtacggctacggacccgtaccggtacggtctaacccggg

SEQ ID NO: 114554 - DNA, 637 bp, Homo sapiens
  misc_feature: GYAE6OF02ITIXT.15.86.H09.1.454.CMB.1.raw
  modified_base (390)..(390): a, c, t, g, unknown or other
  misc_feature (390)..(390): n is a, c, g, or t
  modified_base (481)..(481): a, c, t, g, unknown or other
  misc_feature (481)..(481): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagccgtgggggtccttagagtctcctgtgtggcctctggattctactttcagtaatggctggatgagttggtccgcaggctccgagggaaggggctggagtgggtggacgttcaaaagtaaaatgatggtgagaaaatagactaggtagcaccggtagaaagganattcactatcacaagagaataatacaaaacgtacgtgtattgactaaatgaacacgacctaggaaaaccgacggaacacgacgtacccgtnttaacttacgtacgtaacccaagtaagtaacgttcgggtaaagtcgaacgtacgtaacggtaacggtaaaagggacgggtaacttaacgttacggtttactttaggtaattacgttacggttccgggggaccctaaggggtacctaggttccgggg

SEQ ID NO: 114555 - DNA, 590 bp, Homo sapiens
  misc_feature: GYAE6OF02HTUJQ.15.86.H09.1.454.CMB.1.raw
  modified_base (381)..(381): a, c, t, g, unknown or other
  misc_feature (381)..(381): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (476)..(476): a, c, t, g, unknown or other
  misc_feature (476)..(476): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccgaggctccgaggggaaggggctgggaggtgggttggacgtttacaaaagtaaaatgatggtagagaaaatagactaggngacaccgtgaaaggaagattacaccatctacaagagataatanaaaacgngtagttattganaaatgaacagacctagaaaacgagaacacgacncgtactattacctacgtaccacagtacgttacggaagtcgacaagtccggaaggtaaaggacggtctagtgtagttttagattagtcgtacggggacccagggtacaagtcggg

SEQ ID NO: 114556 - DNA, 693 bp, Homo sapiens
  misc_feature: GYAE6OF02HYA2P.15.86.H09.1.454.CMB.1.raw
  modified_base (591)..(591): a, c, t, g, unknown or other
  misc_feature (591)..(591): n is a, c, g, or t
tcagtctacgtagccacgaccggtgctcgatttagtgctatagacttgggtttgggggggtaggagggaggccccagccttggggatccccaagtgtttcattcagtgatcaggactgaacacagaggactcaccatggagttcgggctgagctgggtttccttgctgctatcttaaaggtgtccagtgtgaagtgcaggtggtggagtcgtggggggagccgttgggtaaagccgttggggggtcccttaggaggttctccgtgtggtggcctcgtggattcacgttttcagtaatggtcgtggagtgagttgggtccgcctagggctccgagggaggggctggaggtgggtggcgttacaaaaggtaaaagtgatagggtagaagtaaaagtaggacgtaacggcgtacgaaccggtaggaaagggtaagaagttaccgactatacctagaaacgtaaggactaaagtttaccaaaaacggtacgggttaaggttaactttaggaaactaagtaagaactagactaagaaacgtagacaacgagtccgtaatgttaactcgtaacccacgaagtactacgggaagttanactaacgttagaaccggttaagggacggtactaaggtcgtaaccgttttagaattaggttacccgtggggggaacccctaagggtaccgtaagttaccgggg

SEQ ID NO: 114557 - DNA, 661 bp, Homo sapiens
  misc_feature: GYAE6OF02GACJI.15.86.H09.1.454.CMB.1.raw
  modified_base (433)..(433): a, c, t, g, unknown or other
  misc_feature (433)..(433): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtgggtggagtcgtgggggagccgttggtaaagccgtgggggtcccttagagtctcctgtgtggcctctggattcacttcagtaatggctggatgtagttcgggtcgccgacggctccgaggggaaggggcgtgggaggtggggttggtacgtttaacgaaaaagtaaaataggagtaggtagaagaaaatagacgtacggtagctaccgagaaaggaagactcacatcacaaganaataattaacaaaacgtcggtatatttagacaaatagaacacgaccgtaagaaaaccgacggaaccaacgacgtaccgttactactttaacgacgttaacccataagtaacttaacgggaatacgtacaacgtaccgaaggtaaacggaacgtacgttaatcggtttactttagtaagttacgttacgggtaccggggacccgtaaggggtaaccgtagttaccgggg

SEQ ID NO: 114558 - DNA, 662 bp, Homo sapiens
  misc_feature: GYAE6OF02HKEYN.15.86.H09.1.454.CMB.1.raw
  modified_base (489)..(489): a, c, t, g, unknown or other
  misc_feature (489)..(489): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccctaggagtctcctgtgtggcctctggattcactttcagtaatggctggatgtagttgggtccgccgaggcctccgaggggaagggggcgtggaggtgggttggacgtttacgaaaaaggtaaaaagttgtaagtgggtagaaagaaaatagactacggtagcgaccgtagaaaggtaagattcaacatactacgaagaagtataaattaacgaaaaacggtcggtagtaatttaggactaaagtacgaaanacgtacccgtaagaaaaccgaggaacaacgacgtacccgtattaacgttactacgtaaccacgtagtaagttacggtaagtagacctaagtaccggaacgtaaagggagtactagtacgttacgttttagagttacgtcggtaccgggacccggtaacgggactaagttcggg

SEQ ID NO: 114559 - DNA, 668 bp, Homo sapiens
  misc_feature: GYAE6OF02GR1E4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggagtcgtgggggagccttggtaaagccgtgggggtcccttagagtctcctgtgtggcctctggattcactttcagtaatggctggatgagttgggtccgccgaggctccgagggaaggggctgggaggtgggttggtacgtttacgaaaagtaaaagtgtagtggtagaagaaaagtagacgtacggtgacaccggtagaaaggaagattacacatctacaagagaataatacgaaaaacgtcggttatactttagactaaatagaacaacgaccgtaagaaaaccggaggaaccaacgacgtaccgtacttaactttacgtacgtaacccgataaggtacttacgggaattgactaacgtacggtaaacggtaagggtacggtacgttaagttcggttactttttaggaactttacggtacgggttaccggggaccccggtaaggggtacctaaggttaccgggg

SEQ ID NO: 114560 - DNA, 741 bp, Homo sapiens
  misc_feature: GYAE6OF02H3EJV.15.86.H09.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (422)..(422): a, c, t, g, unknown or other
  misc_feature (422)..(422): n is a, c, g, or t
  modified_base (446)..(446): a, c, t, g, unknown or other
  misc_feature (446)..(446): n is a, c, g, or t
tcagtctacgtagccacgaccggtgctcgatttagtgctatagacttgggtttgggtccactgggcagtctcgaatagagctcttggaagtccctccaaccatggcctgggtctccttctacctactgcccttcattttctccacaggtctctgtgctctgcctgtgctgactcacgccccgtctgcatctgccttgcgtgggancctcgatcaagctcactgctacctaagngtcgagcactacgaacctacgaccataccgaatggtataccaagagagaccgagggtaaccgccccctaagtaactaattaacgagtaaaacgttaagagtagacgtagggacagtaccaacgaacccggaaagggggtaccggaactccccggataccggtcttacgagtcggactccgagttccggngggtactacgaccgtaccgttacnccgtaaccacttcacccgtaacctcgtacgtccttaggaaccgtagtacggtaacgggtcttacgggaacgttacgccgttaaccgtttagggtacgggtacgtaacggtacccggtaacccaaacgttaaccgtaaaggttaagtacgtacggttaacccgggaaggttttaccggggtacgggtttacgggttaacccggggtaccgggggtaaaccggtaccggttaacggggtaccttaacccggggttaaccccgttacccgggttaaccggggttcccaaacccggggg

SEQ ID NO: 114561 - DNA, 638 bp, Homo sapiens
  misc_feature: GYAE6OF02GBXYN.15.86.H09.1.454.CMB.1.raw
  modified_base (466)..(466): a, c, t, g, unknown or other
  misc_feature (466)..(466): n is a, c, g, or t
  modified_base (522)..(522): a, c, t, g, unknown or other
  misc_feature (522)..(522): n is a, c, g, or t
  modified_base (604)..(604): a, c, t, g, unknown or other
  misc_feature (604)..(604): n is a, c, g, or t
  modified_base (616)..(616): a, c, t, g, unknown or other
  misc_feature (616)..(616): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtgggggtcccttagagtctcctgtgtggcctctggtacttcgactttcgagtaatggctggatgaggttggtccgccgaggctaccgagggtagggcgtggaggtgggttggacgtttacgaaaagtaaatgagtaggtagaagtaaaagtagacgtaacggagaccgaaccgtaggaaaagtagtacgttacaactagtactacgaaagagtaacgtaaataacgaaaaacggnggttacgttaatttaggactaaaagtacgaacgtaggaccctaaggaaaaacccgngaaacagaagccgttaatagttaaccaagttaacccaagtaagacgttaggaatcgcaagtccggaagtaaggcgattagtntcttgattacgngtacgggaccagggtatggtcg

SEQ ID NO: 114562 - DNA, 681 bp, Homo sapiens
  misc_feature: GYAE6OF02F5ISP.15.86.H09.1.454.CMB.1.raw
tcagtctacgtagccacgaccggtgctcgatttagtgctatagacttgggtttgggggggggagaggagccccagccttgggatcccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccgaggctccgagggaagggggctgggaggtggggttggacggtttacaaaaagtaaaatgaagtggtagaagaaaatagacgtacggtagaccaacccggtaggaaaaggaagacgttacaaccattctacaaagagtaattaaacttacgaaaaaacgtacgggttataagttttacgactaaaagtacgaaacaggacctaaggaaaaccgaggaaccaacacgtacccgtataacgtttaacctacgtaccaacaagtagttacgggaattgacgtaagtaccggtaacggtaaacgggacggtcgttaagtcgttacgtttttagaacgttacgtacggtacgggggacccaaggggtactaaggttcggg

SEQ ID NO: 114563 - DNA, 404 bp, Homo sapiens
  misc_feature: GYAE6OF02FLLRI.15.86.H09.1.454.CMB.1.raw
  modified_base (392)..(404): a, c, t, g, unknown or other
  misc_feature (392)..(404): n is a, c, g, or t
tcagtctacgtagccacgaccggtgctcgatttagtgctatagacttgggtttggggtacgattttgatgttacctgatgcttagaggcttttcctggaagcagggcatttgttgcttcagcaccgtagtgcctcgtcatcacgcctcagccttgatttttccggatttgcctggaaaaccagcctacccgcttaaaccgggacaaccgtcgcccggccaacatagccttctcccgtccccccttcgcagtaacaccaagtacaggaatattaacctgtttcccatcgactacgcctttcggcctcgccgttagggtcactcaccctgccccgattaacgttggacacggaacccttggtcttccggcgaggcgggctggcaggcgcatagnnnnnnnnnnnnn

SEQ ID NO: 114564 - DNA, 581 bp, Homo sapiens
  misc_feature: GYAE6OF02FQHR3.15.86.H09.1.454.CMB.1.raw
  modified_base (492)..(492): a, c, t, g, unknown or other
  misc_feature (492)..(492): n is a, c, g, or t
tcagtctacgtagccacgaccggtgctcgatttagtgctatagacttgggtttgggggggggagaggagccccagccttgggatcccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaggggaaggggctggagtgggttggacgtttacaaaagtaaaatgatggtgagaaaatagactacggtgcaccgtgaaaggagattcaccatctcaagagataatacaaaaacgcggtagtatttgacaaatgaacagacctagaaaaccgagacacagccgtataattacagtaccanagtattacggaagtgcagtacgacggtaaagggaggtactagtcgtacttttagaattactcgtaggggccccaggggtacagttcggg

SEQ ID NO: 114565 - DNA, 689 bp, Homo sapiens
  misc_feature: GYAE6OF02HFONP.15.86.H09.1.454.CMB.1.raw
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaagccgtggggggtcccttagagtctcctgtgtcggcctctggattcactttcagtaagtggctggatggaggttcgggtccgccaggcctccgaggggaggggtctggaggttggggttaggtacgtttaacgaaaaagtaaaatgagttagggtagaaagtaaaaagtagaacgtacggtgccgaaccgtaggaaaaggaagtattcaacatactacaagagtaataaataacgaaaaacgtggttataagtttagaataaatgaaacagccgtaagaaaaccgacggaacacgacgtacccgttactaactttacgtacgtaaccgactaacggtaacgttagggtaaacgtgaacctagtaacccggtaagggtaaagggacgtaccgttaagtgttacgttttaggaacttaggtacccggtcggggacccgtaaggggtacctaagggttccggg

SEQ ID NO: 114566 - DNA, 581 bp, Homo sapiens
  misc_feature: GYAE6OF02GNGH4.15.86.H09.1.454.CMB.1.raw
  modified_base (423)..(423): a, c, t, g, unknown or other
  misc_feature (423)..(423): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagcctgggggtcccttagagtctcctgtgtggcctctggattcactttcagtaatggctggatgagttggtccgcaggctccgagggagggctggagtgggttggacgtttacaaaagtaaaatgatggtagagaaatagactacggtgacaccgtagaaaggagacttcacatctacaagagaataatacaaaagngtatattgacaaatgaacagtacctagaaaaccgagaacacgacgccgtactattacacgaccacgagtagttacgagtcactactaggacgtaaggnggtactagttgtacgttttagagttacgtcggtacgggacccgagggacctaagttcggg

SEQ ID NO: 114567 - DNA, 634 bp, Homo sapiens
  misc_feature: GYAE6OF02GJHW1.15.86.H09.1.454.CMB.1.raw
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgcgaggctcgagggaggggctggagtgggttggacgttacaaaagtaaaatgatggtagaaagaaatagacgtaggtnccgaaccgtagaaagganacttacaactatctacgaagatataatacaaaacgtcggtagtactttgacaaatgaaacacgtactaacggaaaaccgaggaccaacgacgtaccttaactattaaccgtacgtaaccagtacgtaagttacggaatcggactaagtacgtaacggtaaagggtaacgtcgtaattacggttacttttacgatttaccgtcggtacgggtacccggaacgggtaactaacgttcggg

SEQ ID NO: 114568 - DNA, 594 bp, Homo sapiens
  misc_feature: GYAE6OF02GRMAE.15.86.H09.1.454.CMB.1.raw
  modified_base (497)..(497): a, c, t, g, unknown or other
  misc_feature (497)..(497): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccaggggaaggggctgggagtgggttggacgtttacaaaagtaaaatgatggtgaagaaatagactacggtgcaccgtgaaaggagattcacatctacaagagataatacaaaacgcggtagtatttagactaaatgaaacagacctaggaaaaccgaggaacacagccgtatacttactgtaaccanagtattcggaagtgacagtacgaacggtaaggacggtactaagttcgtacgttttagattacgtcgtaccggggacccaaggggtacctaagtcggg

SEQ ID NO: 114569 - DNA, 736 bp, Homo sapiens
  misc_feature: GYAE6OF02G9PYZ.15.86.H09.1.454.CMB.1.raw
  modified_base (367)..(367): a, c, t, g, unknown or other
  misc_feature (367)..(367): n is a, c, g, or t
tcagtctacgtagccacgaccggtgctcgatttagtgctatagacttgggtttgggggggaggagggggccccgagccttgggatccccaagtgttttctattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtccctagagtctctgtagtggctctggatctactttcagtaatggctggatgacgttggccgtcgaggctccgaaggggaagggctggagtggggttggtacgtttaacgaaaaaggttaaaaanggtaatgggtagaaagaaaaacgtggtaaacgttaccggtagaccgtaacccggtagaaaaacgggaagtaacgtttcaaacctagtacccgttaacaaaagggacgtaaaattaaacttaaccgaaaaaacggtacgggtaagtaattttacgaagtaaaaacgtgtaaaacgaacggacctaaggtaaaaacccgaacgggaaaccaacggaaccgacggtttacctaacgtttaacgtacgtaacctaacgtaacggtaacgtttacggaacggtagactaaagtacgaaccggtaaagggacggtacaagttcgtacttagtataacgtcggttacggggacctaagggactaatgggttaccgg

SEQ ID NO: 114570 - DNA, 605 bp, Homo sapiens
  misc_feature: GYAE6OF02HX99V.15.86.H09.1.454.CMB.1.raw
  modified_base (263)..(263): a, c, t, g, unknown or other
  misc_feature (263)..(263): n is a, c, g, or t
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtggggggtccttagagtctcctgtgtggcctntggattcactttcagtaatggctggatgagttgggtccgcaggctccagggaagggctggaggtgggtggacgtttacaaaagtaaaatgatggtagaagaaaatagactaggtgccaaccgtaggaaagaagacttacacctatctacaagagtataaattacaaaaacgngtaggtagtattganaaatgaacagacctaggaaaaccgaggaaccaacgacgacctctaattacntaaccanagtattaccggagttgacaatacgaacggtaaaggcgtacgtaattgtaacgttttagagttacgttccggtacggggacccgtagggactaacggg

SEQ ID NO: 114571 - DNA, 616 bp, Homo sapiens
  misc_feature: GYAE6OF02HN4JV.15.86.H09.1.454.CMB.1.raw
  modified_base (409)..(409): a, c, t, g, unknown or other
  misc_feature (409)..(409): n is a, c, g, or t
  modified_base (457)..(457): a, c, t, g, unknown or other
  misc_feature (457)..(457): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttaggagtctcctgtgtggcctctggattcactttcagtaatggctgatgagttgggtccgcaggctccgagggaaggggctgggaggtgggttggtacgttttacgaaaagttaaaagtgatgggtagaagtaaaataggactacggtgaccaccggtagaaagganattacacgatcacaagagataatacaaaacggaggttagtaatttganaaatgaacagctaagaaaaccgaggaacacagtcccgtactaattaacctacgtacctaacgacgtaagttacggaagtgaacctagtacgacggtaaaggagtactactgtacgtttagatacgttacggtcgggaccctagggacctagttacgggg

SEQ ID NO: 114572 - DNA, 632 bp, Homo sapiens
  misc_feature: GYAE6OF02FZ54S.15.86.H09.1.454.CMB.1.raw
  modified_base (430)..(430): a, c, t, g, unknown or other
  misc_feature (430)..(430): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttgggtaaagccgtgggggtcccttagagtctcctgtgtggcctctggattcactttcagtaatggctggatgagttgggtccgcgaggctccgagggaaggggcgtgggaggtgggttggacgtttacgaaaagtaaaagtgaagtggtagaagtaaaatagactacggtagacgacccgtagaaaggaagacttacgacatctacaaaganaataattacgaaaaacgtacggtagtatttagactaaatgaaacagacctagaaaaccgaggacaacgacgtaccgtcttaatactagtaacccanaacggtattacgggaagtagaccacgtacgacgtaaaggacggtactagtgtacttttagaagttagttaccggtcgggacccgtaaggggacctaagggttccgg

SEQ ID NO: 114573 - DNA, 329 bp, Homo sapiens
  misc_feature: GYAE6OF02G3701.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtctgcatctgccttgctgggagcctcgatcaagctcacctgcaccctaagtagtgagcatccgaacctacaccatcgaatggtatcaacagagacagggaactcccccgagtataataatagaaagttaagagtgataggcaacg

SEQ ID NO: 114574 - DNA, 583 bp, Homo sapiens
  misc_feature: GYAE6OF02I57XX.15.86.H09.1.454.CMB.1.raw
  modified_base (456)..(456): a, c, t, g, unknown or other
  misc_feature (456)..(456): n is a, c, g, or t
  modified_base (462)..(462): a, c, t, g, unknown or other
  misc_feature (462)..(462): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagcctgggggtcccttagagtctcctgtgtggcctctggattcgactttcagtaatggctggatgagttggtccgcaggctccgagggagggctggaggtgggttggacgtttacaaaaggtaaaatgatggtagaagaaatagatacggtgcaccgtagaaagagatcaccatcacaagagataatacaaaacgcgtagtatttagacaatagaacagctagaaaaccgnggaacncgagccgtatattactcgtaccagagtacgttcgtaagcacgaagtaccggacgtaaaggacggtactaatgtaccgttttagacgttatcggtacgggcccagggtaccaggttaccggg

SEQ ID NO: 114575 - DNA, 628 bp, Homo sapiens
  misc_feature: GYAE6OF02JMIAW.15.86.H09.1.454.CMB.1.raw
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (411)..(411): a, c, t, g, unknown or other
  misc_feature (411)..(411): n is a, c, g, or t
tcagtctacgtagccacgaccggtgctcgatttagtgctatagacttgggtttgggggggaggaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggggagccgttggtaaagcctgggggtcccttaggagtctcctgtgtggcctctggattcactttcagtaatggctggatgagttggtcgcaggctccagggaagggntcggnggtgggttggacgtttacgaaaagtaaaatgatggagtagaaatagactaggtgacctaccgtgaaacgagatcacatctcaaganataactacaaaacgacggtattagttacgactaaagtagaaacgacgaccttaagaaaccggagaaccacgacgacccgtataactacgttacgtaaccgacgtaacgtacttacgggaactggtactagtacgtaacggttaacggaggtaaccttagtacggttacgtttagacgttactcggttacgggacccggtacgggtactagttacggg

SEQ ID NO: 114576 - DNA, 614 bp, Homo sapiens
  misc_feature: GYAE6OF02FJLVB.15.86.H09.1.454.CMB.1.raw
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgtaggttgggtccgccaggctccgaggggagggctggagtgggttggacgtttanaaaagtaaangatggagaagaaatgactacggtgaccaccgtagaaaggagacttacacatctacaagagaataattacgaaaaacgtcggttagtatttagactaaatagaaacacgacctaaggaaaaccgaggaacaccgacgacccgttacttaacttacgtacgtaccaatacgtaacgttcggaagtgacagtacgaacgtaaggaggtctagttgtcttttagattacgtcggtacggggacccgagggtactaggttcggg

SEQ ID NO: 114577 - DNA, 607 bp, Homo sapiens
  misc_feature: GYAE6OF02FTISO.15.86.H09.1.454.CMB.1.raw
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggtttttccttgctgctatcttaaaggtgtccagtgtgaagtgcaggtggtggagtcgtgggggagccttggtaaagccgtgggggtcccttagagtctcctgtgtggcctctggattcactttcagtatggctggatggtagttgggtccgccgaggcctaccgaggggaaggggcgtgggaggtgggttggacgttacgaaaagtaaatgatggtgaagaaatagactacggtgcgtaccgagaaaggagacttcacctatctacaagagataatacaaaacgcggttatatttgacaaatgaaacagccctaagaaaaccgnggaccacgagcctatacttacncgtaccacagtacttacggaatcgataacgtcgaaggtaaggaggtctagtcgttcttttaagagtttacggcggttacggggacccgtaagggtactaggttcggg

SEQ ID NO: 114578 - DNA, 638 bp, Homo sapiens
  misc_feature: GYAE6OF02JCA8H.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccgaggggaaggggcgtggaggtgggttggacgtttacaaaagtaaaatgatggtagagaaaatagactacggtgcaccgtagaaaggagattacacatctacaagagaataattacgaaaaacgtacggtagtatttagactaaatagaacagacctaggaaaaccgaggacacacgaccgtactaacttacgtacgtaccaactagtacttacgggaagttcgacgtagtaccggacggttaaaggaggtacgttaatcggttactttttacgaacttacgttaccggttccgggggaccccgtaaggggtacctaaggttccggg

SEQ ID NO: 114579 - DNA, 690 bp, Homo sapiens
  misc_feature: GYAE6OF02HP8UB.15.86.H09.1.454.CMB.1.raw
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (618)..(618): a, c, t, g, unknown or other
  misc_feature (618)..(618): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtgggtggagtcgtgggggagccgttggtaaagccgttgggggttcccttagagtctcctgtgtggcctcgtggattcactttcagtaatggctggatgngttgggtccgcaggctccgaggggaggggctgggnggtggggttggacgtttacgaaaagttaaaatgaatggtagagaaatagagtacggtgcgaccgtaggaaaggaagtatacaacatctacaagtaagattaaattaacgaaaaggtacggttacgttatttacgactaaagtacgaaacacgtaccgtaacggtaaaaaccggacggtaaacgaccgtaacgtacccggtaacttaacgttaccgtaacggtaacccaccgtaaggtaccgtttacggaagtacgacctagtaccgaacgggtaacggaacggtnttaacgttcggttaccgttttaagattacgtcggttaccgggtaacccggtaacgggtacgtacgttacggg

SEQ ID NO: 114580 - DNA, 883 bp, Homo sapiens
  misc_feature: GYAE6OF02G7MTM.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttagggtaaagccgtggggggtacccttaggagtctccgtgtgtcggtcctcgtggtacttctactttcagtaagtggtctaggatggtaggttcgggtccgcgaggcctccggagggagggcgtggtagtgggttggtaacgtttaacgaaaagttaaaagtgtaagtaggtagaaaggtaaaagtacgtaacgtaacggtcgaccgtaaaccggtaggaaaaggaacgtacttacaaccgtaatacgtaacgtaaaggtaacgttaaacttaaaacgtttaaaaccgaaaaaaccggtagggtttaacgtttaaagttttaacggaaaccgtaaaaagttacggaaaacccgtaacgggtaacccttaaaggggaaaaaaacccggtagggtaaacccgaaaccgtaaccggtacccgtttaaccgtttaaacgtttaaccgtaaccgggtaaacccctaaacggaaaggtttaacccggttaacgggtaaacggtttcaaaccgttaacgttaacccgggtaaacgggttaaaaagggtaccggtttaccgttaaaggttacggtttcccgttttaaagggtaacgtttaaccggttcccggggttaaaccggggggtaaccccggtaacgggggttaactaaacgggtttcccggggg

SEQ ID NO: 114581 - DNA, 675 bp, Homo sapiens
  misc_feature: GYAE6OF02HXAE0.15.86.H09.1.454.CMB.1.raw
  modified_base (422)..(422): a, c, t, g, unknown or other
  misc_feature (422)..(422): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtggggggtcccttagagtctcctgtgtggccttctggattcactttcagtaatggctggatgagttgggtccgcgaggctcgagggaaggggctgggagtgggttggacgtttacgaaaagtaaaatgaagtggtagaagaaagtagacgtacggtgacaccgtagaaaggagtattcaactatctanagagataatacgaaaacgtacggtattattgacaaagtagaacagtacctaaggaaaaccgtaggaacacgacgaccgttactaacttacgtacgtaccgaacgtaagtaacgtttacgggaaaggttcgaaccgtaacgtaccggtaaccggtaaagggtacgggtaacctttaaggtcgttacgtttttaaggaacgtttaggttcccgggttaccgggggaccccgtaaggggtaccttaaggttccggg

SEQ ID NO: 114582 - DNA, 696 bp, Homo sapiens
  misc_feature: GYAE6OF02GINFP.15.86.H09.1.454.CMB.1.raw
  modified_base (412)..(412): a, c, t, g, unknown or other
  misc_feature (412)..(412): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttggtccgccaggctccgagggaagggcgtggagtgggttggacgtttacaaaagtaaaatgatggtagaagaaaatagactacggtgacgaccgtagaaaggagacttaccacgatctanaaagagtaactaattacgaaaaaacgtcggttagttaagtttagactaaattacgaaactacgaccctaaggtaaaaacccgaggaacaaccgaacgtaccgtacttacttaactacggtaacccaacgtaacgtaagtttacgggaaacttactaacgtacggtaaaccggtaaagggacggtaaccgttaatacggtttacgtttttaacgaacgtttaacgttcgggtacccgggggtaccccgtaaagggggaacccttaaggttcgggttaaccccggg

SEQ ID NO: 114583 - DNA, 605 bp, Homo sapiens
  misc_feature: GYAE6OF02GGUKU.15.86.H09.1.454.CMB.1.raw
  modified_base (436)..(436): a, c, t, g, unknown or other
  misc_feature (436)..(436): n is a, c, g, or t
  modified_base (474)..(474): a, c, t, g, unknown or other
  misc_feature (474)..(474): n is a, c, g, or t
  modified_base (526)..(526): a, c, t, g, unknown or other
  misc_feature (526)..(526): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccgttggtaaagccgtgggggtcccttagagtctcctgtgtggcctctggattcactttcagtaatggctggtatgagttgggtccgcgaggctccgagggaaggggcgtggaggtgggttggacgtttacaaaagtaaaatgatggtgaagaaatagactaggtgacaccgtagaaaggagattacaacatctacaaagagaataatacgaaaaacgngtagtatttgactaaatgaacacgactaggaaaaccgnggaacaacgacgccgtactattactacgtaccacagtaattacggaagtganagtacgaacgtaaaggacggtatagttagtcgttttagattacgttcggtaccgggacccgaagggtacgaagttcggg

SEQ ID NO: 114584 - DNA, 672 bp, Homo sapiens
  misc_feature: GYAE6OF02GETVC.15.86.H09.1.454.CMB.1.raw
  modified_base (349)..(349): a, c, t, g, unknown or other
  misc_feature (349)..(349): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtctgggggagccgttggtaaagccgtgggggtcccttagagtctcctgtgtggcctctggattcactttcagtaatggctggatgtaggttgggtccgccgaggctaccgagggaagggctggaggtggggttgacgttanaaaagtaaaatgagtggtagaagaaaatgactaggtagcaccgtagaaaggagattacacatctacgaagtagtaataattaacaaaaacggtaggttataacgtttagaactaaagttcgaaacgagacccttaaggaaaaacccgacgggaacaaccgagtacccgttacttaattaacctacgtaaccctaacagtaacgtttacgggaacgtacacgtaacgtacggtaacggtaaacgggaggtaccgttaattcgggttctttttaggaagttacgttccggtacgggggaccctaaggggtacctaacggttcggg

SEQ ID NO: 114585 - DNA, 666 bp, Homo sapiens
  misc_feature: GYAE6OF02JCZ0Q.15.86.H09.1.454.CMB.1.raw
  modified_base (389)..(389): a, c, t, g, unknown or other
  misc_feature (389)..(389): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgaggttgggtccgccaggctccgaggggaaggggctggaggtgggttgggtacgtttacaaaaggttaaaaatggatggtagaagaaaatagactacggngccaaccgtagaaaggaagattcaaccatctacaagagaataattacgaaaaacggtcgttataatttgactaaagtagaaacagacctaaggaaaaacccgagggaacaaccgacggtacccgttacttaactttaccgtacgtaccaacgtaagtaacgtttacgggaagttcggactacgtacgaacggtaaacgggaggtaccttagttcggtagtttttagtaagttacgttcggtaccgggggaccccgtaaggggtactaaggtttcggg

SEQ ID NO: 114586 - DNA, 614 bp, Homo sapiens
  misc_feature: GYAE6OF02IP1YT.15.86.H09.1.454.CMB.1.raw
  modified_base (366)..(366): a, c, t, g, unknown or other
  misc_feature (366)..(366): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttggtaaagccgtgggggtcccttagagtctctgtgtggcctctggattcacttcagtaatgctggatgagttggtcgccaggctccgaggagggctggagtggtgcgtttacaaagtaaatgagtggtagagtaaaatagactacggngacaccggtagaaaggagtactacaccatctacgaagagataacttacgaaaacgtacggtagtattagataaagtagaacagaccgtagaaaaccgagacgacgacgactactacgttactacgtaccacgtaagacgttacgggaacgtcgacgtacgtaccggaacgttaacggaggtaactagttacgttactttaggtacttacgtcggtacgggtacccggtagggtacgtagttaccgggg

SEQ ID NO: 114587 - DNA, 626 bp, Homo sapiens
  misc_feature: GYAE6OF02HSNTI.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagcctgggggtcccttagagtctcctgtgtggcctctggattcactttcagtaatggctggatgagttgggtccgccgaggctccgaggggaaggggctgggaggtggggttggtacgttttacgaaaaagttaaaaatggaagtgggtagaagaaaatagaactacggtgctaacccggtaggaaaaggaagattcgaacatctacgaaagagaattaaattacaaaaaaccgacggttagttaagtttagactaaaatagaaacagacctaagaaaaccgagaacacgagccgtactattactagtaccaacagattacggaagtgactatacgacggtaaaggaggtactaagtgtacttttagattacgtcgtacggggaccctagggactagtcggg

SEQ ID NO: 114588 - DNA, 627 bp, Homo sapiens
  misc_feature: GYAE6OF02FYKY1.15.86.H09.1.454.CMB.1.raw
  modified_base (396)..(396): a, c, t, g, unknown or other
  misc_feature (396)..(396): n is a, c, g, or t
  modified_base (503)..(503): a, c, t, g, unknown or other
  misc_feature (503)..(503): n is a, c, g, or t
tcagtctacgtagccacgaccggtgctcgatttagtgctatagacttgggtttgggggtacgatttgatgttacctgatgcttagaggcttttcctggaagcagggcatttgttgcttcagcaccgtagtgcctcgtcatcacgcctcagccttgtattttccggattttgcctggaaaaccagcctacccgcttaaaccgggacaaccgtcgcccggccaacatagccttctcccgtcccccttcgcagtaacaccaagtacaggaatattaacctgttcccatcgactacgtccttcggcctcgccgttagggtcgactcacctgccccgattaacgtgacagtacctggtctccggcgagcggtctttcaccgtctttatcttacttatgtcngcattcgctacttctgactaccctccagtcatcgtcctacacgagccaactaccttcacacggtccttaacgaagaaccctcctaccccctaaaccaaccgaaaccncaacgtaacgccgtaccgccgtcgcccgcgacgtccttcggtacgtctagttcggtttaccgtccccgtttctaccgttccttcccgtcctacgtcgttacgaccgtacgttacgtacgtaccg

SEQ ID NO: 114589 - DNA, 621 bp, Homo sapiens
  misc_feature: GYAE6OF02GKCC5.15.86.H09.1.454.CMB.1.raw
  modified_base (403)..(403): a, c, t, g, unknown or other
  misc_feature (403)..(403): n is a, c, g, or t
  modified_base (483)..(483): a, c, t, g, unknown or other
  misc_feature (483)..(483): n is a, c, g, or t
tcagtctacgtagccacgaccggtgctcgatttagtgctatagacttgggtttgggggaggaggagcccagccttgggatcccaagtgttttcattcagtgatcaggactgaacacacgacggactcaccatggagttcgggctgagctgggttttccttgctgctatctaaaaggtgtccagtgtgaagtgcaggtcggtggagtctgggggagccttggtaaacgcctggggggtcccttagagtctccgtagtgtggcctctggaatttcactttcagtaatggctggatgagttgggccgtccaggcgtccagggaagggctaggagtgggtagacgtttacaaaaggtaaaatgatggtagaagtaaaatagactacggtgctaccggtagaaagganagttcaacgatctacaagagattaattacgaaaaacgcggtagtagtttagacaaagtgaaacgagacctagaaaaccgnggaacacgagccgtataattactgtaaccagtagatttacggaagtgcgaagttcggacgtaaagggacggtctaagttcggtactttttagaacgttagttccgtacgggggtacccaggggtaccaacggttcggg

SEQ ID NO: 114590 - DNA, 852 bp, Homo sapiens
  misc_feature: GYAE6OF02J057E.15.86.H09.1.454.CMB.1.raw
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
tcagtctacgtagccacgaccggtgctcgatttagtgctatagacttgggtttggggggaggaggagccccagccttgggatccccaagtgttttcattcagtgatcaggactgaacacagaggactcaccatggagttcggctgagctgggtttccttgctgctatcttaaaaggtgtccagtgtgaagtgcaggtggtggagtcgtggggagccgttggtaaagcctgggggtcccttagagtctcctgtgtggcctctggattcactttcagtatggctggntgngttgggtccgccgaggctccgagggaaggggcgnggagtgggttggtacgtttacgaaaagtaaaaagtgaagtaggtagaagtaaaacgtaggtaacgtacggtacgtacgaaccccggaggtaaaagggtaagaacgttaccgtaacccaagttaccgttaccgaaaggtaacggtaactttaaaacggtttaacccgaaaaaaacgggtaaccgggttttaaacggttaaagttttaacggaaaccgttaaaacttaaaggaaaccgtaacggtaaacccgttaaacggtaaaaacccggaacgggaaaccgtaaacccgtaaggtacccggttaacccttaacgtttaacccgtaaccggtttaaacccgtaaccgtaaaccgggttaacgtttaaccggggttaaaccggtaggacccgttaaacgttaacccgggaaccggttaaaagggtaaccgggtaacgttaccgttacggttaacgttttacggtaaacgtttacggttaccggttccgggggtaaccccggtaagggttaaccggtaacgttttaaccgggg

SEQ ID NO: 114591 - DNA, 625 bp, Homo sapiens
  misc_feature: GYAE6OF02F205E.15.86.H09.1.454.CMB.1.raw
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (442)..(442): a, c, t, g, unknown or other
  misc_feature (442)..(442): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgtagttgggtccgcaggctccgagggaaggggctggagtgggttggacgtttacgaaaagtaaaatgatggtagaagaaaatgaagtacggtagcctaccggtagaaaggagatacacntcnaaganataatacaaaacgtgtatattganaaatgaacagacctaagaaaccgtaggacaacgagtaccgtacttaattaccagttacccaatacggtattaccgggaagtcgtactagttaccggaggtaaacggtacggtcttaaggttcgttaccgttttagaacgttacgtccgggtacggggtacccgaagggtaaccaggttccggg

SEQ ID NO: 114592 - DNA, 703 bp, Homo sapiens
  misc_feature: GYAE6OF02F2X5A.15.86.H09.1.454.CMB.1.raw
  modified_base (521)..(521): a, c, t, g, unknown or other
  misc_feature (521)..(521): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgcgaggctccgagggaggggcgtggaggtggggttggtacgtttacgaaaagtaaaaagtgagtgggtagaagaaaatacggaactacggtgacgacccggtagaaaagggaagaattacaccgtatctacgaagtagaataaacgttacgaaaaaacggtcggtagttaagtttagaacgaaaagttacgaaacacggacccgtaaggaaaaaccgnggaaaccaacgacgccgttactaacttaacctacggttaacccaacgagtaacgttacgggaaagttcgaaccgtaagttacccgggaaggtaaaacggtcggggtaacttaggttcgttaacgtttttaggaattacggttcgggttaccggggacccgtaagggtacctaaggttcgggg

SEQ ID NO: 114593 - DNA, 744 bp, Homo sapiens
  misc_feature: GYAE6OF02JEJKH.15.86.H09.1.454.CMB.1.raw
  modified_base (513)..(513): a, c, t, g, unknown or other
  misc_feature (513)..(513): n is a, c, g, or t
tcagtctacgtagccacgaccggtgctcgatttagtgctatagacttgggtttgggggggagaggagccccagccttgggatccccaagtgttttcattcagtgatcaggactgaacacagaggacctcaccatggagttcgggctgagctggttttccttgctgctatacttaaaggtgtccagtgtagagtgcgtaggtggtggagtcgtgggggagtccgttaggtaaacgtccggtgggggtcccttaggacgttccttccgtggttggtcggtccttcgtggtacttcgtactttcagtagtggcgtggtagtggtagttcgggtccgcgacggcctaccgggaggggtacggggtcgtcgggaggttcgggttaggtacgtttaagaaaagtaaagtgaagtggtagaagtaaagtagaacgtacggtcgaccgacgtagaaaggacgtactacgactatacgacaagataataaacgtacgaaaacggtcgtagttagtacgtaanaaagtaggaaacctaggtaacctaaggtaaaaaccgagaaccgaaccgtaacgtaccgtttacgtaattaacccgtacgttaacccgacgtaaacgtaacggttcggtaaagtcgtaaacgtcgaacggttaaccgggaagtaccggtaacgttaaccgttagtttaccgttacgtaacgttacggttacgggtacccgggtaaccggtaaggtaccggttcggttacggg

SEQ ID NO: 114594 - DNA, 673 bp, Homo sapiens
  misc_feature: GYAE6OF02FVA8P.15.86.H09.1.454.CMB.1.raw
  modified_base (497)..(497): a, c, t, g, unknown or other
  misc_feature (497)..(497): n is a, c, g, or t
tcagtctacgtagccacgaccggtgctcgattagtgctatagacttggtttggggggagaggagccccagccttgggatccccaagtgtttcattcagtgatcaggactgaacacagaggactcaccgatggagttcgggctcgagctgggttttccttgctgctatcttaaaaggtgtccagtgtgaagtgcaggtggtggagtctgggggagccgttggtaaagccgtgggggtcccttagagtctcctgtgtggcctctggattcactttcagtaagtggctggtatgtagttgggtccgccaggcctccgagggaacggggcgtggtagtgggttgacgtttacgaaaagttaaaatgtagtgggtagaagtaaataggactacggtgacctaacccgtgaaaacggacgacttcgacctatctacaagatataattacgaaaaagtcggtaatatttgaactaaagtcgaaacacgacctaaggaaaaccgnggaactaacgacgtaccgttactaagttacctagtaaccctagtaacggtacgtttacggaaagttcgactacgttaccggaacggtaaacggcggtaccttaaggtgttaccttttaacggaagttaccgttcggtacccggggacccctaagggggtacccttaaggttccggg

SEQ ID NO: 114595 - DNA, 805 bp, Homo sapiens
  misc_feature: GYAE6OF02GUTN0.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagagtctcctgtgtggcctctggattcactttcagttaatggctggatgtagttgggtccgcgaggctccgagggaagggcgtggaggtgggttggacgtttacgaaaagttaaaagtgaagtggtagaagtaaaatagacgtaacggtcgaccgtaccggtagaaaagggagtaacgttaccgaacctaatcctaacgaaagagtaattaaacgtttaaccgaaaaaacggtcggttaagtttaacgttttacggaaccaaaagttacggaaacctacggtaacccgttaaaggaaaaacccggaggtaaccaaaccgtacgggtacccgtttaccgttaaacgtttaacccgttacggttaaaccccaacgtaacggttaacgttttaaccgggggaaatttcggaaccggttaacgttacccggggaaacgggttaaaacgggggtaccggttaacccggtttaagttaccggtttacgtttttaacgggaactttaacggttcccggggttaccggggtacccccggtaaggggttaacccgtaagggttttacccgggg

SEQ ID NO: 114596 - DNA, 663 bp, Homo sapiens
  misc_feature: GYAE6OF02GHZJN.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtgggggtcccttagagtctcctgtgtggcctctggtattcactttcagtaatggctggatggagttgggtccgcaggctaccgagggaagggcgtggaggtgggttggacgtttacgaaaaggtaaaatgagtgtagaagaaaatagactacggtgacgtaccgtaggaaaaggagacttacaacctatactacgaagtacgaattaagtaaccgaaaaacggtacggttaagttaagtttacgaactaaaataggaaacacggtaccgttaacggaaaaaccgagggtaaccaacgaccggccttaactaatttacgtacgtacccaacgtaggtacttacggaagtacgcaagtccgtaaggtaacggaggtcttaagtgttacgtttagagttacgtcggttaccggggacctaggggtacaggttccgg

SEQ ID NO: 114597 - DNA, 726 bp, Homo sapiens
  misc_feature: GYAE6OF02HR4FU.15.86.H09.1.454.CMB.1.raw
  modified_base (686)..(686): a, c, t, g, unknown or other
  misc_feature (686)..(686): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgagttgggtccgccaggctccgaggggaaggggcgtgggaggtggggttaggtacggttttacgaaaaaaggttaaaaatggaagttgggagtaaaggtaaaaattaggaacgttaacgggttgacctaaccccgggtaaggtaaaaagggaaagtaagtttacccaacctaacttaccgtaccaaaaggaggtaaatttaaagtttaaccaaaaaaaccggtagggtttagttaaagtttcgaaactaaaaagttcggaaactaacggaccctaaacggaaaacccgtagggaaccaacgacgtacccgttacttaacttacgtacgtaaccaacgtacgtaagttaccggaagtcgaactagtaccggacgtaaaggacggtctagttacggtntttagattacgtcgtacgggtaccgtaggactaagttcgg

SEQ ID NO: 114598 - DNA, 657 bp, Homo sapiens
  misc_feature: GYAE6OF02H8XNV.15.86.H09.1.454.CMB.1.raw
  modified_base (400)..(400): a, c, t, g, unknown or other
  misc_feature (400)..(400): n is a, c, g, or t
  modified_base (495)..(495): a, c, t, g, unknown or other
  misc_feature (495)..(495): n is a, c, g, or t
  modified_base (623)..(623): a, c, t, g, unknown or other
  misc_feature (623)..(623): n is a, c, g, or t
tcagtctacgtagccacgaccggtgctcgatttagtgctatagacttgggtttggggggaggaggaggccccagccttgggatccccaagtgttttcattcagtgatcaggactgaacacagaggactcaccatggagttcgggctgagctgggtttccttgctgctatcttaaaggtgtccagtgtgaagtgcaggtggtggagtcgtgggggagtccgttggaaagccgtgggggtcccttaggacgtctctggtgtggcctctggattctacgtttcagtatggctggatgaggttgggtccgtccgaggctacgaggggaacgggctggaggtgggttggtacgtttacgaaaagtaaaagtgaacgtgggagaacgtaaaatagaacgtacggtnaccgaccgtaggaaagaaggattacgactaagtacctagaacgagtaataattaacgaaaacgacggttagttagttagacgaaatacgtaaagngtactaacggaaacgtaacgaagaaccagtctaccttaatacgtacgacaaccgagtaccgtaggaaagtacacgtaagacccgtaaggtaaacggacgtgtaattccggttatttagtaacgttacnccgggtacggaccggtagtaacgtacgttcgggg

SEQ ID NO: 114599 - DNA, 665 bp, Homo sapiens
  misc_feature: GYAE6OF02JHOG0.15.86.H09.1.454.CMB.1.raw
  modified_base (214)..(214): a, c, t, g, unknown or other
  misc_feature (214)..(214): n is a, c, g, or t
  modified_base (354)..(354): a, c, t, g, unknown or other
  misc_feature (354)..(354): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtggtttccgtgacgtgctatacttaaaggtgtccagtgtgaagtgcaggtggtggagtcgtggggngccttggaaagccgtgggggtccttagagtctcctgtgtggcctctggattcactttcagtaatggctggatgagttcggtccgcgaggtctacgagggagggctggacgtggttaggacgtttacaaaaagttaaaagnggtaatggtagaagtaaaagtagtacgtacggtgactaaccggtagaaaggagtacttcgacctaatcctaacaagtagtaattaaactaacgaaaaacggtcggtagttaagtttcggaactaaatcggtaaacacggtaaccgtacgaaaaccggtgaactacgaacgtccgtactaacgttcgtaccgtaaacccgataacgtacgttacgggaactgtaaccgagttacggacgttaaaggggctacgttaagttgtaccttttaggaacttacggttcggaccgggtaccgaggtactaggtccgg

SEQ ID NO: 114600 - DNA, 618 bp, Homo sapiens
  misc_feature: GYAE6OF02FU387.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccagggaaggggctggagtgggttggacgtttcaaagtaaaatgatggtgagaaatagactaggtgcaccgtgaaaggagatcacatctacaagagataattacgaaaaacgcggtagtatttggactaaatcgaaacagacctaaggaaaaccgagaaccagaagcccgtatacgttacgtacgtaccacgagtacgttcggaagtcgacgtacgtacggaacgtaaagggagggtacctagttacggtcgtttttaggagtttaacttcgggttaccggggaccccgtaacggggtacctaaggttacggg

SEQ ID NO: 114601 - DNA, 599 bp, Homo sapiens
  misc_feature: GYAE6OF02G9XNU.15.86.H09.1.454.CMB.1.raw
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgatggtagagaaatagactaggtgcaccgtagaaagganattcacatctacaaganataatacaaaacgngtagtatttagacaaagtgaacagcctagaaaaccgagacacagccttactattactacgtaccaactagatttacgggaagtgactagtaccggaggttaaagggaggtacttaagtggttcttttaagagttacgtcggtacggggtaccccgaggggtacctaaggttccggg

SEQ ID NO: 114602 - DNA, 619 bp, Homo sapiens
  misc_feature: GYAE6OF02GBQIM.15.86.H09.1.454.CMB.1.raw
  modified_base (409)..(409): a, c, t, g, unknown or other
  misc_feature (409)..(409): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctcagggaaggggctggagtgggtggacgtttacgaaaagtaaaatgatggtagagaaatagactaggtgcacccgtagaaaggagattacacatctacaaganataattacaaaacgacggtatagtttagactaaatnaacanacctaggaaaaccgaggaacacgacgaccgtacttaacttactacgtaccaacgtaaggtactttacgggaagtacgactacgtaccggaacggttaaagggacggtcttaagtacgtcgtttttagagttacgtcggtccggggacccgaagggtacctagttacggg

SEQ ID NO: 114603 - DNA, 679 bp, Homo sapiens
  misc_feature: GYAE6OF02FRTQ3.15.86.H09.1.454.CMB.1.raw
  modified_base (361)..(361): a, c, t, g, unknown or other
  misc_feature (361)..(361): n is a, c, g, or t
  modified_base (433)..(433): a, c, t, g, unknown or other
  misc_feature (433)..(433): n is a, c, g, or t
  modified_base (500)..(500): a, c, t, g, unknown or other
  misc_feature (500)..(500): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttcctgctgctatcttaaaggtgtccagtgtgaagtgcaggtggtggagtcgtgggggagccttggtaaacgccgtgggggtcccttagagtctcctgtgtggcctctggattcactttcagtaatggctggatgagttcgggtccgcgaggctccgagggaggggctgggaggtgggttggtacgtttacgaaaaagttaaaangaagttggtagaagaaaatagtaactacggtacgaccgaccggtagaaaagggataacttaccacatcctanaaagtagtaattaaacttaacgaaaaacggtggttaacgttatttacggaactaaatacggaaaacncgtaaccgttaacggaaaaaccggaacgtaacaaccgtacgtaccttacgttaagttacctacggtaacccataagttacttaacgggaagtcgactagtccgaaggtaacggacgtcgttagtcggttacttttagactttacgccggttacggggaccctaagggtacttaggtcgg

SEQ ID NO: 114604 - DNA, 565 bp, Homo sapiens
  misc_feature: GYAE6OF02JIO5F.15.86.H09.1.454.CMB.1.raw
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
  modified_base (472)..(472): a, c, t, g, unknown or other
  misc_feature (472)..(472): n is a, c, g, or t
  modified_base (528)..(528): a, c, t, g, unknown or other
  misc_feature (528)..(528): n is a, c, g, or t
tcagtctacgtagccacgaccggtgctcgatttagtgctatagacttgggtttggggggggaggaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttgggaaagccgttgggggggtcccttaaggagttctcctggtgtggcctctggattcactttcagtaatggctgatgagttggccncaggctcagggagggctggagtggtggacgttanaaagtaaatgatggtanagaaatagactacggtgctaccgtgaaacggagattcactatctacaagagattaataccgaaaagcggtattattagataaatagaacagacctaaggaaaccgtagaccanagaccgtatattactcgtaaccacagtacgttacgaagtcacagtacgagtaaggngctatgtcttagatactcggtacggcaggatagtcgg

SEQ ID NO: 114605 - DNA, 711 bp, Homo sapiens
  misc_feature: GYAE6OF02G8LZK.15.86.H09.1.454.CMB.1.raw
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttaggtaaacgccgtggggggttcccttaggacgtcgtccgtgtggtggcctctggattctactttcagtaatggctggatgtagttgggtccgcgaggctccggagggaggggctgggaggtgggtggtacgtttacgaaaaagtaaaagtgagtggtagaagaaagtagacgtacggngaccaaccggtagaaagagtactacacatcanaagagtaataactaacgaaaacgtggtagttaagttagaactaaagtacgaaacacgtaaccgtaaagaaaacccggtagaaaccgacgtaaccgtcccgtttacttaacgttaaccgtacgtaaaccctaacgtaaacggttacgttaacgggtaaagttcgtaacgacgttaaccggtaacggtaaagggacggtaccttaagttcgttacgttttacggaactttacggttccgggtaacggggtaccccgtaaggggtaacctaggtttccggg

SEQ ID NO: 114606 - DNA, 724 bp, Homo sapiens
  misc_feature: GYAE6OF02H3MH9.15.86.H09.1.454.CMB.1.raw
  modified_base (576)..(576): a, c, t, g, unknown or other
  misc_feature (576)..(576): n is a, c, g, or t
  modified_base (645)..(645): a, c, t, g, unknown or other
  misc_feature (645)..(645): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggtttttccttgctgctatacttaaaaggtgtccagtgtgaagtgcaggtggtggagtcgtgggggagccgttaggtaaacgccggttgggggtcccttaaggacgttccttccgtggttggtcgggcccttcgtgggtactttcctacttttcaagttaaagttgggccttgggattggtagggtttcgggttccccgccgaggtccttacccggaagggggtaagggggcgtggggacggggtttggggtttagggttaaccgttttaacgtaaaaaaaggttaaaaagtaggtaagttagggttaggaaacgtaaaaagtaagaacgttacgggtgacctaacccgggtaggaaaaggaatactacacctatcgtacaaagataagttaaactaacgaaaaacgtcggtagttatttagaanaaagtgaacacgacgtaacgaaaccgagaacacagtacctatacttctacgtacacgtagagttcgaangctagtaccgaaggtaacggagcgttaatgttagtttagatttacggtcggaccgggacccggtaggacgtaggttcgg

SEQ ID NO: 114607 - DNA, 656 bp, Homo sapiens
  misc_feature: GYAE6OF02F6XKW.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatgtagttgggtcccgcaggctccgagggaaggggctggaggtggggttggacggtttacgaaaagtaaaatgattggtagaagaaaatagaacgtacggtgaccgacccgtaggaaaaggaagtattacgaacccatcctacaagagtaataatttaacaaaaacgtacggtagtaatttaggactaaatcgaaacacgacctaggaaaaccgagaaccaacgagtccctacttaattacctacgtaccaacgagtacgttacggaagtacgactacgtacgaacggtaaaggacggtacgttacgtggttactttagtaacttcgtaccggttacgggacccgtaggggtactaggttccggg

SEQ ID NO: 114608 - DNA, 761 bp, Homo sapiens
  misc_feature: GYAE6OF02H0DVN.15.86.H09.1.454.CMB.1.raw
  modified_base (261)..(261): a, c, t, g, unknown or other
  misc_feature (261)..(261): n is a, c, g, or t
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttaggtaaagccgtgggggtcctagagtctctgtgtgcctntggattcactttcagttaatggctggatggaggttcgggtcccgccgaggccgtaccgaggggaacggggctagggtaggtgggttggtacgtttacgaaaaagtaaaatgagtaggtagaagtaaaagtagacgtaacggtacgaccgtaaccggtagaaaaggaagacttacgaacctatacctacgaaagtaagaattaaacgttaacgaaaaaaccggtacggtttaagttaaacgtttagaacgtaaaatacggaaactacggaccgtaaacgaaaaccggagaaccgaacgtacgtaccgttacttaacgtttaaccgtacgaaccgtaactaaggtacgtttaacgggaagttacgaacgtacgtaaccggtaaacggttaaagggtacggtaacgtttaacgttacggtttacgttttacggtaagtttaaccggttaccgggttaccgggggtaacccccggtaaggggttacccgtaagggtttaccggg

SEQ ID NO: 114609 - DNA, 669 bp, Homo sapiens
  misc_feature: GYAE6OF02HAN1E.15.86.H09.1.454.CMB.1.raw
tcagtctacgtagccacgaccggtgctcgatttagtgctatagacttgggtttggggggggagaggagccccagccttgggatccccaagtgtttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgagggaaggggctgggagtgggttggacgtttacgaaaagtaaaatgagtggtagaagaaaagtagactacggtgacaccggtaggaaaggaagattacaaccatctacaaagagtaataattaaccaaaaacggtacgggttagttaagtttgaactaaatagaaacacgacctaaggaaaaccggaggaaccaacgacgacccgttacttaacttaacgtacgtaacccaacgaagtaacgtttaccgggaaagtcgactaacgttaccggaacggtaaaggggacggtactagtacggttcttttagaagttagttcggtacggggtaccccgaaggggacctaaggttcggg

SEQ ID NO: 114610 - DNA, 617 bp, Homo sapiens
  misc_feature: GYAE6OF02GKVAJ.15.86.H09.1.454.CMB.1.raw
  modified_base (367)..(367): a, c, t, g, unknown or other
  misc_feature (367)..(367): n is a, c, g, or t
  modified_base (382)..(382): a, c, t, g, unknown or other
  misc_feature (382)..(382): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatgtagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccaggggaaggggctggagtgggttggtacgtttacaaaagtaaaatgatgggtgaanaaaatagactacggngcaccgtgaaaggagattcacatctacaagagataatacaaaaacgcggtagtatttagacaaatgaaacacgacctaaggaaaaccgaggaacacgaagcccgtactaacttacattaccaacaaggtattaccggaatcgaccaagtccggaacgtaaagggacgtcttaagtcggttcttttacgaagttatccggttacggggaccccgtaggggtacctaaggttccggg

SEQ ID NO: 114611 - DNA, 648 bp, Homo sapiens
  misc_feature: GYAE6OF02HFBDI.15.86.H09.1.454.CMB.1.raw
  modified_base (262)..(262): a, c, t, g, unknown or other
  misc_feature (262)..(262): n is a, c, g, or t
  modified_base (585)..(585): a, c, t, g, unknown or other
  misc_feature (585)..(585): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggtttccttgctgctatcttaaaaggtgtccagtgtgaagtgcaggtggtggagtctgggggagccttggtaaagccgtgggggtcccttagagtctcctgtgtggcctcnggtattcactttcagtaatggctggatgtagttgggtcccgcaggcctcgaggggaaggggtctggagtgggttggtacgtttacgaaaaagtaaaatgatggtagtaagaaaatagactacggtgcaccgtagaaaggagacttcacgatactacaagaagtaataattaaccgaaaaacggtcggtagttaagtttaggaactaaaactagaacacgtaccgtaaggaaaaacccggaggaaccaacgacgtaccgttactaatttacgtacgtaccaacgagtattaccgggaaagttgaccagtacggaacgtaagggngtactagtggttacttttgaagttcgtcgggtacgggacccggtaagggtacctaggttcggg

SEQ ID NO: 114612 - DNA, 689 bp, Homo sapiens
  misc_feature: GYAE6OF02IL2YU.15.86.H09.1.454.CMB.1.raw
  modified_base (426)..(426): a, c, t, g, unknown or other
  misc_feature (426)..(426): n is a, c, g, or t
  modified_base (472)..(472): a, c, t, g, unknown or other
  misc_feature (472)..(472): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtggggagccttgggtaaagccgtgggggtcccttagacgtctccgtgtgtcggcctctggattcactttcagttaatggactggatggaggttcgggtccgccgaggctccgagggaggggctggagtgggttggacgtttacgaaaagtaaaatgtatggtagaagaaaatagaactacggtgcaccgtagaaaggagtactacacgatatacaaagntaataactacgaaaaacgtaggttagtagtttacgactaaaagtanaacgtagaccgttaacggaaaacgacggaacaaacgacggtacccgtacttaacgttaaccgttacgtaaccaacaacgttaattaccgggggaaaatttggaacccgtaagttaaccgggaacgttaaaaaggggccgacgtttaaacggtcgtttagttttagacgttaattccgggtaggggtacccccggaagggtaccgtaaggtttccggg

SEQ ID NO: 114613 - DNA, 670 bp, Homo sapiens
  misc_feature: GYAE6OF02IVCPN.15.86.H09.1.454.CMB.1.raw
  modified_base (619)..(619): a, c, t, g, unknown or other
  misc_feature (619)..(619): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcttggttttccttgctgctatacttaaaagtgtcagtgtgaagtgcaggtggtggagtcgtgggggagtccgttggtaaaggccgtcggggggtcccttaggagtccttccgtgtggtcggcctcgtggtattcctacttttcaagttaatggcgtggatggtaggttgggtcccgccgaggccgtcccgagggggaagggtccgtggggaggttggggttgggtacgtttacgaaaaaggtaaaatgagttaggtgaagtaaaagtagactacggtagcaacccggtagaaaggtaagtacttacgaacctatactacgaagaaggtaactaaattaaccaaaaacggtacggttagtaatttagactaaaagtcgaaactagacctaaggaaaaccgagacacgacgactactacttacgtactaccatacgagttacgaagtcgacgactaggacgtaaggacggtnttagtagttcgtttagattagccggttcgggaccgacggtacgtagttcgg

SEQ ID NO: 114614 - DNA, 719 bp, Homo sapiens
  misc_feature: GYAE6OF02I83GV.15.86.H09.1.454.CMB.1.raw
  modified_base (245)..(245): a, c, t, g, unknown or other
  misc_feature (245)..(245): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttcctgctgctatacttaaaaggtgtccagtgtgaagtgcgaggtggtggagtcgtggggagccgttaggtaaagccgtgggggtcctagngtctcctgtgtcggcctcgtggattcacttctagtaagtggtcgtggagtagtcgaacgttgggaccgccctagggcgtaccggaggtaagggggcttggggagtcgggttagaaacggttttacaaaaggttaaaaatggaataggtaagtagaaaaacgtaggaactaacggtacgagaacccggtagaaaacggtaacgaacttacaacctatactacgaaagtaagtaacgtaaaacgttacgtaaaaacgtacgttaacgtaatttagactaaaatagaaacaagaaccctaagaaaacccgtaggaacaacgtagtaccgttactacgttaacctacgtaaccacgtaacgaacttcggaaacttacgaacgtaacgtacgaacggttaaacggtaggtcgttaacgttaggtaaccttttaggaacgttacggaccgttaggggaaccccgtagggtaccgtaacgg

SEQ ID NO: 114615 - DNA, 678 bp, Homo sapiens
  misc_feature: GYAE6OF02F315T.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttttccttgctgctatcttaaaggtgtccagtgtgaagtgcaggtggtggagtcgtggggagccgttggtaagccgtgggggtccctagagtctcctgtgtggctctggattcactttcagtaatggctggatgagttgggtccgcaggctccgagggagggctggagtgggtgacgttacaaaagtaaatgatggtagagaaatagaactacggtagccaccggtagaaaggagacttacgacatactacgaagagaataacttaacaaaaacggtcgttagtagtttagactaaatagaacacgactaacgaaaaccggacgaacgacgacgtcccggtattacgttacctacgtaaccacgtaacggtaacgttaccgggaagttcggaacgaaccggttacggtaaccgggttaaaaggacggggttaacttaaggttccggttaagttttacggtaactttacggttaccggttaccggggggtaaccccgacgggggtaacctaagggtttaccggggg

SEQ ID NO: 114616 - DNA, 590 bp, Homo sapiens
  misc_feature: GYAE6OF02FGY6V.15.86.H09.1.454.CMB.1.raw
  modified_base (149)..(149): a, c, t, g, unknown or other
  misc_feature (149)..(149): n is a, c, g, or t
  modified_base (470)..(470): a, c, t, g, unknown or other
  misc_feature (470)..(470): n is a, c, g, or t
  modified_base (484)..(484): a, c, t, g, unknown or other
  misc_feature (484)..(484): n is a, c, g, or t
  modified_base (528)..(528): a, c, t, g, unknown or other
  misc_feature (528)..(528): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcngggttttccttgctgctatctaaaaggtgtccagtgtgaagtgcaggtggtggagtctgggggagccttggtaaagcctggggggtccctttagagtctcctgtgtggcctctgggattcactttcagtaatggctggatgagttgggtccgccagggctcagggaaggggctggagtgggttggacgtttacaaaagtaaaaatgagtggtgagaaaatgactaggtgcaccgtgaaaggagattcaccatctacaagagataattacaaaaacgacggtagtatttgacaaatgaacagacctagaaaaccgagacacngcctactattacgngtaaccacgagatttacggaatggctacgtacggacgtaaaggnggtaactataggtctttttgaattacgttcgtacggggcccctaggggaacctaggttcggg

SEQ ID NO: 114617 - DNA, 662 bp, Homo sapiens
  misc_feature: GYAE6OF02HPECT.15.86.H09.1.454.CMB.1.raw
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (567)..(567): a, c, t, g, unknown or other
  misc_feature (567)..(567): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttccttgacgtgctatcttaaaaggtgtccagtgtgaagtgcgaggtggtggagtcgttgggggagccgttaggtaaaggccgtggggggtacccttaggacgtctcctggtgtcggcctctggattcactttcaagtatgctggatgngttggccgcgnggctccgagggacgggctggaggtgggttggtacgtttacgaaaagtaaatgagtggtagaagaaatgacgtacggtgcgaccgtagaaggagtactacaccgagtacagaacgaagacttaaacgttacaaaaacggtcggtattaacgttagaacctaaagtaggaaactacgtaccgtaagaaaaccgtagggtacccacgacgtacccgttacgtattacgtacgtacctaacgagtaattacgggtaangaaccgtatacccgggacgttaaggcggtaatcggtagttcttttaggatttacgtaccggtacgggtacccctaggggtaatacgttacccggg

SEQ ID NO: 114618 - DNA, 720 bp, Homo sapiens
  misc_feature: GYAE6OF02IMYAX.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagcgtggttttcctgctgctatcttaaaaggtgtccagtgtgaagtgcaggtggtggagtcgtggggggatccgttaggtaaaacggtcctagggggggtcccctttaaggacggttcctccgttggtggtcggcccgttctgggtactttcacttttcgaagtaatggtcgtaggtattggaggttcgggtcccgccgaggcctccggaaggggaaggggctaggggagtggggttggtaaccgtttaacgaaaaaagttaaaaacgtggtaagtaggtagaaaggtaaaaactagaaccgttacggtgaacctaccggtagaaaacgaaggtacttaccaacgacttcaacgtaaagaagaattaaacgtaacgaaaaacggtaggtagttatttaagactaaaatcggtaaaacagacccgtaaagaaaaccgtacaacgaacacggtcctagtaacttaacgtacgtaaccaagagttaagttacgaaagtcaacacgtacggaagtaaagggacgcttagtgttacttagaattcgtacggccgggtaccgacggtacgagttcggg

SEQ ID NO: 114619 - DNA, 590 bp, Homo sapiens
  misc_feature: GYAE6OF02FWB8Y.15.86.H09.1.454.CMB.1.raw
  modified_base (534)..(534): a, c, t, g, unknown or other
  misc_feature (534)..(534): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgagggagccttggtaaagccgtggggggtcccttagagtctcctgtgtggcctctggattcactttcagtaatggctggatgagttgggtccgccaggctccgagggaagggacgtggagtgggttggacgtttacgaaaagtaaaatggatggtagaagtaaaatagactacggtgacaccggtagaaaggagattcaacatctacaagagataatacaaaagtcgtatattagacaatgaacagctaagaaacgaggacacgagtccgtattaacttactagtaccagagtacgttacgagtgacagtacgaacggtaaggngtacgtagtcgttactttagacttacgtccggtacgggtacccgagggactaacgg

SEQ ID NO: 114620 - DNA, 685 bp, Homo sapiens
  misc_feature: GYAE6OF02H4P9T.15.86.H09.1.454.CMB.1.raw
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
tcagtctacgtagccacgaccggtgctcgatttagtgctatagacttgggtttgggggagaggagcccccagccttgggatccccaagtgttttcattcagtgatcaggactgaacacagaggactcaccatggagttcgggctgagctgggttttccttgctgctatctaaaggtgtccagtgtgaagtgcaggtggtggagtcgtgggggagcgttaggtaagccgtgggggtcctagagtctctgtgtgctgtgatcacttcagtaatgcgtgatgagtggtccgcgagctcgagggaggcgtggaggtggtgtacgtttacgaaaagtaaatgatggtagaagaaatagactacgngcgacgagaagagatacacatcacaaganaataacttaacgaaaacgtcggttaagttaattagaactaaaagtacgaaacgagtaacctaaacggaaaacccgtggaaaccacgtaaccgtaccgtaacgttaacgtttacctaaccggttacccaaacgtaacggttaacgtttaacggaaaggttacggactaacggtaccggtaaacgggttaaagggtacgtacgtttaacgtttagggtccttttttaacggaacttacgggttaacccgggaccgggggttacccccgaaacggggttaaccgtaaggtttacccggg

SEQ ID NO: 114621 - DNA, 827 bp, Homo sapiens
  misc_feature: GYAE6OF02FGJVL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatctaaaaggtgtccagtgtgaagtgcaggtggtggagtcgtggggagtccttaggtaaagccgtgggggtccccttaggagtctcctgtcgtggcctcgtggtacttctactttcgagtaatggcgtggatggtaggttcgggtcccgaccgtacggccgtaccgagggggaacggggtctagggtaggttagggttacggtaaccggttttaacgaaaaaacggttaaaaacgtcggtaagtagggttaacgaaacggtaaaaagtacggtaaccgttaacggtacgtacccggtaacccggtaaggtaaaacgggtaaagtacttaccgaaaccctaacgttacctaaccgtaaacggtaacgtaaactaaacgtttaaaccgaaaaacccgggtcggtttagttaaacgtttcggaaacctaaaacgttacggaaaccgtacggtaacccgttaacgggaaaaacccgtggtaacccaaccggtacgtcccggttaacttaacttaaccgtacgtaaccaaccgtaaggttaaccgttacgggaaacttcggaaccgaagtttaccggaaggtaaacggccgtttaacgtacgttacggttacttttacgaacgtttacgacgggtcccgggaccgaagggttaccagtttccggg

SEQ ID NO: 114622 - DNA, 582 bp, Homo sapiens
  misc_feature: GYAE6OF02J1UIP.15.86.H09.1.454.CMB.1.raw
  modified_base (273)..(273): a, c, t, g, unknown or other
  misc_feature (273)..(273): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgccaccctaagtagtgagcatacgaacctacaccatacgatggtatcaanagagaccagggaactcccccagtactataatagaaagttaagagtagagtgcagccacgaccggaaggggacggacncccgagtcgtctacngtcggctacgagtcgtgggcgtgaccgtctaccncgacactcacccaacctccgagtcngacgatcggacgtcagtagtactccgacgtggtaggacgtacgacgtacccaacacgttaagtgtaagccggtacgaagggtacgggtttcggggtcgtcggggacggacgggtaaccgacgtccggacgtacccggtacggtaggcccgtaaccggg

SEQ ID NO: 114623 - DNA, 645 bp, Homo sapiens
  misc_feature: GYAE6OF02GBVTY.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgagggaaggggcgtggagtgggttggacgtttacgaaaagtaaaatgatggtagaagaaatagactacggtgacgaccgtagaaaggagattacacatctacaagagtaataataccgaaaaacggtcggtagttaagtttagactaaagtgaaactacggaccctaaggaaaaacccgtaggaaccacgacgtcccgttactactttaacgtacgtaacccaacgaagtacgttacggaagttgactagtccggaagtaacgggaggtactagttcgttacttttagaattacggttccggtcggggaccccgaaggggtacctagttccggg

SEQ ID NO: 114624 - DNA, 574 bp, Homo sapiens
  misc_feature: GYAE6OF02FQ2ZW.15.86.H09.1.454.CMB.1.raw
  modified_base (400)..(400): a, c, t, g, unknown or other
  misc_feature (400)..(400): n is a, c, g, or t
  modified_base (466)..(466): a, c, t, g, unknown or other
  misc_feature (466)..(466): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagccgtgggggtcccttagagtctcctgtgtggcctctggattcacttttcagtaatggctggatgagttgggtccgccaggctccgagggaaggggctggagtgggtggacgtttacgaaaagtaaaatgatggtagagaaatagactacggtgcaccgtgaaagagatcacatcncagagataattacaaaacgcggtagtattgacaaatgaacagcctagaaaccgagacacagccgtntacttacgtagtacccacagattacggaagtcgctagtcgacgtaaaggacgtacgtaagtgtacttttagattacgttcgtaggggtccccaagggtaccagttcgg

SEQ ID NO: 114625 - DNA, 627 bp, Homo sapiens
  misc_feature: GYAE6OF02FJZQD.15.86.H09.1.454.CMB.1.raw
  modified_base (426)..(426): a, c, t, g, unknown or other
  misc_feature (426)..(426): n is a, c, g, or t
  modified_base (464)..(464): a, c, t, g, unknown or other
  misc_feature (464)..(464): n is a, c, g, or t
  modified_base (486)..(486): a, c, t, g, unknown or other
  misc_feature (486)..(486): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatcttaaaaggtgtccagtgtgaagtgcaggtggtggagtctgggggagccttggtaaagcctagggggtccccttagagtctcctgtgtggcctcgtggattcacttcagtaatggctggatgaggttgggtcccgccgaggctccagggaagggtctggagtgggttgacgtttacaaaagtaaaaatgaatggtagaaggaaaataggaactacggtagccaccgtagaaacggagattacaccattctacgaaganaataattacaaaaacgcggtagtatttagacaaaagtnaaacacgacctaagaaaaccgnggaaccaacgagccgtacttaattacagtacccaacgaagtagttaccggaatcgacgaacgtcgaacggttaaaggcggtactaagtcgtacttttaggaattacgcggtacggggaccccaggggtaactaggttcggg

SEQ ID NO: 114626 - DNA, 798 bp, Homo sapiens
  misc_feature: GYAE6OF02IOGGD.15.86.H09.1.454.CMB.1.raw
  modified_base (647)..(647): a, c, t, g, unknown or other
  misc_feature (647)..(647): n is a, c, g, or t
  modified_base (673)..(673): a, c, t, g, unknown or other
  misc_feature (673)..(673): n is a, c, g, or t
  modified_base (682)..(682): a, c, t, g, unknown or other
  misc_feature (682)..(682): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttcctgctgctatacttaaaaggtgtccagtgtgaagtgcaggtggtggtagtcgtgggggagccctttagggtaaaacgcccggttcggggggtcccttaggacggtccttacccttggttcgtcgggcccttcgtggtactttcgtaacctttccgaagttaatagggtccgttaggattggtacggtttcgggggtcccgaccgtacgggcctacccggaagggggaacggggtcgtgggtaagggttcggggttacggttaacgttttaaccggaaaaaaggttaaaacgtgaagttacgggagtaaagtaaaagtacgtaacgttacggtacgtacgtaacccgtagggaaaacggacgttaacttaccaaccgtaattcctaacgaacgtaagtaaacttaaacggttaacgaaaaaccggtacggtagttttaaagtttaaggaaattaccgaaacgtacgtaaccgtaaccggaaacgacgtaanaccgtacgtacttactagttaaccgntaacccganacgttacgtacggaagtcacgtaagtaccgtaaggtaaggacggtattagtcggtttactttacgattaacgtccgggtacgggacccgtaagggtacttaacggtggttaacccg

SEQ ID NO: 114627 - DNA, 806 bp, Homo sapiens
  misc_feature: GYAE6OF02HQK5K.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttaggagtctccgtgtgtggcctctggattcacttttcagtaatggactggatcgagttcggtccgccgagctccgaggggaagggctgggagtgggttggacgttttaacaaaaggtaaaatggagttaggtagaacggaaaagtacggaacgtacggtgaccgaacccggtaggaaacggaagtaacttacgaacctataccgtaacgaaacggtaagtaattaaaacgttaaaccgtaaaaaaggtaccggtttagttaaacgttttacggaacttaaaaagttacgaaacgtaaacggtacccgtaaacgggaaaaaacccggaggaaaccgtaaacgaacgtcccggttaccttaaacgttaccgttaacgttaccccgaacgtaacgtaacgttttacgggaaacggttacgtacctaacggtacggtaaaccgggttaaaggggtaacggtacgttaaacgtttcggttaccgttttttaacggaacgttttacgggttaaccgggttcccgggggttaaccccggtaaagggggtcccttaaagggtttcccggggg

SEQ ID NO: 114628 - DNA, 647 bp, Homo sapiens
  misc_feature: GYAE6OF02JDYR9.15.86.H09.1.454.CMB.1.raw
  modified_base (322)..(322): a, c, t, g, unknown or other
  misc_feature (322)..(322): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttggtccgccaggctccagggaaggggcnggagtgggttggacgtttcaaaagtaaaatgatggtagagaaaatagaacgtacggtagccgaacccgtggaaaaggaagattaccaccgatactcaagagaataattacaaaaacggacggtagttaatttagactaaatagaaacacggtacctaaggaaaaacccggtaggaaccaacgacgtacccgtacttaactttaccgtacgttaacccaacgagtaacgtttacgggaaagttcgactagtccggaacggtaaaggacggtatacgttggtacgttttagattacgtcggtacggggacccagggactaagtcggg

SEQ ID NO: 114629 - DNA, 577 bp, Homo sapiens
  misc_feature: GYAE6OF02F4IR1.15.86.H09.1.454.CMB.1.raw
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgatggtagaagaaaatagactacggtgcaccgtagaaaggagattcacatctacaagagataatacaaaaacgcggtagtatttgactaaatgaacagcctagaaaccgngacacagccgtatattacngtaccanagattcgaagtgacagtcgaacgtaaggacggacttagtgtcttttagaacttacgtcggtacggggaccctagggactagttcggg

SEQ ID NO: 114630 - DNA, 706 bp, Homo sapiens
  misc_feature: GYAE6OF02GMEH7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcgaggtggtggagtcgtgggggagccgttagggtaaagccggtgggggtcccttagagtctctgtgtgcctctggattcactttcagtatggctggagtgtaggttcgggtccgccgaggcctcggaggggaaggggcgtgggaggttggggttaggtacgtttaacgaaaaagttaaaagtggtaagtagggtagaaagtaaaagttaggaaccttacggttacgaccgtaacccgggtaggaaaagggaagtacttaccgaacctatacctacgaaagaagtaattaaacttaaccgaaaaacggtacggttagtttaattaggaactaaaagtacgaaaccacggtacccgtaaaggaaaaccggtagaaacctacgacgtcccgtattaacgttacctacgtaccactagtaacgttcggaaagtcgaactagtacggaaggtaacgggagtcttaagtcgttagttttagattaggtcggtaccgggacccaagggtactaggttcgg

SEQ ID NO: 114631 - DNA, 711 bp, Homo sapiens
  misc_feature: GYAE6OF02IKTF2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaagccgtgggggtcccttagagtctcctgtgtggcctctggattcactttcagttaactggctggatgaggtttcgggtccgccagggtcctccggaaggggagggggctgggtagggtggggttaggtacgtttaacaaaaaggttaaaatggattaggtagaagaaaattacgacgttacggtagaccgaaccggtaggaaaggtaaatacgttaccaacctaagttacctagaaacgaagtaataaacgtttaacgaaaaacgtacgggttattaagtttagactaaaagtcgaaactacggtaaccctaaggaaaacccgaggtaaaccaacacggtacccgttattaacgttaccgtagtacccgtactaagtacgtttacgaagtcgactacgtaccgaaggtaacgggagaacttaggcgtttaacgtttgaagttcgttacgggttacccgggaccgaaagggtcctaaggtcggg

SEQ ID NO: 114632 - DNA, 758 bp, Homo sapiens
  misc_feature: GYAE6OF02IAF5V.15.86.H09.1.454.CMB.1.raw
  modified_base (272)..(272): a, c, t, g, unknown or other
  misc_feature (272)..(272): n is a, c, g, or t
tcagtctacgtagccacgaccggtgctcgatttagtgctatagacttgggtttgggggggagaggagcccccagccttgggatcccccaagtgtttttcattcagtgatcaggactgaacacagaggactcaccatggagttcgggctgagcgtggttttccgttgcgtgctattattaaaaggtgtccagtgtgaagtgcaggtggtggagtcgtgggggagccgttaggtaaagccgtgggggtcccttaggagtctcctgtgtggcctntggattctactttcagtaatggcgtggagtgagttgggtcccgccgaggctaccgaaggggaacgggctggtaggtgggtacggtacgtttacgtaaaaagtaaaaatggaagtggtagaaagaaaaagtagaacgtaacggtcgaccgaacccggtaagaaaaggaaagtaacgttaccaccgaattcctaacgaaagtaagtaacttaaagtttaaacgaaaaaacggtacggtttaagttaagtttacgaacgtaaaatacggaaacagtaccaaacgaaaaacccggaagaacaacagaccgtacttaaacgtttaccgtaagtacccaaagtaacgtaagtttaccgggaaagtacgaccgtaagttaccggaaacggttaaaagggtaggaacccttaagttggttaacccggttttttagaacgtttaacgtccgggttaccggggggaccccaaaggggttaacccaaggtttccggg

SEQ ID NO: 114633 - DNA, 672 bp, Homo sapiens
  misc_feature: GYAE6OF02GHBE0.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccgagggaaggggctgggagtgggttggacgtttcaaaagtaaaatgatggtagagaaatagactacggtgcaccgtgaaaggagattcaacctatctacaagacgaattaatacaaaaacggtcggtagttaagtttggactaaataggaaacacggacctaaggaaaaccgtaggaaccacgacgcccgtactattaaccgtacgtaacccactaacgtagtttaccgggaaagttcgacgtaacgtaccggtaacgggtaaaacgggacggtaacgtttaagttacgggttactttttagaagtttaacggtccggtttaacggggggaccccctaaagggggtacctaaaggtttcccgggg

SEQ ID NO: 114634 - DNA, 728 bp, Homo sapiens
  misc_feature: GYAE6OF02HHMVU.15.86.H09.1.454.CMB.1.raw
  modified_base (325)..(325): a, c, t, g, unknown or other
  misc_feature (325)..(325): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagtccgttggtaaagccgtgggggtcccttagagtctcctgtgtggcctcgtggattcactttcagtaatggctggatgagttggtccacgaggctcgagggagggctggnggtgggtgtacgttacgaaaagtaaatgtagtggtagaagaaatagacgtacggtgacaccgtagaaaggagtactacaacctatactacaaagaagtattaaattaaccgaaaacggtacggttagtttaacgtttagaacgtaaaagtacgtaaaccgtaacgtaccgtaacggaaaacccggtacgggaaccaaccggacgtacccgttacttaaacgttaccgttaccgtaacccgaacgtagtaacgttacgggtaagttacgtaccgtaaccgttaccgggaaacggtttaaacggggacgttaacggttaacgttacggtttaccgtttttaggaagtttaccggttaccgggtacccgggggtaaccggtaaccgggtaccgtaaggtttcgggg

SEQ ID NO: 114635 - DNA, 778 bp, Homo sapiens
  misc_feature: GYAE6OF02I5NGP.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagtccgttaggtaaagccgtgggggttcccgttagtagtctccgtgtggtcggcctcgtggtattctactttcagtaatggcgtagggtatggtaggttcgggtcccgccgacggcgtaccgaggggaaggggcgtgggtaggtggggttacgggtacgtttaacgaaaaagtaaaaagtgtaagtggtagaagtaaaagtaagtaacgtacggtcgcctaacccggtaggaaaaggtaagtaataccgaacctactactaaccaaggtaacgtaattaactaaccgaaaaaaccggtggtttaacgttagtttaacgaacgtaaaacgttgaaaaccgaccgtaccgttaaaccggaaaaccgggtacgaaacccgtaacaccggttaccccggttactttaaacgttacccgttacgtaaacccaggtaaagtcggttaaacggtaaggttacagtaaccgtacggaaacgttaaaggggaacgtaccgttaatcggttacgtttagtagttacgtcgggttacccggggaaccctaaggggtaacctagtttaccgggg

SEQ ID NO: 114636 - DNA, 649 bp, Homo sapiens
  misc_feature: GYAE6OF02IV0AP.15.86.H09.1.454.CMB.1.raw
  modified_base (373)..(373): a, c, t, g, unknown or other
  misc_feature (373)..(373): n is a, c, g, or t
tcagtctacgtagccacgaccggtgctcgatttagtgctatagacttgggtttgggggggagaggagccccagccttgggatcccaagtgttttcattcagtgatcaggactgaacacagaggactcaccatgagttcgggctgagctgggttttccttgctgctatcttaaaaggtgtccagtgtgaagtgcaggtggtggagtctgggggagccttggtaaagcctggggggtcccttagagtctcctggtgtggcctctggattcactttcagtatggctggatgagttgggtccgccaggctccagggaggggctggagtgggttgacgtttacaaaagtaaaatgatggtagagaaaatgactaggtnctaccgtgaaaggagattcgacatctcaaagagaataacttacgaaaaaccgacggttagtaatttaggactaaagttagaaacacggacccttaggaaaaccgaggaccacgtacgcccgttattaacttactacgttaaccaactacgtaagtttccgggaaagttcggtaacacgtaccgggtaacgttaaaggggacgacgttaattcggtctttttacggaatttaccgttcggtaccgggggtaccccaacggggtactaaggttacggg

SEQ ID NO: 114637 - DNA, 638 bp, Homo sapiens
  misc_feature: GYAE6OF02HW8DY.15.86.H09.1.454.CMB.1.raw
  modified_base (476)..(476): a, c, t, g, unknown or other
  misc_feature (476)..(476): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctctgtgtggcctctggattcactttcagttaatggctggatgaggttgggtcccgccgaggctaccgaggggaaggggcgtgggaggtgggttggacgtttacgaaaaagttaaaatgagtaggtagaagaaaatagaacgtaacggtgtacgaccgtaggaaaggaagtattaccgacatctagaagagtataatacgaaaacgtcgtagttattagataaatanaacagacctaagaaaccgagacacagacctactattaaccgtagtaaccaacgtagtaacgttacggaagtcgactagtaccgaacggtaaaggaggtactaagttcgtcttttagaattcggtacggtaccggggaccctaagggtacctaaggttccggg

SEQ ID NO: 114638 - DNA, 637 bp, Homo sapiens
  misc_feature: GYAE6OF02I5P90.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgaggttgggtccgccgaggctccgagggaaggggctgggaggtgggttggacgtttacaaaagtaaaatgaatggtagaagaaaatagaacgtacggtgacaacccggtaggaaaggaagattcaaccatactacaagagaattaataacgaaaaacgcggttagtatttagactaaagtcgaaacagacctaaggaaaccgagacaacgcgcctacttagttactacgtaccacgagtacgttacgaaagtcaatacgtaacgaacgggtaaggacggtgttaacgtgttatttacgaatttacgtcgggtaccggggtacccgtaaggggacctaaggttccggg

SEQ ID NO: 114639 - DNA, 675 bp, Homo sapiens
  misc_feature: GYAE6OF02HB64P.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtgcctctggattcactttcagtaatggctggatgagttgggtccgcaggctcgagggagggctggagtgggttggacgtttacaaaagtaaaatgagtaggtagaagaaaagtagaacgtacggtgaccgaacccgtaggaaacggaagtacgttacaaccgtatactacgaaagagtaataattaacgaaaaacgtacggtagttaattagactaaatagaacacgaccgtaacgaaaaccgaggaaccaacgacgtaccgtaacttaactttaccgtacgttaacccaacgtaacggtaagttacggaaaggtcgtacgtaagtaccgtaacgggtaaaggacggtaacttagttagttaccgttttaagagttacgtccggttacggggaccccgtaagggtacccgaaggttccgg

SEQ ID NO: 114640 - DNA, 603 bp, Homo sapiens
  misc_feature: GYAE6OF02GP96P.15.86.H09.1.454.CMB.1.raw
  modified_base (399)..(399): a, c, t, g, unknown or other
  misc_feature (399)..(399): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgccaggctccgagggaaggggctggagtgggtggacgtttacaaaagtaaaatgatggtagaagaaaatagactacggtgacacccgtagaaagganattcaccatctacaagagaataatacaaaacgacggtagtatttagactaaagtgaaacagacctaaggaaaaccgaggaacacgacgccgtactattactagtaccacagattacggaagtgacagtacgaacgtaaggacggcttaagttgtacttttagacgttagtcggtacggggacccgtagggacctaggttccggg

SEQ ID NO: 114641 - DNA, 889 bp, Homo sapiens
  misc_feature: GYAE6OF02IPTX0.15.86.H09.1.454.CMB.1.raw
  modified_base (256)..(256): a, c, t, g, unknown or other
  misc_feature (256)..(256): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggagtccgttaggtaaagccggtgggggtcccttaggngtctccgtgtgtggcctcgtggattcactttcagtaatggtctggatggaggttgggtccccgacacggtcctaccgggaaggggaagggggtcgtaggggtagggtttgggggttacgggaacggttttaacgaaaaaaaggttaaaagtggtaagtagggttaagaaagaaaaagttaggaacgtacggtacgaccgtaaaccggtaggaaaaagggtaacgtacgtttacccaaccgaattaccgtaacaaaacggaagtaaatttaaaacgttaacggaaaaaaaccggtacgggtttagttaacgtttacggaaacctaaaagttacgggaaaaaccacggtaacccgtaaaacgggaaaaaacccgggaagggaaacccaacggtaaccgtccccggttaaatttacgtttaaacccgtagttaaaaccccgaagttaaccgggtaacttacccgggggtaaaagtccgtaaacgacgttaacccgggaaacgggtaaaaacggggtggggttaccttaacgtttagggttttacctttttacgggttaaaattccccggttttaacggggttccccgggggtaaacccccgggaaggggttaaaaccgtacgggtttaaccggggg

SEQ ID NO: 114642 - DNA, 668 bp, Homo sapiens
  misc_feature: GYAE6OF02HFVJ4.15.86.H09.1.454.CMB.1.raw
  modified_base (424)..(424): a, c, t, g, unknown or other
  misc_feature (424)..(424): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggaaagccgtgggggtcccttagagtctcctgtgtggcctctggattcactttcagtaatggctggatggagttgggtccgccgaggcctaccgaggggaacggggctgggaggttggggttggtacggtttacaaaaaggttaaaagtgtagtaggtagaaggtaaaataggaactacggtacgacaccgtaaggaaaggaanagttacaactatactacaaagagtaactaaattaacgaaaaacggtcgggttaattaatttcgataaatagaaacagacctaggaaaaaccgagacaacgagtactcttaacttacgataacccaacgaagttaattcggaaaggttcagtactacggaacggttaaaggacggtaactagttacggttacgtttagacgtttacggtcggttcgggacccggaaggtaaccgtaagttccggg

SEQ ID NO: 114643 - DNA, 607 bp, Homo sapiens
  misc_feature: GYAE6OF02I44LR.15.86.H09.1.454.CMB.1.raw
  modified_base (477)..(477): a, c, t, g, unknown or other
  misc_feature (477)..(477): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaaggccgtgggggtcccttagagtctcctgtgtgcctctggattcacttcagtaatggctggatggagttgggtcccgcgaggctaccgagggaagggcgtggaggtgggttggacgtttacgaaaagtaaatgagtggtagaagaaatagacgtacggtgacgaccgtagaaaggagattacactatctacaagacgtataatacgaaaacgacggttataatttagataatagaacagacctagaaaacgngacacacgccgtactattactacgtaccatagacgttacggaaatcgacgagtacgaacggttaacgaggtcgttacgtagttactttagacgtttagtccggtaggggaccccaagggtacaggtacgg

SEQ ID NO: 114644 - DNA, 713 bp, Homo sapiens
  misc_feature: GYAE6OF02H9PGT.15.86.H09.1.454.CMB.1.raw
  modified_base (408)..(408): a, c, t, g, unknown or other
  misc_feature (408)..(408): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttaggtaaagccgtgggggtcccttagagtctcctgtgtggcctctggatctacttcagtaatggctggatgaggttcgggtccgccgaggctaccggaaggggacggggcgtgggtaggttggggttaggtacgtttaagaaaaacgttaaaagtgaagtggtagaaagaaagtagacgtacggngacgaccgtagaaaggagtatacgactatcacgaagtagtaataaacttacgaaaaacggtcggtattaacgttagaactaaacgtaggaaactacggtaccctaaaggaaaaaccgtcggaaccaacgacgtacccgttaattaacgttctaccgtacccgtaataggttacgttaacggaacgttacgaaccgttagtaaccggaaggttaaacggcggtccttaagttcgggttaacctttttgaacgtttccggtacccgggtcggggacccctaaagggggtacctagggtttcccgggg

SEQ ID NO: 114645 - DNA, 727 bp, Homo sapiens
  misc_feature: GYAE6OF02HYB5E.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatacttaaaaggtgtccagtgtgaagtgcgagggtggtggaggtcgtggggggagcctttggtaaaggccgttggggggtcccttaggacgtctccgtgtcgtggcctctggattcactttcagtaatggctggatggagttgggtccgcgaggcgtccgaaggggaaggggtctgggtaggtggggttcggacgttttacgaaaaaggttaaaagtggagtagggtagaaagaaaagtagaacgtacggtgaccgtaccgtaggaaaaggtaagacttacaacctatcgtacaaagagtaataaacttaacaaaaacggtacggttaagtaatttacggaacaaaattcggaaactacggtacctaaacggaaaaccggaacggaaccaacgaacgtccgttaacttaacgttacctacggttaaccaacgaacgtaacgttaccggaaagtcgaaccaagttaccggaaggttaaacgggacgtacgttaagttcggttactttacgtaagttacgttccggtaccggggaccctaagggtaccgtaagtccgggg

SEQ ID NO: 114646 - DNA, 605 bp, Homo sapiens
  misc_feature: GYAE6OF02JO6FM.15.86.H09.1.454.CMB.1.raw
  modified_base (471)..(471): a, c, t, g, unknown or other
  misc_feature (471)..(471): n is a, c, g, or t
  modified_base (524)..(524): a, c, t, g, unknown or other
  misc_feature (524)..(524): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagtccttggtaaagccgtgggggtcccttagagtctcctgtgtggcctcgtggacttcactttcgagtaatggctggatggagttggtcccgcaggctccgagggaacggggctgggagtgggtggacgtttacgaaaagtaaaagtgagtggtagaagaaagtacgacgtacggtgacgaccgtagaaggagattacacgatctacgaagatactaatacaaaaacgtcggtagttattagactaaatgaaacncgtacgtaagaaaccgtaggaccagacgtcgtacttaatacgtacgacctaanagtaattacggaatgacagtccggaagtaggaagtcctagtgtactttgaatgtaccggtcgggacctaggactcgtcggg

SEQ ID NO: 114647 - DNA, 762 bp, Homo sapiens
  misc_feature: GYAE6OF02J2CL7.15.86.H09.1.454.CMB.1.raw
tcagtctacgtagccacgaccggtgctcgatttagtgctatagacttgggtttggggggggagaggagccccagccttgggataaaccccaagtgttttcattcagtgatcaggactgaacacagaggactcaccatggagttcgggctgagctgggtttccttgctgctatcttaaaaggtgtccagtgtgaagtgcaggtggtggagtcgtggggagccgttggtaaagccgtgggggtcccttagagtctcctgtgtggcctgtggattcactttcagtaatggctggatgagttggtccgcgaggctccgagggaagggcgtggaggtgggtggtacgtttacgaaaagtaaaagtgagtaggtagaagaaaatagaacgtacggtgaccgtacccgtaggtaaaggaagtagttaccaccgtaattacctaacgaagaagtaattaaacttaacgtaaaaacggtacggtttattaaacgtttacgaactaaaagttacggaaaactaacggtaacccgtaaacggtaaaaacccggaacgggtaaccgaaaccgtaaccggtacccgtttaacgtttaaacgtttaaccgtaaccgttaacccgaaacgttaacggttaacgtttaccgggtaaacgtcggtaactaacggtaccggtaacggtaaagggtacggtacgttaagttcggttacgttttagaacgtttacggtaccggtaccggggtacccggtaagggtacccgtaggttaccggg

SEQ ID NO: 114648 - DNA, 664 bp, Homo sapiens
  misc_feature: GYAE6OF02I2H3Y.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtcgtccagtgtgaagtgcaggtggtggagtcgtgggggagccgttggtaaagccgtgggggtcccttagagtctcctgtgtggcctctggattcacgtttcagtaatggctggatgaggttggtccgcagctcgagggagggctggagtgggtggacgtttacgaaaagtaaaatgtagtaggtagaagtaaatagacgtacggtagaccaaccgtagaaaggagactcaacatcacaagagtataagtacgaaaacggtacgttagttaagttagacaaagtagaaaccgtgacccttaaggaaaaccgaggaaccacgacgtccgttacttaacttacctacgttaacccagtaacgtaacgttacgggaaacgttcggaacttaacgtccggtaacgggtaaacgggtcggtactttaagttcggtaccgtttttagactttagttcccgggtagggaccccggtagggtacttacgttcgggg

SEQ ID NO: 114649 - DNA, 673 bp, Homo sapiens
  misc_feature: GYAE6OF02JNOTJ.15.86.H09.1.454.CMB.1.raw
  modified_base (531)..(531): a, c, t, g, unknown or other
  misc_feature (531)..(531): n is a, c, g, or t
  modified_base (621)..(621): a, c, t, g, unknown or other
  misc_feature (621)..(621): n is a, c, g, or t
tcagtctacgtagccacgaccggtgctcgatttagtgctatagacttgggtttgggggggagaggagccccagccttgggatcccaagtgttttcattcagtgatcaggactgaacacagaggactcaccatggagttcgggctgagctgggttttccttgctgctatcttaaaggtgtccagtgtgaagtgcaggtggtggagtcgtgggggagccttggtaagccgtgggggtcctagagtctcctgtgtgcctctggattcacttttcagttaatggctggatggagttgggtccgcgaggctaccgaggggacggggctggaggttggggttggacgtttacaaaaaggtaaaatgagttaggtagaaggtaaaactaggacgttacggtagtaccgtaaccggtaggaaaaggtaacgtacgtttaccgaacctagttacctaacgaagtaacgtaattaacgtaaacgtaaaaacgtcggttagttaagtttagaactaaagtagaaacagacctaagaaaccgngaacgacacgccgtataacgttactagacctagaagtacgttacggaagtgacgtataccggagtaaacgggcgtacgtagttacggttntttacgaagtccggttaccggtacgggacccgaagggtactaacggttccgg

SEQ ID NO: 114650 - DNA, 700 bp, Homo sapiens
  misc_feature: GYAE6OF02HR8D0.15.86.H09.1.454.CMB.1.raw
  modified_base (305)..(305): a, c, t, g, unknown or other
  misc_feature (305)..(305): n is a, c, g, or t
tcagtctacgtagccacgaccggtgctcgatttagtgctatagacttgggtttggggggagaggagcccccagccttgggatccccaagtgttttcattcagtgatcaggactgaacacagaggactcaccatggagttcggctgagcgtggttttccgttgcgtgctatcttaaaaggtgtccagtgtgaagtgcaggtggtggaggtcgtgggggagccttaggtaaagcccgtgggggtcccttagagtcctcctgtgtggccttctggatcactttcagtaatggctggatgagtggtccncgagctcgaagggaggcgtggaggtgggttaggtacgtttaacgaaaaggttaaaaatgatgggtagaaagaaaatacgacgtaacggtgaccgtacccgtaggaaaaggaagaattaccaacattacaccgaagaagtattaaacttaacaaaaacggtacgttagttaagtttagactaaaaatacggaaactacggtaccctaaggaaaaacccgtagggaaccaaacgtacgacccgtacttaacgtttgacttaccgtaaccaccaagttagttaccggaagtacggaccttagtaccggtaacggttaaacgggcgggtaaccttaggtcttacggttttgtaaccttggttaacccggccggggtaaccgtacgggtaacgtaacggg

SEQ ID NO: 114651 - DNA, 608 bp, Homo sapiens
  misc_feature: GYAE6OF02GVKBZ.15.86.H09.1.454.CMB.1.raw
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
  modified_base (488)..(488): a, c, t, g, unknown or other
  misc_feature (488)..(488): n is a, c, g, or t
  modified_base (521)..(521): a, c, t, g, unknown or other
  misc_feature (521)..(521): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttggggggagaggagccccagccttgggatccccaagtgttttcattcacgtgatcaggactgaacacagaggactcaccatggagttcgggctgagctgggttttccttgctgctatcttaaaaggtgtccagtcgtgaagtgcaggtggtggagtcgtggggnccgttggtaaagccgtgggggtcccttagagtctcctgtgtggcctgtggattcactttcagttaatggctaggatggagttgggtccgcnggctccgagggaagggctggagtgggttggtacgtttacgaaaagtaaatgagtggtagaagaaatagactacggtgaccaccggtagaaaggagattacgactatcacgaagacgtaataacgtaacaaaacggtcggtagttaattgaactaaagtcgaaacagaccttaggaaaaccnggaacacgagtccgtatacttacgtgtaaccanagtacgttacgaagtncgtagtacgacgaaggagtcgtaagttgtactttagatacgttcggaccgggccctaaggacgtgtaccgg

SEQ ID NO: 114652 - DNA, 737 bp, Homo sapiens
  misc_feature: GYAE6OF02IR06A.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttggtaaagccgtgggggtccttagagtctcctgtgtcggcctctggatctactttcagtaatggctggatgaggttgggtccgccaggctccgaggggaagggggctggggaggtggggttcggacggttttaacgaaaaaggttaaaatgagttgggtagaagaaaagtagaacgttacggtagaccgaacccggtaggaaaaggaagtacgttaccaacctaatcctacgaaagtagaaattaaacgttaacaaaaaacggtacggttagttaactttggactaaaagtagaaaccagtacccgtaaggaaaaacccggaggaaacccgaactaccggtacccgttaccttaagttaaccttacgtaacccaacgtaggtaatttacgggaagtcggtaactagttaccggaacggttaaacgggaggtaccttaattacggtaccgtttttagaacgtttaacgtccgggttaccgggggaccccgtaacggggtacctaaggttcccggg

SEQ ID NO: 114653 - DNA, 596 bp, Homo sapiens
  misc_feature: GYAE6OF02JZIWY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtccttagagtctcctgtgtggcctctggattcactttcagtaatggctggatgagttgggtccgcaggctccgagggaaggggctggagtgggttggacgttacgaaaagtaaaatgataggtagagaaaatagactacggtgacaccggtagaacggaagattcacactctacaagagaataactacaaaaacgacggttagtaacttagactaaatgaaacagactagaaaccgagaacacagccgtacattactagacctacacgtattcggaagtgactatcggacgtaaaggacggacttaagtggtcttttagaagttcgttacggcgggtacccgaagggtaccaagttccggg

SEQ ID NO: 114654 - DNA, 606 bp, Homo sapiens
  misc_feature: GYAE6OF02GW7I5.15.86.H09.1.454.CMB.1.raw
  modified_base (520)..(520): a, c, t, g, unknown or other
  misc_feature (520)..(520): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
tcagtctacgtagccacgaccggtgctcgatttagtgctatagacttgggtttggggggagaggagcccccagccttgggatccccaagtgtttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaaggggcgtggaggtgggttggacgtttacgaaaagtaaaatgatggtagaagaaaatagacgtacggtcgcgaccgtagaaaggaagattacacatactacgaagagtaataacttaacaaaaacggtacggtagttatttgaacaaatagaacagacctaagaaaaccgaggaaccacacgccgtactattactgtaccanacgtattacgaagtnacanacgtacgtaaggagtctattgtcttttagacttacgtcggtaccgggacccgagggtacaggttcgg

SEQ ID NO: 114655 - DNA, 739 bp, Homo sapiens
  misc_feature: GYAE6OF02F3LZT.15.86.H09.1.454.CMB.1.raw
  modified_base (331)..(331): a, c, t, g, unknown or other
  misc_feature (331)..(331): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtgggggtcccttagagtctcctgtgtggcctctggattcactttcagtaatggctggatgtagttgggtccgccaggctccgagggaacggggctagggnggtgggttggtacggtttacgaaaaagtaaaatgatgggtagaaagtaaaatagaacgtaggtgaccaacccggtaggaaaaggaagactttaccaacctatacctacaagagtaactaattaaccaaaaacggtacggttagttaacttttaggaactaaaagtacggtaaacaacgtacccttaaggaaaaacccgacggaaccaaccgtacgacccgtttacctaagtttaaccgtacgttaacccgaacgtaacgtaacgtttacgggtaaagttcggtacctaaggtaccgtaacggtaaagggacggtaccttaagttacggtaccgttttttaggaaacgtttcggtttacccgggtaccggggtaacccccgtaaggggtaacccttaaggtttccgggg

SEQ ID NO: 114656 - DNA, 644 bp, Homo sapiens
  misc_feature: GYAE6OF02FNWVE.15.86.H09.1.454.CMB.1.raw
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (362)..(362): a, c, t, g, unknown or other
  misc_feature (362)..(362): n is a, c, g, or t
  modified_base (438)..(438): a, c, t, g, unknown or other
  misc_feature (438)..(438): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaaagccgtgggggtcccttagagtctcctgtgtggcctctggacttcactttcagtatggntggatggtaggttgggtccncgagcgtccgaggggagggctgggagtgggttgtacgttagaaaagtaaaangtaagtggagaagtaaataggactacggagacgacccggtaggaaaggaagtacttacaccgtatcgtacaagtanaattaataacgaaaaacggtgttagttatttagaactaaagtacgaaacagtacctaaaggaaaccgacgacacgacggtcctacttaattacctagtaacccaacgtagtagttacggaagtcgaaccgtacgtacgacgggtaaaggcggtactagttcgtatttagacgttagtccggtcggtaccgaagggactaggttcgg

SEQ ID NO: 114657 - DNA, 769 bp, Homo sapiens
  misc_feature: GYAE6OF02HJGZ5.15.86.H09.1.454.CMB.1.raw
  modified_base (301)..(301): a, c, t, g, unknown or other
  misc_feature (301)..(301): n is a, c, g, or t
  modified_base (457)..(457): a, c, t, g, unknown or other
  misc_feature (457)..(457): n is a, c, g, or t
  modified_base (679)..(679): a, c, t, g, unknown or other
  misc_feature (679)..(679): n is a, c, g, or t
tcagtctacgtagccacgaccggtgctcgatttagtgctatagacttgggtttggggggaggaggaggccccagccttgggagtccccaacgtgttttcattcagtgatcaggactgaacacagaggactcaccatggagttcgggctgagctgggttttccttgctgctatctaaaggtgtccagtgtgaagtgcgaggtggtggagtcgtgggggagccgttggtaagccgtagggggtcccttagaggtctcctgtgtcggcctcgtggattcacgtttcagtaatggctggagtagngttggtacgccgagggctaccgagggagggctgggagttgggtcgtacgttacgaaaagtaaaaagtgaattgggaggtaagtaaaagtaggaacgtacggtagaccgtaaccgtaggaaaacggtaagacttaaccgacctaacttaccgtaaanaacggaataaacgtaaattaaccgaaaaacggttacggtaagtttaatacgaataaaagtacggaaacctaagaccctaaagggaaaaaccgaacgggaaccaagaacgacccgtaacttaaacgtttaccgaaccggttaaccaacccgttaaggtaaaccgtttaccggaaaaggttactaaccggtaactaaccgggtaaacgtaaacgggggtttaanacccggtttaagtaccggttacgtttttaagacgtttaagtttccggaaacggggggaccccgtaaagggtacccgtaaggtttccgggg

SEQ ID NO: 114658 - DNA, 665 bp, Homo sapiens
  misc_feature: GYAE6OF02H7ANL.15.86.H09.1.454.CMB.1.raw
  modified_base (262)..(262): a, c, t, g, unknown or other
  misc_feature (262)..(262): n is a, c, g, or t
  modified_base (380)..(380): a, c, t, g, unknown or other
  misc_feature (380)..(380): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtggggagccgttggtaaagccgtgggggtccttagagtctctgtgtgctctggnttcacttcagtaatggctggatgagttggccgcgagctcgagggagggctggcggtgggtgacgtttacaaagtaaatgatgagaagaatagactacggtacaccacgtagaaagganactcactactacacgaagagtaataacgtaacgaaaacgtacggtagttagttagaactaaagtacgaaacgtacgtaacccgtaaacggaaaaccggaacggtaacaaccgtaacgacccgttaattacgttaaccgtaccgttacaacgtacgtaacgttacggaagtacgactaacgtacggtaacggtaaacgggtacgtacgttaggttcgttaacgtttttaagagttacggttcggtaccggggttacccggaaaggttacccggtaacgtttcgggg

SEQ ID NO: 114659 - DNA, 783 bp, Homo sapiens
  misc_feature: GYAE6OF02G6998.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttagggtaaacggccgtgggggtcccttagacgtctcctgtgtcggcctcgtggtacttctacttcagtaagtggcgtggatggtaggttcgggcccgccgaggcctccggaaggggaacggggtcgtgggtaggtgggttaggtaacgtttaacgaaaaaggtaaaagtgaagtaggtagaaaggaaaataacggtaacgtaacggtacgaccgtaaccggtaaggaaaggaacgtaacggttaccaacctatacctaacgaaagaacgtaattaaacgttaaaccgaaaaacgttcgggttaagtttaacgtttagaaccgtaaaagttacgaaacgtaaccgtaccgtaaacggaaaacccggaagaaccaaccgtacgtaacccgttacttaacttaaccgttccgaaaccctaagtaacggttacgttaaccgggtaaacgtcaccgtaacgtaccggtaacggtaaggaccggtacgttagttacggtttaccgttttaacgagtttaccggttacgggtaccgggtacccgaagggttacctacggtttcggg

SEQ ID NO: 114660 - DNA, 584 bp, Homo sapiens
  misc_feature: GYAE6OF02H7DJV.15.86.H09.1.454.CMB.1.raw
  modified_base (186)..(186): a, c, t, g, unknown or other
  misc_feature (186)..(186): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtntgcagtctgtccttgctgggacgcctcgatcaagctcacctgaccaaccctaagtagtgagcactacgaacctacaccatcgaatggtactcaacagagaccagggaaccgtccccagtaataataatacgaaagttaagagtgatggcagccacgacggaaggggcggactcccgatcgctacagtggctacgngttcgcggtctcgaccgctaccncacctatcctaccgaacctcgacgtctgaacgtacgtcggtacgtcgtagtacgttacaccgtagtggtaggagacggtcaccgaactatagtactagcggacgtaacggtagggtgggtacgttcgggacgggtacgtaccgagtccggtccgtaccgttaccgtacgtcgtaacccgg

SEQ ID NO: 114661 - DNA, 612 bp, Homo sapiens
  misc_feature: GYAE6OF02FHA5J.15.86.H09.1.454.CMB.1.raw
  modified_base (343)..(343): a, c, t, g, unknown or other
  misc_feature (343)..(343): n is a, c, g, or t
  modified_base (482)..(482): a, c, t, g, unknown or other
  misc_feature (482)..(482): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgtagttgggtccgccaggctccgagggaaggggctggagtgggttgacgtttanaaaagtaaaatgtagtggtagaagaaaataggaactacggtgacgacccggtagaaaagggaagatacaccatcacaagagaataattacgaaaaacgcggtagtatttagactaaatgaaacagacctagaaaaccgngaccagacgcctactaattacgacgtaccagagtacgttacggaatcgacagtaccgaggtaaaggcgggtatacgtagtcctttttagaattacgtccggtacggggcccaaggggacctaaggttcgg

SEQ ID NO: 114662 - DNA, 680 bp, Homo sapiens
  misc_feature: GYAE6OF02FYM5H.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaaggccgtggggggtcccttagagtctcctgtgtggctctggattcactttcagtaatggctggatgtaggttgggtcccgccaggctccgaggggaaggggctgggaggttggggttaggtacgtttacaaaaagtaaaagtgaagtgggtagaagaaaagttagacgtacggtgaccacccggtagaaaggaagtagttacactatcacaaagagataaattacgaaaaacgtcgttaggttaatttagaacaaatacgaaacacggacctaacggaaaaccgtagacaacgacgtaccgttactaacttacgtacttacccaacgtaaggtagttaccggaaagtcgacaacgttaccggaagttaaagggacggtaaccttaaggttcggttaactttttacggattaccggtcgtccggggggaccctaaggggtaacctaaggttccggg

SEQ ID NO: 114663 - DNA, 678 bp, Homo sapiens
  misc_feature: GYAE6OF02JUIUY.15.86.H09.1.454.CMB.1.raw
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
  modified_base (621)..(621): a, c, t, g, unknown or other
  misc_feature (621)..(621): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaaagccgtgggggtcccttagaggtctccgtgtgtggcctcgtggtattcgactttcagtaatggctggatgagttgggtccgcgaggctccgagggaaggggctggaggtgggttggacgtttacgaaaagtaaaatggatggtanaagaaaatgaactacggtgaccgtaccggtaggaaaggagtacttacaaccgntactactaaaggagtactaaacgttaacgaaaaaccggtacggttagtaacgtttgaaaccgtaaagtacgaaaacgtcgaacccttaaggaaaacccggagaactacgaacgtcccgttatacgtttaacgcgtaacccgactagtacccgtttagaagtacgactaaggtccgacggtaaaggtacggacttaacgnggttactttacgaatttacggtccggtacgggacccctaaggggtacacgtttcggg

SEQ ID NO: 114664 - DNA, 663 bp, Homo sapiens
  misc_feature: GYAE6OF02GSPJS.15.86.H09.1.454.CMB.1.raw
  modified_base (568)..(568): a, c, t, g, unknown or other
  misc_feature (568)..(568): n is a, c, g, or t
tcagtctacgtagccacgaccggtgctcgatttagtgctatagacttgggtttggggggagaggagccccagccttgggatcccccaagtgtttttcattcagtgatcaggactgaacacagaggactcaccatggagttcgggctgagctgggttttccttgctgctatacttaaaggtgtccagtgtgaagtgcaggtggtggagtcgtgggggagccttaggtaaagccgtgggggtcccttagagtctctgtgtcggcctctgatctactttcagtaatggctggatgtaggttcgggtcccgcgaggcctccggaaggggagggcgtggtaggtggggttaggtacgtttaacgaaaagtaaaagtgagtggtagaagaaaagtagaacgtacggtacgaccgaacccggtaggaaaacgggtaagtaactaccgaacctatactacgaaagtacgtaataactaacgaaaacggtacggttaagttaagtttacgactaaagtagaaactacgactaacggaaaaccgacggacacgtacgcctactatactacgtaaccanaagtacgttacggaagtcactacgtacgaacgtaaggacgtactattacgtgtttagtatacggttcggaccgggacccgagggtactagtcggg

SEQ ID NO: 114665 - DNA, 604 bp, Homo sapiens
  misc_feature: GYAE6OF02HD3Q3.15.86.H09.1.454.CMB.1.raw
  modified_base (547)..(547): a, c, t, g, unknown or other
  misc_feature (547)..(547): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaggggctgggagtgggttggacgtttacgaaaagtaaatgatggtagagaaaatagactacggtgacgaccgtagaaaggagaacttcaccatctacaagagataatacaaaacgtggtgtattgacaagtagaacagacctagaaaccgaggacacgacgcccgtattaacttacgtacgtaacccagtaacgtagttacgggtaagtcgactacgacggtacgtaaaggnggtacttagtgtctttagacttacgttcggtacgggcccaagggacctaaggtccgg

SEQ ID NO: 114666 - DNA, 661 bp, Homo sapiens
  misc_feature: GYAE6OF02IYUZQ.15.86.H09.1.454.CMB.1.raw
  modified_base (551)..(551): a, c, t, g, unknown or other
  misc_feature (551)..(551): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggtccgcaggctccgagggaaggggctggaggtggggttggacgtttacgaaaagtaaaaatgagtggtagaagaaaatagacgtacggtgacacccggtagaaaggaagtactacgaaccatactacaaacggataataaattaaccgaaaaaacgtcgggttaagttatttagactaaaagtgaaacagtaccctaaggaaaaacccgaggaaccaacgacggtacctacgttaacttactacggtaacccaanaaggtacttaccgggaagtcgactaagtacgaacgtaaagggacgtacttagtgttacgttttagagttacgtacggttaccgggacccgtaagggtactaagttcgggg

SEQ ID NO: 114667 - DNA, 664 bp, Homo sapiens
  misc_feature: GYAE6OF02FU6WF.15.86.H09.1.454.CMB.1.raw
  modified_base (381)..(381): a, c, t, g, unknown or other
  misc_feature (381)..(381): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcacttcagtaatggctggatgagttggtccgcaggctccgagggaaggggctgggaggtgggtggacgtttacgaaaagtaaaatgagtggtagaagaaatgactacggtnacgaccgtagaaaggagtacttacacctagtctacgaagagaataattaacgaaaacggtcggtagttatttaggactaaatggaaacacggacccgttaaggaaaacccggaggaacctaacgacggtacccgtacttaactttaacctacgtaaccctacgtaaggtaacttcggggtaaactgaccgtagtacgtaacgggtaaagggtacggcttaagttacgttacgttttaggacttacgtcgggttccggggaccctagggacctaggttaccggg

SEQ ID NO: 114668 - DNA, 615 bp, Homo sapiens
  misc_feature: GYAE6OF02IL21A.15.86.H09.1.454.CMB.1.raw
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcaggctccgagggaaggggctgggaggtgggttggacgtttacaaaagtaaaatgagtggtagaagaaatagactacggtgacgaccgtagaaagganattcacatctanaaagagtaataattacgaaaaacgtggtagtatttgactaaatgaacagacctagaaaacgagaacacgagccgttatattacgacgtaaccacgtagtacgttacggaagtcgacagtaccgaacggtaaaggacggacttaagcgttacgttttagaacttacgtcggtacggggacccaaggggtacctaagttccggg

SEQ ID NO: 114669 - DNA, 630 bp, Homo sapiens
  misc_feature: GYAE6OF02HEJM9.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgaggttgggtcccgccaggctccgaggggaaggggctgggaggtgggttggtacgtttacgaaaagtaaaatgaagtggtagaagaaaatagactacggtgccaccgtagaaaggagatccacatctacaagagaataataacaaaaacgtggtagttatttagactaaatagaaacagaccctaaggaaaaccgaggaacacacgtaccgttacttaacttacgtacgtaaccacgtaagacgttacggaagtgacagtacggaacggtaaaggcggtactagtcgttcgttttagaattcgttacggccggggacccggaagggtacctaggttcgg

SEQ ID NO: 114670 - DNA, 649 bp, Homo sapiens
  misc_feature: GYAE6OF02HTU3Y.15.86.H09.1.454.CMB.1.raw
  modified_base (277)..(277): a, c, t, g, unknown or other
  misc_feature (277)..(277): n is a, c, g, or t
  modified_base (517)..(517): a, c, t, g, unknown or other
  misc_feature (517)..(517): n is a, c, g, or t
  modified_base (534)..(534): a, c, t, g, unknown or other
  misc_feature (534)..(534): n is a, c, g, or t
  modified_base (549)..(549): a, c, t, g, unknown or other
  misc_feature (549)..(549): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttnagtaatggctggatgagttgggccgccgaggctccgagggaaggggctgggaggtggggttggacgtttacgaaaaagtaaaaagtgaagtaggtagaaagtaaaagtaggaactacggtcacgacccgtaggaaaacggagtaacttacgaaccatctaacaagagtaattaaataacgaaaaaacggtcggttaagtaactttagactaaagtagaaactacgacctaagaaaaccgngaacaacagtccgttanagttacagtaaccanagtacgtacgaagtcactagtacggacgtaaagggacgtctaagttcgtagttttagacgttagtaccggtcgggacccgtaaagggtactaaggttcgg

SEQ ID NO: 114671 - DNA, 720 bp, Homo sapiens
  misc_feature: GYAE6OF02HR5FO.15.86.H09.1.454.CMB.1.raw
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (327)..(327): a, c, t, g, unknown or other
  misc_feature (327)..(327): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctggagctgggtttttccttgctgctatcttaaaaggtgtccagtgtgaagtgcaggtggtggagtcgtggggagtccttaggtaaagccgttgggggtcctagagtcctcgtgtgtggcctntggtattcactttnagtaatggctggntgngttcggtcgccgnggctcgaggggaggctggngtgggttggtacgtttacgaaaagtaaaagtgacgtggtagtaaagaaagtacgtaacgtacggtagtaccgacccggtaaggtaaaggaacgagttaccgaacctattacgtaccgaaagtaacgtaattaagtaaccgaaaaacggtccggttaagttagttacgactaaagtacgtaactacggtaaccgtaacggaaaaccgtacgggaccaaaccggtcgtaccgtaaccgttaactttaacggtaccgtaaccgacgaacggttaactcgggtaaacgtgaacgtacttaaccggacgggttaaaggacgtaacgtcgttacgttagttttacggtattaggttcccggttaccgggaaccggtacgggtacttacggtttaccggg

SEQ ID NO: 114672 - DNA, 751 bp, Homo sapiens
  misc_feature: GYAE6OF02GQVU5.15.86.H09.1.454.CMB.1.raw
tcagtctacgtagccacgaccggtgctcgatttagtgctatagacttgggtttggggggagaggagccccagccttgggatcccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggtattctactttcaagtaatggctggatggtaggttcgggtcccgccgaggcctccgaggggaaggggcgtgggaggtgggttggtacgtttacgaaaaagtaaaagtgtagtaggtagaagtaaaaagtagtaacgtacggtacgaccgtaacccggtaaggaaaaagggtaagtaacttaccgaacctaagttaccctaacgaaaggaagtaaacttaaacgtttaacgaaaaaacggtcgggttaagttaagtttacgaacctaaaagtacgaaacacgtacccgtaaacggaaaaccggaggaaccaacgacgtacccgttacttaacttaccgtacgtaaacccagtaacgtaacgttacgggaaagttccgaacgtagtaaccggtaaacggtaaaggacggtactaagttcggtttacttttaggaatttacggtccgggtacccggggaacccgtaagggtacctaagggttccggg

SEQ ID NO: 114673 - DNA, 790 bp, Homo sapiens
  misc_feature: GYAE6OF02IBUK5.15.86.H09.1.454.CMB.1.raw
tcagtctacgtagccacgaccggtgctcgatttagtgctatagacttgggtttgggggggagggaggagccccagccttgggatccccaagtgttttcattcagtgatcaggactagaacacagaggactcgaccatcggagttcgggctgagctgggtttccttgctgctatacgttaaaggtgtccagtgtgaagtgcgaggtgtggacgtccgtgggggagccgttagggtaacggcccgtgggggtcccttaggacgtctctgtgttggtccgtagtggattcgtacttttacgaagttaagtggtacgtggtaagtcgtaggttcgggtcccgaccgtaggctaccggaaggggtaacgggcgttagggtaccggttgggttacggtacgtttacgaaaaagttaaaaagtagaagttggtaagaagaaatacggtaacgtaaccggtcgaaccgtacccggtaaggaaaacgtaacgtacttaccgaccgtaacttacgtaacgaagacgtaaactaaacgttaaccgaaaaaccggtcggttacgttaattacgtaacgtaaaaggttacggaaaccgtacggtaaccgtaaacggaaaacccggtaggtaacgactaacggtacctaccgttaatttaaccgtacggtaaccgacgtaagaccgttttaacgggagtcaccgttaagtccggtaaacggttaaggtcgaacgttagttcgggtacttttagacgtttacggtccgggttaccgggacccggtaagggacctaggttcccggg

SEQ ID NO: 114674 - DNA, 847 bp, Homo sapiens
  misc_feature: GYAE6OF02HBOGO.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagtccgttaggtaaagcgtagggtcgggggttaccttaggacgtcctccgtggtcggtcggtcctcgtggtacttacctactttacgaagttaagtcggtacgtaggtagttggttacggttccggggtcccgaccggtacggtcccgtaccggggaaggggggaacggggtcggtaggggtacggggttgggggttaacggttaaccggtttaaacgtaaaaaaaggttaaaagtggtaaggttaggtaagaaaagtaaaagtacggtaacgtacgggtacgaccgtaaccggtaaggaaaggtagtacttaccaactacgtactaacgaagaagtaaacttaaacgtaaaaccgtaaaacggtaggtttaagttacgttaacgaaactaaagtaaccgtaaacgacgtaaccgtaaaaggaaaaccggacgtaaaccacgtaaccgtaccgttaacttaacgtttaaccgaccgtaaaccgtaacgttaaagtaacggtttaacgggaaagtacgacctaacggttacgggtaaacggtaaacgggcgttaacttaaggttcggtttaacgttttagaactttaccgggtaccgggtacccggggtaaacggtacggtaacgttacgg

SEQ ID NO: 114675 - DNA, 727 bp, Homo sapiens
  misc_feature: GYAE6OF02FSY9F.15.86.H09.1.454.CMB.1.raw
tcagtctacgtagccacgaccggtgctcgatttagtgctatagacttgggtttgggggggagaggagccccagccttgggatcccccaagtgttttcattcagtgatcaggactgaacacagaggactcaccatggagttcgggctgagctgggttttccttgctgctatcttaaaaggtgtccagtgtgaagtgcaggtggtggagtcgtggggagccttaggtaaagccgtgggggtcccttagagtctcctgtgtggcctctggattctactttcagtaatggctggatgtagttgggtcccgccgaggtcctccgaaggggaaggggcgtgggaggttggggttggtaacgtttaacgaaaaaaggttaaaaagtgtaagttagggtagaaaggaaaaagtacgtaacgtaacggtcgaccgtaaccccggtaaggaaaagggtaagtaacttaccaaccaatcctacgaaaagagaaattaaacttaaccgaaaaaacggtacgggttagttaactttgaaactaaagttacgaaacaacgactaacgaaaacccgaggaaccacgacgccgttataacttaactaactaaccctaagaacgtacgtttacgggaaacgtgacctaagttaccgaacgtaaaggacggtactaagttcgttacgttttagaagttacgttccggtaaccggggaccccgtaagggtaacctaaggttccggg

SEQ ID NO: 114676 - DNA, 663 bp, Homo sapiens
  misc_feature: GYAE6OF02IBCD3.15.86.H09.1.454.CMB.1.raw
  modified_base (612)..(612): a, c, t, g, unknown or other
  misc_feature (612)..(612): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagccgtgggggtccttagagtctcctgtgtggcctctggattcacttttcagttaatggctggatggaggttgggtcccgccgaggcctaccggaaggggaacggggcgtggggaggttggggttggtacgttttacgaaaaaggttaaaaagtgaagtgggtagaagaaaagtagaacgtacggtagacaccggtagaaaggaagactacgaccatctacgaagagtaattaactaacgaaaaacggtacggttagtttaatttagaactaaagtacgaaacagtacctaacggaaaacccgaggaacacgaacgtccgtaacttagtttacctacgtaccaacgtagtaagttacggaagtgacctaagtacgaacggtaaaggnggtacttagtgtacttttagattcgtcggtcgggaccgaggtactagtcgg

SEQ ID NO: 114677 - DNA, 572 bp, Homo sapiens
  misc_feature: GYAE6OF02IMBK8.15.86.H09.1.454.CMB.1.raw
  modified_base (493)..(493): a, c, t, g, unknown or other
  misc_feature (493)..(493): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgcttgctatcttaaaaggtgtccagtgtgaagtgcaggtggtggagtctgggggagccttggtaaagcctgggggtccttagagtctcctgtgtggcctctggattcactttcagtaatggctggatgagttgggccgccaggctccgagggaaggggctgggagtgggttggacgtttacaaaagtaaaatgatggtagaagaaatagactacggtgcaccgtgaaaggagattacacatctacaagagataattacaaaaacgacggtagtaatttgactaaagtgaacagctagaaaccgagacacagccgtatactactagtaccanagattacgaagtacagtacgaacgtaaggaggactagtgtacttttgattagtcgtcgggacccagggacagtggtccg

SEQ ID NO: 114678 - DNA, 759 bp, Homo sapiens
  misc_feature: GYAE6OF02IQRF5.15.86.H09.1.454.CMB.1.raw
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagtccgttggtaaagccgtgggggtcccttagagtctctgtgtcgcctcgtggattcacttcagtatggctggatgngttggccgcgaggctccgagggagggctggngtgggttgacgtttaanaaaagtaaaatgtagtacggtagaagtaaaatagaacgtacggtagaccgaaccggtagaaaaggaagtactacaaccagtaccgtacaaagtagaattaaacgttaacgaaaacggttaggtaggttaatttacggactaaaacgtacggaaactaaccggtaaccgtaacggtaaaaaccggtacggaaaccaccgaaccgggtacccttaacgtttaacctttaaccgacgtttaaaccccgaacgttaaacggtacgtttaaccgggtaaacggtctaaccgtaacggttaacccgggaacgggttaaaagggtaccggtaaacgtttccggtaatttaccggtttttaaggacctttaacgggttcccggggtaaccggtacccgggtaaagggtacccgttaaggttaccgggg

SEQ ID NO: 114679 - DNA, 713 bp, Homo sapiens
  misc_feature: GYAE6OF02HUR6A.15.86.H09.1.454.CMB.1.raw
  modified_base (315)..(315): a, c, t, g, unknown or other
  misc_feature (315)..(315): n is a, c, g, or t
  modified_base (583)..(583): a, c, t, g, unknown or other
  misc_feature (583)..(583): n is a, c, g, or t
tcagtctacgtagccacgaccggtgctcgatttagtgctatagacttgggtttggggggggagaggagccccagccttgggatccccaagtgttttcattcagtgatcaggactgaacacagaggacctcaccatggagttcgggctgagctgggttttccttgctgctatcttaaaaggtgtccagtgtgaagtgcaggtggtggagtcgtgggggagccgttaggtaaagccgttgggggtcccttaggacgtctcctgtcgtggcctctggtattcactttcagtaatggctggatgaggttggtcccgcgnggctccgaggggagggcgtgggaggtgggttaggtaccgttagaaaaaggtaaaatgaagtggaggaagaaaagtagtaacgtacggtcgtaccgacccgtaggaaacggaagtaacgttaccactactactacgaagtaagtattaaacgttaaacgaaaaaccggtcggttaagtaatttacgaataaaatacggaacaggaacctaaaggaaaacccggaggtaacccaagaccgtcccgtaacttacgttaccgtacgtaaccncgtaagtacgttacgtaaggtacacgtaacgtaccggaaggtaaacggcggtaacgttacgttcggtacttttaaggactttacgggtccggttacggggaacccctaaggggtaccgtaaggttccggg

SEQ ID NO: 114680 - DNA, 603 bp, Homo sapiens
  misc_feature: GYAE6OF02FH6M8.15.86.H09.1.454.CMB.1.raw
  modified_base (561)..(561): a, c, t, g, unknown or other
  misc_feature (561)..(561): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccccttagagtctcctgtgtggcctctggattcactttcagtaatggctggatgagttgggtccgccgaggctccgaggggaagggcgtggagtgggttggacgtttacaaaagtaaaatgatggtagaagaaaatagaactacggtagacaccggtagaaaggaagattacaaccatctacaagagaataatacaaaacgtacggtagtatttgacaaatcgaacagcctaagaaaaccgagaacacgacgccgtactattactacgtaccacagtattacggaagtgacagtacgacgtaaaggaggtacttagtacggttnttttagattacgttccggtgggaccctagggacctaagtcgg

SEQ ID NO: 114681 - DNA, 601 bp, Homo sapiens
  misc_feature: GYAE6OF02JCZZ4.15.86.H09.1.454.CMB.1.raw
  modified_base (435)..(435): a, c, t, g, unknown or other
  misc_feature (435)..(435): n is a, c, g, or t
  modified_base (472)..(472): a, c, t, g, unknown or other
  misc_feature (472)..(472): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaatccgtgggggtcccttagagtctcctgtgtggcctctggattcactttcagtaatggctggatgagttgggtccgcaggcctccgaggggaggggctgggagtgggttaggacgtttacgaaaagtaaaatgaagtggtagaagtaaaatagacgtacggtgcaccggtagaaagagtattcacatctacaagagataatacaaaacgngtatatttgataaatgaactacgcctaggaaaaccgnggacacgagccgtatacttactacgtaccaacgagtagttacgggaatcgacagtacgaacgtaaggaggtacttagtgttacttttagaattacgtcgggtaccgggccctaagggactaagttcggg

SEQ ID NO: 114682 - DNA, 738 bp, Homo sapiens
  misc_feature: GYAE6OF02GFMX9.15.86.H09.1.454.CMB.1.raw
  modified_base (390)..(390): a, c, t, g, unknown or other
  misc_feature (390)..(390): n is a, c, g, or t
tcagtctacgtagccacgaccggtgctcgatttagtgctatagacttgggtttgggaggagaggagccccagccttgggatccccaagtgttttcattcagtgatcaggactgaacacagaggactcaccatggagttcggctgagctgggttttccttgctgctatcttaaagtgtccagtgtgaagtgcaggtggtggagtcgtgggggagccgttaggtaaacgccgtggggggtcccttaggacgttctcctggtgtggcctcgtggtattcactttcagtatggctggatgagttggtccgccagctccgaggggagggcgtggtaggtgggttggacgtttacgaaaagtaaatgagtggagaagtaaagtaggactacggganaccgtacccggtaaggaaaaggaacgtacttaccgaacctacgtactacgaaacgaagtaaacgttaaattaaacccgaaaaaacggtaccgggttagtttaagtttacgaacgtaaattagaaaccgtacgaccgtaaacgaaaacccggtaaggaaccgaacgtaccggtaccgttaccttaatttaacccgtacgttaaaccccagtaacggttaacgtttaccgggtaaagtcgtacgtaaccgtaccgaaacgggtaaaggtacggtacgttaacgttacgttacgtttttaaggatttaccggtccggggttacggaccccggttaagggacgttaaccggg

SEQ ID NO: 114683 - DNA, 672 bp, Homo sapiens
  misc_feature: GYAE6OF02GZ7A8.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaggtgtccagtgtgaagtgcaggtggtggagtcgtgggggagtccgttggtaaacgccgtgggggtcccttagagtctcctgtgtcggcctcgtggattcactttcagtaagtggtctggatggaggttcgggtcccgtccgaggctccggaggggaagggcgtggaggtgggttggacgtttacaaaagtaaatgagtggtagaagaaaatagacgtacggtgaccgtaccgtagaaaggagtacttaccgactatcacaagagtaataacaaccgaaaaacggtcggtagttagttaggaactaaagtacgaaacgacgtaccgtaacggaaaaccgaggaacaccgacgtacccgtacttaacttacgtacgtaccacgtagtacgttacgggaagttcgaacctacgtaccggtaacggtaaggacggtacttaagttgttacgtttagagttacgtcggttaccggggacccgtaagggtaccgtaggttccggg

SEQ ID NO: 114684 - DNA, 784 bp, Homo sapiens
  misc_feature: GYAE6OF02GGX9I.15.86.H09.1.454.CMB.1.raw
  modified_base (645)..(645): a, c, t, g, unknown or other
  misc_feature (645)..(645): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtgggggagccgttggtaaagccgtgggggtccttaggagtctcctgtgtggcctcgtggattctactttcaagttaatcggcttggattggtaggttcgggtccgccgaaggtctaccggaggggaaggggtccgtaggggtaggttcggggttagggtaaccggttttaacgaaaaaacggtttaaaaagtggtaaagttggggttaagtaaaaggtaaaaacgttaggtaaccgttaacgggttacgacccgtaaaccccggttaagggaaaaagggtaacgtaacgtttaccgaaccctaagttacctaacggtaaaggaagtaattaaacgtaaaccgtaaaaaacggtcggttaagttaacgtttagaactaaaagtacgaaacacgtaccgtaagaaaaccgaggaaccacgaacgccgtatacttaacgntaccagtacgtaacgttacggaagtcgataacgtaccgtaacggtaacggggataccggttagttacgttcgttttaacggacttacggttacccgggtaccggggtaccccgtaagggtaccctaagggttacccggg

SEQ ID NO: 114685 - DNA, 653 bp, Homo sapiens
  misc_feature: GYAE6OF02IVK70.15.86.H09.1.454.CMB.1.raw
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
tcagtctacgtagccacgaccggtgctcgatttagtgctatagacttgggtttggggggagagggagccccagccttgggatccccaagtgttttcattcagtgatcaggactgaacacagaggactcaccatggagttcgggctgagctggttttccttgctgctatcttaaaagtgtccagtgtgaagtgcaggtggtggagtctgggggagccgttggtaaagcgtgggggtcccttaggtagtctccgtgtgtggcctcgtggattcactttcagtaactggctggatgagttggcgccgaggctccgaggaggggctggagtgggtgacgtttacaaaaggtaaatagatggtagaacgaaagtagactacggtnacaccgtagaagganattacgacatctacganaagatagtaacaaaagacggtagttacttagacaaatggaaactagaccgtaagaaaccggagaacaacgactaccgtataacgttacttacgacctacaagacgtttaacggatacgtaacgacgtaccggtaacggaaaggtacggtccttaagttcggttaaaccgttttttgaaacgtttcggttaccgttaccggggtaaccccgtaaaggggttacccctaaaggtttcccgggg

SEQ ID NO: 114686 - DNA, 600 bp, Homo sapiens
  misc_feature: GYAE6OF02II3EL.15.86.H09.1.454.CMB.1.raw
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (487)..(487): a, c, t, g, unknown or other
  misc_feature (487)..(487): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccaggctccagggaggggctggagtgggtggacgtttcaaaagtaaaatgatggtagagaaaatagactacggtgcaccgtagaaaggaagatacacatctacaaganaataacttanaaaaacgtcggtagtatttagactaaatgaaacagacctaggaaaaccgaggaccacgacgccgtntaattacgtagtaccatagacttacggaagtgctaagtacggacgtaaagggcgtctaatcgtacttttggaattacgtcggtcggggaccctaaggggtactaaggttcggg

SEQ ID NO: 114687 - DNA, 1082 bp, Homo sapiens
  misc_feature: GYAE6OF02GXS19.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtgggggagtccgtttagggtaaacggtccggttcgggggggttacccctttaaggacggttccgttccccgttgggttcggttcggggtccccgttcgttcggggtaacttttaccgttaacctttttaccgtaaaggtttaaagttggggtaccgttaggggtaagttcgggtacggtttcggggggttacccccggccccggtaaggggtcccccgttaccccggggaaagggggggaaaacgggggggtcccggttagggggtaacggggtttagggggggttttaacgggggtaaacccggttttttaaaccggaaaaaaaaacgggttttaaaaaaaacgttagggtaaaggtttacggggttaagggtaaaaaggtaaaaaaaacggtttaccgggtaaaaccggtttaacccggggttacgaaccccggtaaaccccgggttaaagggaaaaaacggggtaaacgttaaacgtttacccgaaaccctaaacgttaccctaaaccgtaaaagggtaaacgtaaacgtttaaaacgttaaacccgaaaaaaaccggggtacccgggttttaaaggttaacgttttttaaacggaaaccgttaaaaaagttacgtaaaaccggtaaccggttaacccggtaaacggaaaaaacccgggtaacgggaaccaaccgtaaacggtccccgttaacttaaacgtttaaccgtaccggttaacccacgtaacggtaacgtttaccgggtaaagacgtactaacgtaccgggaacggtaaacgggtaggtacgttaagttacggttacttttacgggtaactttaggtcccgggtacggggtaaccccggtagggtaaccgtacggtttaccggg

SEQ ID NO: 114688 - DNA, 694 bp, Homo sapiens
  misc_feature: GYAE6OF02GAAUS.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgcaggctccgagggagggcgtggagtgggtggagttacaaaagtaaaatgatggtagaagaaaagtagacgtaacggtgaccgacccggtaggaaaacggaagtaagttacaaccgtaatccgtacgaaacggagtaacttaaattacgaaaaaaccggtacgggttagttaagtttacgaactaaatggaaaacctcgacccgtaacggaaaacccgagggtaaccaaccgtacggtacccgttaacgttagtttaacctacggtacccgaactaagtacgtttacgggaagttacgacgtacgtacggaacggttaaagggacggacgttagtagtacgtttttagaattacgtcggtaccgggggacccgtaggggtacctaggttccggg

SEQ ID NO: 114689 - DNA, 714 bp, Homo sapiens
  misc_feature: GYAE6OF02H33WW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacttaaaaggtgtccagtgtgaagtgcgaggtggtggagtcgtggggagtcttggaacgcggtcggggtccttagagtcgtcgtgtgtcgcctcgtggtattacgtactttacgagttaagtggtacgtggagtggtaggttcggtccgcgaggtccgtaccggaaggggaaggtcgtaggtaggttgggttacggtaacgtttaaacgaaaaagtaaaagtagagtaggtagaagtaaagtagacgtagcgacgtaaccggagtaaagaagtactacactatactaacaagaagtaacgtaacgttaaaacgaaacggtaggttaagttaacgtaagaactaaagtacgaaactacgtaaacccgaacgaaaacgtacgaaacgtacgagtaccttactaacgttaaccgtactaaccagtaacgtacggttaagaacggtcaaacgtacgtaacgaaacggtaggtacgtgttacgttcgttaacgtttagaacggttcgtaaccgggtccgggaaccctaagggttaccacgggtttcgg

SEQ ID NO: 114690 - DNA, 704 bp, Homo sapiens
  misc_feature: GYAE6OF02ITME1.15.86.H09.1.454.CMB.1.raw
  modified_base (308)..(308): a, c, t, g, unknown or other
  misc_feature (308)..(308): n is a, c, g, or t
  modified_base (533)..(533): a, c, t, g, unknown or other
  misc_feature (533)..(533): n is a, c, g, or t
  modified_base (634)..(634): a, c, t, g, unknown or other
  misc_feature (634)..(634): n is a, c, g, or t
tcagtctacgtagccacgaccggtgctcgatttagtgctatagacttgggtttggggggggagaggagccccagccttgggatccccaagtgttttcattcagtgagtccaggactgaacacaggaggactcaccatggagttcgggctgagctgggttttccttgctgctatcttaaaaggtgtccagtgtgaagtgcaggtggtggagtcgtgggggagccgttaggtaaagccgtgggggtcccttagagtcgtcctgtgtggcctctggattcactttcagtaatggctggatgagttcggccncaggctcgagggaaggggctggagtgggttggacgtttacgaaaagtaaaatgaatggtagaagaaaatagacgttaggtagacctaacccggtaggaaaaggtaagtactttacaacctatcctaacaaaggaacgaattaaagttaaccgaaaaaaacggtacgggttagttaatttaggaactaaaagtcggaaacaacgtacccgtaaggaaaaacccggngaaaccaacgacgtacccgttacttaactttacgtacgttaacccgaacgacggtaacttacgggaaagtacgaaccaagttaaccggaacgttaaagggnggtacttaagtgttacgttttagaatttacgtcggttaccggggaccctaacgggtaacaggttaccggg

SEQ ID NO: 114691 - DNA, 768 bp, Homo sapiens
  misc_feature: GYAE6OF02IJCSX.15.86.H09.1.454.CMB.1.raw
  modified_base (304)..(304): a, c, t, g, unknown or other
  misc_feature (304)..(304): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttaggagtctcctgtgtggcctcgtggattcactttcagtaatggctggatgagttgggccncaggctccgagggacggggctgggagttgggttggtacgtttacgaaaagtaaaactgagttaggtagaagtaaaagtaggaacgttacggtagcctaacccggtaggaaaacgggaagtacttaccgaacctagttacctacgaaaggtagtaactttaaaacgttaccgaaaaaaaccgggtcggtttaagtttaacttttacggaacctaaaaagttacgaaaccgtacggtaccctaaagggaaaaacccgtgggtaaacccaacgacggtacccggttacttaacgtttaccgtaacggtacccaaacgtaggttaaaccgttacggggaaacgttgtaaccgtacgttaaccgggtaacgggttaaaagggacggtacgtttaacgtggtttaccgtttttaggaactttacggtccggtaccgggggacccctaaggggtacctaagggtttccggg

SEQ ID NO: 114692 - DNA, 714 bp, Homo sapiens
  misc_feature: GYAE6OF02IASXE.15.86.H09.1.454.CMB.1.raw
  modified_base (386)..(386): a, c, t, g, unknown or other
  misc_feature (386)..(386): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggaaagccgtgggggtccttagagtctcctgtgtcggcctctggattctactttcagtaatggctggatgaggttcgggtccgcaggcctaccgagggagggcgtggaggtgggttggtacgtttacgaaaagtaaaatgatggtagaagaaatagactacggngacaccggagaaagaatactacacatctacaagagtaataaagtaacgaaaaacggtcggttaagttaatttagaacctaaaatacggaaaaccaggtaacctaacggaaaaacccggagggaaccctacgaacggtacccgtaacttaacgtttaaccgtacgtaacccaagtaacgtaacgtttaacgggaacgttacgacctaagttaacccgggaaacgggttaaaggggtaccggtaccttaaggttacgttacctttttaagacgtttacgtacccgggtccgggggaacccctaagggggttaacctaaggttacccgggg

SEQ ID NO: 114693 - DNA, 752 bp, Homo sapiens
  misc_feature: GYAE6OF02JZPGO.15.86.H09.1.454.CMB.1.raw
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatacttaaaggtcgtccagtggtgaagtgcgaggtggtggagtcgtggggagtccttggtaaacgccgtgggggtccttagngtctctgtggtcgcctgnggtatctacttcgagtagtggactggagtcggtaggttcgggtcccgcggtacggtcctccgggagggggaggggtccgtagggtaggttggggttgtaaccggtttaacgaaaaacggttaaaaagtggttaacggtaggggtacgtaaaaggtaaaacggttaggtaaccgttacggtaccgaccggtaaacccgttagggaaaacggtaataccgttaaccgacctagtccgtaagaacgaacgtaaacttacgtaaacgtaaaccggtagttacgttatacgaactaaagtcggaaaccacggtaccgtaaaggaaccgtaacgacgtaaccgcgtacgttaactacttacgtataccgaaagacgttaccgtaaggtaactcgtaacctagttaaccggagtaaacggtccggatttaggtccggttatttaacgggcttaacgttccgggtaacccggtagtaccggagttacggttccgg

SEQ ID NO: 114694 - DNA, 589 bp, Homo sapiens
  misc_feature: GYAE6OF02F3W9N.15.86.H09.1.454.CMB.1.raw
  modified_base (461)..(461): a, c, t, g, unknown or other
  misc_feature (461)..(461): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttgacgttacaaagtaaaatgatggtgagaaatagactaggtgcaccgtgaaaggagattcgacatctcaagagataattacaaaacgtacggtagtatttgactaaatgaaacagacctaggaaaacccgngaacacgagccctactaattacctagtaccacgagtagttacgggaaagtgactagtacgacgtaaaggacggtctaagtcgtcgttttagattagtccgttggggacccaggggtaccaaggttcgg

SEQ ID NO: 114695 - DNA, 696 bp, Homo sapiens
  misc_feature: GYAE6OF02G119F.15.86.H09.1.454.CMB.1.raw
  modified_base (402)..(402): a, c, t, g, unknown or other
  misc_feature (402)..(402): n is a, c, g, or t
  modified_base (421)..(421): a, c, t, g, unknown or other
  misc_feature (421)..(421): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccgaggctccgaggggaaggggctggaggtggggttggacgtttacaaaagtaaaatgagtggtagaagaaaatagactaaggtgcaccgagaaaggaanattcaccatctacaaaganaattaattaacgaaaaacgtacggttagtaatttaggactaaaagtcgaaacacgacctaaggaaaaaccgagggaacacgacgtacccgttacttaattaaccgtacgtaacccaacgtaagtaacgtttacgggaaagttacggaccgtaagttaccgggaaacgggttaaaggggtaacggtaccgtttaaattcgggttaccttttttaagggaattacggttacgggttaccgggggacccccgtaaggggtaaccgtaaggttacgggg

SEQ ID NO: 114696 - DNA, 1056 bp, Homo sapiens
  misc_feature: GYAE6OF02HKN6K.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttcctgctgctatcttaaaaggtgtccagtgtgaagtgcgaggtggtggagtcgtgggggagccgttagggtaaacgccgtggggggtcccttaggacgttccttccgtggtggtcggcctcgtggacttctactttcagttaagtggcttggattggtaggttcgggtccccgccgaggtcctacccggagggggaacgggggtccgttggggaagggttggggttagggtaacggttttaaccgaaaaaaagggtttaaaaactgggtaagttaggggttaaggtaaacggtaaaaaagttacggtaaacggtaacccgggttacggacccgtaaaccccgggtaagggtaaaaaacggggtaacgttaaacgttttaccgaaaaccccgtaagtttaaccccgtaaaccggtaaaaggtaaacgttaaaccgtttaaaaaaccggttttaaacccggaaaaaaaaaacccgggttccgggggttttaaacgttttaaacggttttaacggtaaaaccgttaaaaacgtttaacgggaaaaaccgttaaccggtaaccccgggtttaaaaggaaaaaaaccccccgggtgggaaaaacccgtaccgggtaaaccggttcccccgtttaaaacgtttaacgtttaaaccccggttaaccggtaaaacccccgtacgtaaaccggtttaacggtttacccggggaaaagtttaccggaaccccgtttaaaggttaccccgggggtaaaagggttaaaaccggggtaacgggttaacccgtttaacgttaaccgggtttaccgttttttaacgggaacctttaccggggtttaacccgggttaccccgggggggtaacccccgtaaaggggggtttaaccccgttaacggggttttccccgggg

SEQ ID NO: 114697 - DNA, 659 bp, Homo sapiens
  misc_feature: GYAE6OF02GX4Y0.15.86.H09.1.454.CMB.1.raw
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgccccccgtctgcatctgccttgctgggagcctcgatcaagctcacctgcaccctaagtagtgagcatcgaacctacaccatcgaatggtatacaacagagaccagggaacggtccccccagtactaataatagaaaagttaagagtgatgggcacgcaccaaccgaagggggacgggaacgtccccgagtcgcgttacattgggacctccgacgttcgtggggctgaaccgtccgtacctcacatcctacccaactccgacgtcttacggaccgtagtgacggtcgtaggaacgtacgtactacccgttaggttacgggaaggaacggaacgggaccccgaacgaaaccctaaagtttacggacgttacgggaccctaacggggtacggtttgggggtaccggtttcggggaaccggggttacgggaaccggtaaacgtccggtacggtacccgtacccggttacgggtacgtaacccggg

SEQ ID NO: 114698 - DNA, 665 bp, Homo sapiens
  misc_feature: GYAE6OF02H0JIV.15.86.H09.1.454.CMB.1.raw
  modified_base (268)..(268): a, c, t, g, unknown or other
  misc_feature (268)..(268): n is a, c, g, or t
  modified_base (414)..(414): a, c, t, g, unknown or other
  misc_feature (414)..(414): n is a, c, g, or t
  modified_base (569)..(569): a, c, t, g, unknown or other
  misc_feature (569)..(569): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggnttcactttcagtaatggctggattgagttgggtccgccgaggcctccgagggaaggggctgggaggtggggttggacgttttacaaaaagttaaaatgaagtggtagaagaaaatagaacttacggtgcgacccgtagaaaggaanacgttacacctagtactacaaagacgtaataaacttacgaaaaaacgtacgggttgtttaatttacgactaaaatagaaacaggaccctaacgaaaaccggaggaacacgagtcccgtatattaacgtcgtacccaatagacttacgaaacggtnacgaagttccgtaacggtaaaggacggtaacttaggtagtacgtttttagattagtccggttacggggaccccgaaggggtacctaaggttcgggg

SEQ ID NO: 114699 - DNA, 596 bp, Homo sapiens
  misc_feature: GYAE6OF02JDIUX.15.86.H09.1.454.CMB.1.raw
  modified_base (216)..(216): a, c, t, g, unknown or other
  misc_feature (216)..(216): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
  modified_base (462)..(462): a, c, t, g, unknown or other
  misc_feature (462)..(462): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggganccttggtaaagccgtggggggtcccttagagtctcctgtgtggcctctggattcactttcagtaatggctggatgtaggttgggtcccgccaggctccgaggggaggggctggagtgggtggacgtttacaaaagtaaaagtgatggtagaagaaaatgacgtacggtgacaccggtagaaagganattacacatctacaaganaataattacaaaacgtacggtatattagactaaagtnaaacncgacctaggaaaaccgaggacacacgtccgtactaattacgtacgtaccatagtagttcgaaagtgactagtacaggtaaggcggtatagtgtcgtttagattagtcgtacgggacccagggtactaggttcgg

SEQ ID NO: 114700 - DNA, 684 bp, Homo sapiens
  misc_feature: GYAE6OF02JLISK.15.86.H09.1.454.CMB.1.raw
  modified_base (326)..(326): a, c, t, g, unknown or other
  misc_feature (326)..(326): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccttggtaaacgccgtgggggtcccttagagtctcctgtgtgcctctggattcacttcagtaatggctggatgtagttgggtccgccgaggctccgagggagggcgnggaggtggttggacgtttacgaaaagtaaaatggtatggtagaagtaaaataggaactacggtcgaccgtaacccggtaggaaaaggaaagtaacttacacctaatactacgtaaacgagaacttaacttaacgaaaaacggtacggtagttaagttagactaaaagtagaaacgacgacctaacggtaaaaccggacgaaacctacaagtcctacgttaacgttaccgtaaccgtaccctaacgtagtaacgttacggaagttccgaacgtacttaccggaggtaaaggagtcgttaagttcgtacgtttgtacgttagtcggtaccggggaccctaacgggacgtaaggttacggg

SEQ ID NO: 114701 - DNA, 656 bp, Homo sapiens
  misc_feature: GYAE6OF02ICB1Y.15.86.H09.1.454.CMB.1.raw
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
  modified_base (407)..(407): a, c, t, g, unknown or other
  misc_feature (407)..(407): n is a, c, g, or t
  modified_base (601)..(601): a, c, t, g, unknown or other
  misc_feature (601)..(601): n is a, c, g, or t
  modified_base (632)..(632): a, c, t, g, unknown or other
  misc_feature (632)..(632): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtagaagtgcagggtggtggagtcgtgggggagtccttgggtaaagccgtgggggtcccttagagtcctctggtgtggcctntggattcactttcagtaatggctggatgagttggccncagcctcgagggacgggtctgggtaggtgggtagtacgttacgaaaagtaaaatgagtggtagaagtaaaangtacgtaggtgacgaccggtagaaaggtaanattaccaactatactacgaaggtataattaacttaacgaaaaacggtacgggttatttaagttagaactaaaagtcgaaacgaccgtaccgtaaaaggaaacccgaggaaaccaccgtaaggtcccgtaactaagtttaccacgtaacccaatacggtagtacggaagtcgaactagtaccggaagtaacgggngtctacttggtacctttagacttggtccggnggggacccagggtaacaggtccgg

SEQ ID NO: 114702 - DNA, 673 bp, Homo sapiens
  misc_feature: GYAE6OF02HE1ZO.15.86.H09.1.454.CMB.1.raw
  modified_base (187)..(187): a, c, t, g, unknown or other
  misc_feature (187)..(187): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgccccccgtntgcatctgccttgctgggagcctcgatcaagctcacctgccaacctaagtagtgagcataccgaacctaccaccatcgaatggtatacaacagacgaaccgaacgggaaccgtaccccccaagtaactattaaataagaaaaggtttaagaggtgagtggacagacccaacgaaccggaacgggggacggacgtccccgatcgtacttcaggtcggcctacctacgtttcggtcgggtctacggtaccgcctaaccgtccacctactccgtacccaaccctccacgtctacggacgacgtacggacgtcgtacgtaacgttactctacgttagggagaggaacgaccgactaaccgaactaacgttagtaacgtacggacgtaacgggttacggggttcgggttacggggttccggggtaaccgggtaacgggtaccggaacggtcggtacccgggaccgtttacccggtacggtccggaacccgg

SEQ ID NO: 114703 - DNA, 688 bp, Homo sapiens
  misc_feature: GYAE6OF02IB3OH.15.86.H09.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (256)..(256): a, c, t, g, unknown or other
  misc_feature (256)..(256): n is a, c, g, or t
  modified_base (533)..(533): a, c, t, g, unknown or other
  misc_feature (533)..(533): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttggctgctatcttaaaaggtntccagtgtgaagtgnaggtggtggagtcgtgggggtagccgttaggtaaacgccgttcggggggtacccttaggngttcctcctggtgtggcctgtggattcacttcatagtgctggatggagtggtcgcaggctcgaggaaggcgtggaggttgggtggtactttacgaaaagtaaaagtgagtgtaagaacgaaaagtacgtaacgtaacggtgacgaacccggtaggaaagtaacgtagttacacgaacgtctacgaagacgtaagtaaactttaaacgaaaacggtacggtaggttaatttacggaataaacgtagaaacttagaaccttaacgaaaacggtacgaanaccgtacgtacgtaactattaaccgacttaaccgactaagtaacgttaacggagttacgactaacgtaacggtaaccggaaggtacgtaacgtacttaggttactttaggtataacgtcggtaacgggtacccgaaggtacctaaggttacccgg

SEQ ID NO: 114704 - DNA, 571 bp, Homo sapiens
  misc_feature: GYAE6OF02FGIZI.15.86.H09.1.454.CMB.1.raw
  modified_base (442)..(442): a, c, t, g, unknown or other
  misc_feature (442)..(442): n is a, c, g, or t
  modified_base (511)..(511): a, c, t, g, unknown or other
  misc_feature (511)..(511): n is a, c, g, or t
tcagtctacgtagccacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgcccccgattaacgttggacaggaacccttggtcttccggcgagccgggcttttcacccgtctttatcgttacttatgtcagcattcgcacttctgatacctccagcatgcctcacngcacaccttcacaggctacagaacgctcccctaccaacacgcataagcgtcgctgccgcagcttcggtncgatcggtttacgccccgtttcacttcccttcccgcctatctgacgtcctacgtagtacg

SEQ ID NO: 114705 - DNA, 620 bp, Homo sapiens
  misc_feature: GYAE6OF02IOOYQ.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttggtaaagccgtgggggtccttagagtctcctgtgtggcctctggattcactttcagtaatggctggatgagttgggtccgcgaggctccgaggggaggggcgtgggaggtggggttggacgtttacgaaaagttaaaatgagtggtagaagtaaaatagactaggtgacaccgtagaaaggagacttacactatctacagagaattaactaacgaaaaacggtacggtagtatttagactaaatagaacacgacctagaaaccgagaacacgacgaccgtactatacgtacgtaccacagtacgttacggaagtcgacacgtcggaacggtaaggacggtacttagttcgtagttttagagttagtcggttcggggacccgtagggactaggtacggg

SEQ ID NO: 114706 - DNA, 605 bp, Homo sapiens
  misc_feature: GYAE6OF02GEQWV.15.86.H09.1.454.CMB.1.raw
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggtccgcaggctccgagggaggggctgggngtgggttggacgtttacaaaaggtaaaatgatggtagaagaaaatgactacggtgcaccgtgaaagganattcacatctacaagagattaatacaaaaacgtcggttagtaatttgacaaatgaacagccctaaggaaaaccgaggaccaagacgccgttactattacagtacccaacgagtacgttacggaagttcgactaagtccgtaacggtaaaggagtcttagttgtctttttagattacgtccggtacggggacccgagggtacaggttccggg

SEQ ID NO: 114707 - DNA, 616 bp, Homo sapiens
  misc_feature: GYAE6OF02FJ2W4.15.86.H09.1.454.CMB.1.raw
  modified_base (355)..(355): a, c, t, g, unknown or other
  misc_feature (355)..(355): n is a, c, g, or t
  modified_base (474)..(474): a, c, t, g, unknown or other
  misc_feature (474)..(474): n is a, c, g, or t
  modified_base (557)..(557): a, c, t, g, unknown or other
  misc_feature (557)..(557): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccccttagagtctcctgtgtggcctctggattcacttcagtaatggctggatggagttcgggtccgccagggcctccaggggaagggctggagtgggttgacgtttacaaaagtaaaangatggtagaagaaaatgactacggtgcaccgtagaaaggagtatcaccatctacaagagaataactacaaaacgcggttagtaatttagactaaatgaaacagacctaggaaaacccgnggaacaccgaagcccgtacttaattacctacgtaacccaagaagtaattaccgggaaattcgacacgtacggaacgtaaaggnggtactagtcgtacttttgattacgtcggtacggggtcccaaggggacctaaggtccgg

SEQ ID NO: 114708 - DNA, 693 bp, Homo sapiens
  misc_feature: GYAE6OF02JJUGS.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaacgccgtgggggtccttagagtctcctgtgtggcctcgtggattcacttcagtaatggctggatgagttgggtccgccaggctcgagggaaggggctggagtgggtggtacgtttacaaaagtaaaatgagtggtagagtaaatagacgtaggtagctacccggtagaaaggtaagacttcaaccatctacgaagaagtaataacttaacgaaaaaccggtacggtagttaagtttcgaaactaaaacgttaggaaacctaacggaccgtaacggtaaaaacccgggtacgaaaccgtaaccgtaacggtccgtacctttaacttaccgtacgtaaacccacgtaagagtttacggaagtacgacgtaagtaccggtaagtaacgggaacggtactaagttacggtacttttaggaatttacgtccgggttaccgggaacccggtagggttaaccgaagtttaccggg

SEQ ID NO: 114709 - DNA, 632 bp, Homo sapiens
  misc_feature: GYAE6OF02G4IY3.15.86.H09.1.454.CMB.1.raw
  modified_base (450)..(450): a, c, t, g, unknown or other
  misc_feature (450)..(450): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccgagggaaggggctggagtgggttggacgtttacaaaagtaaaatgatggtagaagaaaatagactacggtgcaccgtgaaaggagacttcaacatctacaagagataatacaaaaacgcggtagtatttgacaaatcgaanagcctagaaaccgaggacacgagccgtatacttactacgtaaccacgaagtacgttacgggaaagtgactagtaccggaacggttaaagggacggtacttacgttaggtccgttttttaggaacgtttacgttaccgggttcgggggtacccccgtaagggggtaaccaaggtttaccgggg

SEQ ID NO: 114710 - DNA, 698 bp, Homo sapiens
  misc_feature: GYAE6OF02FGP89.15.86.H09.1.454.CMB.1.raw
  modified_base (364)..(364): a, c, t, g, unknown or other
  misc_feature (364)..(364): n is a, c, g, or t
  modified_base (433)..(433): a, c, t, g, unknown or other
  misc_feature (433)..(433): n is a, c, g, or t
  modified_base (453)..(453): a, c, t, g, unknown or other
  misc_feature (453)..(453): n is a, c, g, or t
  modified_base (613)..(613): a, c, t, g, unknown or other
  misc_feature (613)..(613): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatctaaaaggtgtccagtgtgaagtgcaggtggtggagtcgtgggggagccgttggtaaagccgtgggggtcccttagcgtctccctgtgtggcctctggtacttcactttcagtaatggctggatggtagttcggggtcccgccagggtcctccgagggggtaaggggctggaggttgggttgtaaccggtttaanaaaaggttaaaaactggaagtaggtagaacgaaaataggtactacggtgaccaccggtaggaaaggtanacgttcaacactcacaaganaataactacgaaaacgcggttatatttacgacaaagtagaacacgacctaaggaaaaccgagtaaaccgaccacggtacccgttacttaactttaaccgtcgttaaaccaacgtaagtacgttacgggaataggcctaagtaccggtacggtaaacgggnggttaccttagtcgttacgttttttaggaacgttacgttaccccggggaggggaacccgtacggggttagtaaccggtttccggg

SEQ ID NO: 114711 - DNA, 616 bp, Homo sapiens
  misc_feature: GYAE6OF02FS1F9.15.86.H09.1.454.CMB.1.raw
  modified_base (384)..(384): a, c, t, g, unknown or other
  misc_feature (384)..(384): n is a, c, g, or t
  modified_base (552)..(552): a, c, t, g, unknown or other
  misc_feature (552)..(552): n is a, c, g, or t
tcagtctacgtagccacgaccggtgctcgatttagtgctatagacttgggtttgggggggagaggagccccagccttgggatcccccaagtgttttcattcagtgatcaggactgaacacagaggactcaccatggagttcgggctgagcgtggtttcgtgacgtgctatcttaaaggtgtccagtgtgaagtgcaggtggtggagtcgtgggggagccttggtaaaggccgtgggggtcccttagagtctcctgtgtggcctctggattcactttcagtaatggctggatgagttgggtccgccaggctccgagggaacggggctggcgtgggttggacgtttacgaaaagtaaaatgatggtagaagaaatagactacggtncaccgtgaaaggagattacacatctacaagagtataactacgaaaaacgtacggtagtagtttcgactaaagttgaaactagcctaagaaaccgtagaacacagccgtatacttacgtagtacccaataagtacttacgggaagtagcgacgtacgtacgtaaagggnggtaccttagtcgtacttttagacgttacgtaccggtaggggacccgtagggaactagttcggg

SEQ ID NO: 114712 - DNA, 643 bp, Homo sapiens
  misc_feature: GYAE6OF02GQ9XC.15.86.H09.1.454.CMB.1.raw
  modified_base (358)..(358): a, c, t, g, unknown or other
  misc_feature (358)..(358): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgcgaggctccgagggaaggggctgggagtgggttggacgtttacgaaaaagttaaaangtatggtagaagaaaatagacgtaggtgaccgacccggtaaggaaaaggaagtattaccaacctatactacaaaggaataagttaaattaaccaaaaaacggtcggttaattatttagactaaagtagaaaccagcctaacggaaaaccgacgaacacacgtccgtactaattaccagttaccaactagtacgttacgggaaagtgacagtacgaacggttaacggagtctaatggttacttttaggaattacgtcggtacggggaccctagggactagttcggg

SEQ ID NO: 114713 - DNA, 617 bp, Homo sapiens
  misc_feature: GYAE6OF02GYPK0.15.86.H09.1.454.CMB.1.raw
  modified_base (514)..(514): a, c, t, g, unknown or other
  misc_feature (514)..(514): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccgaggggaggggctggaggtgggttggacgtttacaaaagtaaaatgatggtagagaaaatagacgtacggtgacaccgtagaaaggaagattacgacatctacgaagagaataatacaaaaacggtcggtagttattagactaaatagaacagacctaagaaaaccgaggaaccacacgaccgtactacttacgtacgtaccanagtacgttacggaaagtgactagtaccggtaagtaacgggacgtacgtagttgtctttagagttacgtcggtacgggacccgtaagggtactaaggttccggg

SEQ ID NO: 114714 - DNA, 687 bp, Homo sapiens
  misc_feature: GYAE6OF02IE1EZ.15.86.H09.1.454.CMB.1.raw
  modified_base (335)..(335): a, c, t, g, unknown or other
  misc_feature (335)..(335): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaagcctgggggtccttagagtctctgtgtggcctctggattcactttcagtaatggctggatgagttgggtccgcaggctccgagggagggctggagtgggttgacgtttanaaaagtaaaatgatggtagaagtaaaatagaacgtacggtcgacaccgtaggaaaggaaagtacttaccgacctaatactacaaagtaagaattaacttaacaaaaaacggtacggtagtttaatttaggactaaaagtgaaaccgagtacctaaagaaaaccggaaggaaccaactaagtacccgtaacttaactttaaccgtacgtaacccaagtaacgtaacgtttaccgggaaagtcggactaacgtacgtaaacggtaaacggacgggacttaagttacgtacgtttttagacgttaacgttccggtaccgggggtacccgtaaggggtaccctaaggttcccgggg

SEQ ID NO: 114715 - DNA, 690 bp, Homo sapiens
  misc_feature: GYAE6OF02GSPPI.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcatgtggtggagtcgtgggggagccgttagggtaaagtccgtgggggggtcccttaggagtctccgtgtgtggcctgtggtattctactttcagtaatggctggtatgagttcgggtccgccgaggctccgaggggaaggggctagggaggttgggtggtacgtttaacaaaagtaaaatggagtggtagaagtaaaagtagacgtacggtagacgaccggtagaaaggaagtacttacgaacctagtactacgaagtaagaattaaacgttaaccgaaaaacggtacgtagtttaattagaactaaagtgaactacgaccgtaaacgaaaccgaggaaccacgtacaccgttctaacttactacgtaacccagtaaggttacgttacggtaacgtgaacctagtacggaccgggtaaaggcggttacctaagttcggttacgttttagaacgttcggttaccggtcccgggggaaccgtaggtaccggttaaggg

SEQ ID NO: 114716 - DNA, 611 bp, Homo sapiens
  misc_feature: GYAE6OF02FUKOV.15.86.H09.1.454.CMB.1.raw
  modified_base (500)..(500): a, c, t, g, unknown or other
  misc_feature (500)..(500): n is a, c, g, or t
  modified_base (507)..(507): a, c, t, g, unknown or other
  misc_feature (507)..(507): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtctgggggagccttggtaaagcctggggggtcccttagagtctcctgtgtggcctctggattcacttttcagtaatggctggatgagttggtccgccaggctccgagggaaggggctggaggtgggttggacgtttacaaaagtaaaatgatggtagaagaaatagactacggtgcaccgtagaaaggaagacttcaccatctacaagagaataattacaaaaacggtacggtagtatttgactaaatgaacagacctagaaaaccgaggaacacgagccgtactattaccngtaccanagattcggaatgactactcgacgtaaagggacggtactaagtcgttacgtttttagaattacgttcggtaccggggtaccccgaaggggacctaaggttccggg

SEQ ID NO: 114717 - DNA, 639 bp, Homo sapiens
  misc_feature: GYAE6OF02GM0RN.15.86.H09.1.454.CMB.1.raw
  modified_base (344)..(344): a, c, t, g, unknown or other
  misc_feature (344)..(344): n is a, c, g, or t
  modified_base (449)..(449): a, c, t, g, unknown or other
  misc_feature (449)..(449): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagcctggggggtcccttagagtctcctgtgtggcctctggattcactttcagtaatggcttggatgagttgggtccgcaggctccgagggaagggctggagtgggttggacgtttanaaaagtaaaatgatggtgagaaaatagactacggtgacaccgtagaaaggaagacgttacaccgatctacaagataataatacaaaaacgcggtattatttaganaaatgaaacaggtacctaaggtaaaaccggaggtaaacacgagtaccgtactagtttaaccttacgtaccaactaagaacgttacggtaaaggtcgtaacacgtaacggaacggtaaaggaaggtactaagttcggttacttttaggaacttagtcggtaccggggacctacggggtacaaggttccggg

SEQ ID NO: 114718 - DNA, 645 bp, Homo sapiens
  misc_feature: GYAE6OF02H1NXH.15.86.H09.1.454.CMB.1.raw
  modified_base (403)..(403): a, c, t, g, unknown or other
  misc_feature (403)..(403): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtggggggtcccttagagtctcctgtgtggcctctggattcactttcagtaatggctggatgaggttggtccgccaggctccgagggaaggggctgggaggtgggttggacgttttacgaaaagtaaaagtgatggtagaagaaaatagactacggtgcaccgtagaaggaanattacaccatcacaagagataattacgaaaagtcggtagttatttgaactaaatagaacagacctaaggaaaaccgagaacgaacacgccgtacttaattaccgtacgtaacccaacgtagtactttacgggagtagacctaagtaccgggaacggtaaagggcggtaacttagttacggttacgttttagagtttacgtcggttaccgggggacccgtaacggggtactaacggttcgggg

SEQ ID NO: 114719 - DNA, 634 bp, Homo sapiens
  misc_feature: GYAE6OF02GB789.15.86.H09.1.454.CMB.1.raw
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (498)..(498): a, c, t, g, unknown or other
  misc_feature (498)..(498): n is a, c, g, or t
  modified_base (515)..(515): a, c, t, g, unknown or other
  misc_feature (515)..(515): n is a, c, g, or t
tcagtctacgtagccacgaccggtgctcgatttagtgctatagacttgggtttggggggggagaggagccccagccttgggatccccaagtgttttcattcagtgatcaggactgaacacagcggactcaccatggagttcgggctgagctgggttttccttgctgctatacttaaaaggtgtccagtgtgaagtgcgaggtggtggaggtcgtggggggagccgttggtaaagccgtgggggtcccttagagtctcctgtgtggcctctggtattcactttcagtaatggctggatgtaggttcgggtccgccgaggctccgaggggaacggggcgtggaggttgggttggtacgtttacgaaaaagtaaaatgagtggagaagaaatagacgtaggtagacgaccgtaggaaaggaagtatcacatcanaaganataactacgaaaacgngtagtattgataatnaancaccgaagaaaacgcggacacgagcctnttacttacgacaccganacgtagttacggaagttcacgtagtaccggaaggttaaacgggcgtacgttaagtcgttcgttttagaagttcgttaccgggtacggggaccccgtaggggtaacctagggtttcccgg

SEQ ID NO: 114720 - DNA, 605 bp, Homo sapiens
  misc_feature: GYAE6OF02FWYFC.15.86.H09.1.454.CMB.1.raw
  modified_base (266)..(266): a, c, t, g, unknown or other
  misc_feature (266)..(266): n is a, c, g, or t
  modified_base (392)..(392): a, c, t, g, unknown or other
  misc_feature (392)..(392): n is a, c, g, or t
  modified_base (481)..(481): a, c, t, g, unknown or other
  misc_feature (481)..(481): n is a, c, g, or t
  modified_base (548)..(548): a, c, t, g, unknown or other
  misc_feature (548)..(548): n is a, c, g, or t
tcagtctacgtagccacgaccggtgctcgatttagtgctatagacttgggtttggggggagcggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggnttcactttcagtaatggctggatggtagttgggtccgcgaggcctccggagggaaggggctgggaggtgggttggtacgtttacgaaaagtaaaagtgaagtgggtagaagaaatagactacggtnacgaccgtagaaaggagtatttacatctacaagagtataagtacaaaacgtcggtagtattgataaatgaacagaccgaagaaaccggngaaccacgacgtcctatattactacgtaccagtagtagttcggaatcgactaagtacgaggtaaggngtactgtcgttactttgtaatcgtcggtcgggacccgtagggactaggtggttaccg

SEQ ID NO: 114721 - DNA, 411 bp, Homo sapiens
  misc_feature: GYAE6OF02G43AN.15.86.H09.1.454.CMB.1.raw
  modified_base (366)..(366): a, c, t, g, unknown or other
  misc_feature (366)..(366): n is a, c, g, or t
  modified_base (409)..(411): a, c, t, g, unknown or other
  misc_feature (409)..(411): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagttaatggctggatgaggttgggtccgcaggctccaggggaaggggctgggagtgggttggacgtttacaaaagttaaaatgataggtnagaaaatgactaggtgacaccgtgaaagagattcacatctaannn

SEQ ID NO: 114722 - DNA, 646 bp, Homo sapiens
  misc_feature: GYAE6OF02IQQYD.15.86.H09.1.454.CMB.1.raw
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (587)..(587): a, c, t, g, unknown or other
  misc_feature (587)..(587): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttaggagtctcctgtgtggcctctggattcactttcagtaatggctggatgagttgggtccgccgaggctccggagggaagggtctggagtggtggacgtttacaaaagtaaaatgagtggtagaagaaaatagacgtaggngacaccggtagaaagganatacacatactacaagagaataactaacgaaaaagtcggtagttagtttacgaaactaaagtcggtaaacaagtaccgtaaaggaaaaaccgaggtaacaacgaacggtccgtactaattaaccgtacgtaaccaacgaagttacgttacgggtaacgtagaccgaagtacggaacgtaaagggnggtacctaagtcgtcgtttaagagtacgtcgtacgggacccgtaaggactaagttcggg

SEQ ID NO: 114723 - DNA, 930 bp, Homo sapiens
  misc_feature: GYAE6OF02ISKNO.15.86.H09.1.454.CMB.1.raw
  modified_base (823)..(823): a, c, t, g, unknown or other
  misc_feature (823)..(823): n is a, c, g, or t
  modified_base (862)..(862): a, c, t, g, unknown or other
  misc_feature (862)..(862): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggtagttcgtgggggtagtccgtttaggtaaacgtccggttcggggggtaccctttaggacgttcctccgttggttcggtcgggtcccttcgttacgggtatttccgtacttttccgaacggtttaagttgggtccttagggaagttaggtaacgggtttcgggggtaccccgaccgacgggtccttaccggaacggggggtaaacggggggtccttgggggtaagggtttacggggggtttaggggttaaccgggttttaaacgtaaaaaaaagggtttaaaaaacgttgggtaaacgttaggggttaaggaaaaggtaaaaaacgttacgggaaaccgttaacggggttacggtacccgtaaacccggttaaggaaaaacggtaggttaactttacccggacctaagttacctacgaaaaggacgtaaatttaaacgtttaaacccggaaaaaaacggttcggtttaaggttaacttttacggaaacgttaaaagtacggtaaaactacggtaacccgtaaagggaaaaacccgggagtaaacgaccgtaaccggtcccgttacttaaacgtttacccgttaagtacccgaaacgtaggtaacgttaacgggtaaagtnaactacgttaaccgaacgggtaaaggacgtaccgtttanacggttttaccttttagaacgtttagttccggtacggggtaccccgtaaggggtactaggttaccggg

SEQ ID NO: 114724 - DNA, 584 bp, Homo sapiens
  misc_feature: GYAE6OF02I4FK7.15.86.H09.1.454.CMB.1.raw
  modified_base (299)..(299): a, c, t, g, unknown or other
  misc_feature (299)..(299): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgccaccctaagtagtgagcatccgaacctacaccatcgaatggtatcaacagagaccagggaagtccccccagtanataactgaaacgttaagagtgataggcagccacaccgaagggggacggacgtcccgatcgcttcagtcgggctccgtagttcgtggggctaggacccgtacctacccgtcacccagtcctaccaaccctccacgtcgtgacgatggacgctggagttactcacgtggtaggagacgacggccacgaactaattagagtcggaccgaaggtacggttggggtgttacggggacgggaacggaccgtaaggtccgtacgacccggtccgtacgggtcctaacccggg

SEQ ID NO: 114725 - DNA, 991 bp, Homo sapiens
  misc_feature: GYAE6OF02HW5EC.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttccttgctgctatacttaaaaggtgtaccagtgtgaagtgcgaggtggtggagtcgtgggggagtccgttaggtaaacggccgtacggggggttacccttaaggaacgttccgtccgttggttacggtcggggcccttcgttagggtactttacctaccttttacgaagttaaagttcgggtacgtagggtaagttagggacggtttcgggggtaccccgaccggtaacggggtcctacccggaaggggggtaaacgggggtaccgttacgggggtaaggggttcgggggtttaacgggttaaaccggttttaaaaccgaaaaaaagggttaaaaaacgttggtaaacggttagggtaaaggaaaaggtaaaaacgtaaacggttaacccgttaaacgggtaccggtaacccgtaaacccgggttaaaggaaaacggggtaaaacgtaactttaaccgaaccgttaaacttaccgtaacggtaaaagaacgtttaacttaaaacgttttaaaccgaaaaaaacgggtcgggttaagtttaacgtttaacggaaactaaaagttaaaccggaaactaaccgggtaacccgttaaaacggtaaaaaaccgggtacggaaaaccctaaccgggtaaccggtcccgtttaacctaattttaaaccccggagttaaacccgaacgtaaggtaacgtttaaccgggaaaggttacaaccggtaacgtaccgggtaaaacggtaacgggaaggttaaccttaggttcgttaacgtttttacggaagtttacggtacccgggttaccgggaaccccggtaagggtaacgttaacggttaccgggg

SEQ ID NO: 114726 - DNA, 676 bp, Homo sapiens
  misc_feature: GYAE6OF02I448J.15.86.H09.1.454.CMB.1.raw
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (363)..(363): a, c, t, g, unknown or other
  misc_feature (363)..(363): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacttaaaaggtgtccagtgtgaagtgcgaggtggtaggagtcgtggggacgccgttaggtaaacgtccggtcggggtaccctagacgttcctccgtgtgtggccttcgnggattcgactttnagttaatggactggatgagttggtcgcgaggctcgaggaggctggagtggtgacgtttagaaaagtaaangaagtggtagaagaaaatagaactaggtagacgaaccgtagaaaacggagaacttacgaacctaagacctaacgaaagagaaattaacgtaacgaaaaaacgtacggtaagttaacgttagaactaaagtacgaaactaagacctaagaaaccgagaaacaacgaacgtaaccgtactaacgttaacgtacgtaaccgaacgtaacgaacgttacgaaacgttacgaacgtaacgtaaccggtaacggtaaacggtaagtacgtaacgtacgttacgttagtacgtacgtacgtacggtaccggtaggtaacg

SEQ ID NO: 114727 - DNA, 1008 bp, Homo sapiens
  misc_feature: GYAE6OF02FHYWQ.15.86.H09.1.454.CMB.1.raw
  modified_base (120)..(120): a, c, t, g, unknown or other
  misc_feature (120)..(120): n is a, c, g, or t
  modified_base (705)..(705): a, c, t, g, unknown or other
  misc_feature (705)..(705): n is a, c, g, or t
tcagtctacgtagccacgaccggtgctcgatttagtgctatagacttgggtttgggggggagaggagccccagccttgggatccccaagtgttttcattcagtgatcaggactgaacacngaggactcaccatggagttcggctgagctggtttcctgctgctatactaaaggtcgtccagtgtgaagtgcgtaggtggtggtagtcgtcggggacgtccgttagggtaaacgtccggtcgggggttccccttaggcgttccgttcccgttggtcggtcgggtccccttacgttggtacctttaccgtaccgttttaccgaagttaaacgttcgggtcgtttaacgggacgtttcgggtaaccgggtttccggggtccccgtacccgaacgggttccccgtccgtaacgggggggtaacgggtccggttaggtaacgggtttacggggtttaacggtaaccgttttaaaacgaaaaaacgggttaaaaacgtcggtaaaggttacggtaacggtaaaacgtaaaaacgtccggtaaaccgtttaccgggtacaccccgggtaaccggtaaggaaaacggtaccggttaacgttaccgaaccctaacgtttacgtaaaccaaacgggttaactaaccgtaaacgttaaaccggaaacccgggttaagtttacctaacgtttaagaaccgtaaagtccggtaaaacncccgggttaaaccaccggtaaaaaccggtcgaaacccggtacttacccggtaccttaaaccttaacggtttaacccgaccgttaaacccggtaaacgttacggggttaaccgtttaaaccgggacgtttacccggaacgttaacgggttaaaccccgggtaggttaaaaccgggtcccggttttaagtaccggtttaccccggttaaacggtttttcccggaaatttttaccccggggggaaccgggggtaaccccgggtaacccggtttaaggggaaaccccttttagggtttacccccggg

SEQ ID NO: 114728 - DNA, 739 bp, Homo sapiens
  misc_feature: GYAE6OF02IX0XP.15.86.H09.1.454.CMB.1.raw
  modified_base (179)..(179): a, c, t, g, unknown or other
  misc_feature (179)..(179): n is a, c, g, or t
  modified_base (308)..(308): a, c, t, g, unknown or other
  misc_feature (308)..(308): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtntccagtgtgaagtgcaggtggtggagtcgtgggggagtccgttaggtaaagccgtgggggtcccttagagttctcctgtgtcggcctcgtggattcactttcatatggctggatcggagttcgggtccncaggctacgagggagggctgggagtgggtgtacgttacgtaaaagtaaatgtagtacggtagaacgtaaaatagaccgtacggtcgaccgtaccggtaaggaaaaggaagtaacgttacaacctagtacctaacgaaacgtaagtaagttaaacgtttaacgaaaaaaccggttcggttaacgttaattttaggaaccctaaagttaagaaccaacggtaccctaagggaaaaaccggtgaaacccgacgtaaccggcccgttattaaacgttaccgtaccgtaacccgtaagtaacgtaacgttacgggtaaactcggaacaaggtttacccgaaggttaaaagggccgaatttaacggttgtaacccgttttagtaacgttacgttcgggtaacccgggggtacccaagggttaacccagggtttccgg

SEQ ID NO: 114729 - DNA, 747 bp, Homo sapiens
  misc_feature: GYAE6OF02JKASG.15.86.H09.1.454.CMB.1.raw
  modified_base (334)..(334): a, c, t, g, unknown or other
  misc_feature (334)..(334): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtccttagagtctccgtgtgtggcctcgtggattcactttcagtaatggctggatggagttgggtccctccgaggctccgaggggaacggggctaggnggtgggttggtaacgtttacgaaaaaggttaaaagtggtaagtagggtacgaaacggtaaaaataggaaccgttagggtacgaccgtaaccccggtaggaaaaagggaacggtaactttaccgaaccctaatccgttaccgaaagtaagataaacgtttacgaaaaaacggtcgggttagttaacgtttagaaccttaaaagacgtaaacaacggtcccgtaaaggtaaaaacccgaggtaaaccgaaacacgggtacccgttagttaaccgttaacgtcgttaaccccgaacgtacttacgggtaataggttacaacgtcggaaaccgtaaggtacggtacgtaagttacggtacttttgaacgttagttccgtacggggtccccgaagggtaactaacgtagggttacccg

SEQ ID NO: 114730 - DNA, 783 bp, Homo sapiens
  misc_feature: GYAE6OF02JPAUK.15.86.H09.1.454.CMB.1.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (677)..(677): a, c, t, g, unknown or other
  misc_feature (677)..(677): n is a, c, g, or t
  modified_base (693)..(693): a, c, t, g, unknown or other
  misc_feature (693)..(693): n is a, c, g, or t
tcagtctacgtagccacgaccggtgctcgatttagtgctatagacttgggtttggggggaggagggagccccgagccttgggatccccaagtgttttcattcagtgatcaggactgaacacagaggactcaccatggagttcgggctgagctgggttttccttgctgctatcttaaaggtgtccagtgtgaagtgcaggtggtggagtcgtggggganccttggtaagccgtgggggtcctagngtctctgtgtgcctctggattcactttcagttaacnggtcgttggaatcggtaggttcgggtacccgcctaagggtcctacccggaagggggacgggggtctggggtaaggttggggtttacgggaaccgttttacgaaaaaaggttaaagttcgagttagggtagtaaaggaaaattacggaaccgttacggtagacccgtaacccgggtagaaaaagggggtcgtaactttaccggaaacctacttacgtaaccggaaaggtaacgtaacgtttaaaattaaacccgtaaaaaacccgggtagggtttaacgtttaacgtttacgaaaccgtaaaaggtaacgaaacgtaacggtaccgtaaaggaaaacccgaaggacctacggacgtctaccggttatacgtactacgaactagtacgttacgtaaagntaacgactaaccgggngttaaaagggcggtaacgttacttaggtaccttttagtaaaccggttcgttaaccgggacgggtacccggaagggttactaggtcccggg

SEQ ID NO: 114731 - DNA, 802 bp, Homo sapiens
  misc_feature: GYAE6OF02JOWIE.15.86.H09.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggagtcgtgggggagccttgggtaaagccgttgggggtcccttagagtctcctgtgtcggcctctggattcactttcagtaatggctggatggagttggtccgccaggtcctcgagggaaggggctaggnggtggggttgtaccggtttanaaaagtaaaactgagtggtagaagaaatagactacggagcgtaccgtagaacggaagacttcgactagtacctacgaaagtaagtaagttaaagttaaccgaaaaaccggtacgggtttagttaaattttagggaaaccttaaaaaggttaaccgtaaacgtaaccgggaaccccttaacgggtaaaaaacccccggaaggaaaacccccgtaaggaacccggtaccccgtttaacctaaaccgttttaaaccgtacgggttaaacccctaaagtaaccgggtaaacgtttaacggggtaactacggttaaccgaacccgttaccgggtaaaccggtaaaacgggtaggtaacccgtttaaggttacggttaaccgttttaggtaagttaaccggtttccggtacccgggggtaaccccggaaggggtttaaccaaccggttttccgggg

SEQ ID NO: 114732 - DNA, 622 bp, Homo sapiens
  misc_feature: GYAE6OF02FG2JC.15.86.H09.1.454.CMB.1.raw
  modified_base (432)..(432): a, c, t, g, unknown or other
  misc_feature (432)..(432): n is a, c, g, or t
  modified_base (449)..(449): a, c, t, g, unknown or other
  misc_feature (449)..(449): n is a, c, g, or t
  modified_base (463)..(463): a, c, t, g, unknown or other
  misc_feature (463)..(463): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgtagttgggtccgccaggctccaggggaaggggctggagtgggttgacgtttacgaaaagtaaaatgatggtgaagaaaatgactacggtgcacccgtagaaaggaagatcaccatctacaagagataattacaaaagcggtntatttgacaaatgaacngacctagaaaccgngacacagtccgtattaacgttactagtacccagtagtaacgtttacgggaattcgactaacgtaccgaacggtaaagggacgtacttaagtcggttactttttaggaactttaacgtccggtacgggggtaccccaagggggtacctaaggttccgggg

SEQ ID NO: 114733 - DNA, 607 bp, Homo sapiens
  misc_feature: GYAE6OF02II50A.15.86.H09.1.454.CMB.1.raw
  modified_base (305)..(305): a, c, t, g, unknown or other
  misc_feature (305)..(305): n is a, c, g, or t
  modified_base (498)..(498): a, c, t, g, unknown or other
  misc_feature (498)..(498): n is a, c, g, or t
  modified_base (565)..(565): a, c, t, g, unknown or other
  misc_feature (565)..(565): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagttctcctgtgtggcctctggattcactttcagttaatggctggatgagttgggtccnccaggctccgagggaggggctgggagtgggttgacgtttacaaaagtaaaatgaatggtagaagaaaatgactaacggtgactacccgtagaaaaggaagattacaccatctacaaagaagataaattacgaaaaaacggtacggtgttaatttggactaaaatcggaaacacggacctaaggaaaaacccgngaaaccacgagccgtataacttactagtaccacagtattacgggaatggacatcgaacgtaaagggngctaatgtacttttgatagtcgtgggacccagggacagtcgg

SEQ ID NO: 114734 - DNA, 852 bp, Homo sapiens
  misc_feature: GYAE6OF02HS7BE.15.86.H09.1.454.CMB.1.raw
  modified_base (337)..(337): a, c, t, g, unknown or other
  misc_feature (337)..(337): n is a, c, g, or t
tcagtctacgtagccacgaccggtgctcgatttagtgctatagacttgggtttgggggggagaggagcccccagccttgggatccccaagtgttttcattcagtgatcaggactgaagacagaggactcaccatggagttcgggctgagctgggttttccttgctgctatcttaaaaggtgtccagtgtgaagtgcaggtggtggagtcgtggggagccgttggtaaagccgtgggggtccttagacgttactcctgtgtcggcctctggattctactttcagtaatggactggatgagttcgggccgccgaggctaccgagggaaggggcgtaggnggtgggttaggtacgtttaacgaaaaagtaaaagttaggaacttagggtaggaaaacgtaaaagtaaggtaaaccgttacgggtacgaccgaacccggttaaggaaaacgggtaaagtaacgtttaaccaacccgtaacgttaaccgtaaccgaaaggtaacggtaaatttaaacttaaaacccgggtaaaaaacgtaccggggtttaaatttaacgtttaagggaaaccttaaaagttaaacggaaacgtaaacggtaccccggtaaaagaaaaaaccccgggtagaaaccctaacccggtaaacgtccgtttaaccctttaaagttaaccggttaaaccgaaacccgtaacgttaaacggtacgggtttaaccggaaacgtcggtaacctaaaccgtaacgggtaaaaccggggttaaacggaggttaccgttaaacgttggtttacgtttttaacggagttacgggtttccgggtaaccgggtacccgaagggttaccgaaacgtttcgggg

SEQ ID NO: 114735 - DNA, 789 bp, Homo sapiens
  misc_feature: GYAE6OF02I55M6.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttcgtgacgtgctatacgtaaaggtgtcagtgtagagtgcgaggtggtggagtcgtgggggagtccgttgggtaaacgccgtgggggtacccttaggtacgtccgtccgttggtcggtcggtcctcgtggtacttcctactttcgagttaagtcggtcgtgggatcggtacggttcgggtcccgccgtacgggtccttccggaacgggggtaggggtcgtagggtaggggttcggggtttacgggtaaccgttttaaagaaaaaaggtttaaaaagtgtaacggttagggtaagaaagtaaaagtaacggtacgtaacggtcgtaacccgaccggtaaggaaaacggtaacgtacttacccgaacgtacttaccaataaaggactaaacgttaaattaaaccgaaaaacggtacggttaagttaagtttacgaaactaaaacgtacgtaaacgtaacggaccgtaaaccggtaaaacggaaccgaacgtaccgaacgtacccgtattaactaacgtaccgtaaccaacgacgtaagtttaccggagtacgctaacgtaacgacgggtaagagtaccgtagtacgttacgttagtacgtacgttccggacggcccggtaaggtaccgtagtacggg

SEQ ID NO: 114736 - DNA, 667 bp, Homo sapiens
  misc_feature: GYAE6OF02JB086.15.86.H09.1.454.CMB.1.raw
  modified_base (324)..(324): a, c, t, g, unknown or other
  misc_feature (324)..(324): n is a, c, g, or t
  modified_base (574)..(574): a, c, t, g, unknown or other
  misc_feature (574)..(574): n is a, c, g, or t
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccgttggtaaagccgtgggggtcccttagagtctcctgtgtggcctctggattcactttcagtaatggctggatgagttggtccgccaggctccgaggggagggctggnggtgggttggacgtttacgaaaagtaaaatgagtggtagaagtaaatagaactacggtcgacgaccgtaggaaaggaagacttaccgaacctatccgtaccaagaagtaattaaactttaaccgaaaaaacggtacgggttagttaattttacggactaaaagtacgaaacgtaccgtaccgtaacggaaaaacccggtaggaacccaacgaccgtacccgtacttaacgtttaacctacgtaaccctanaacgtattcggaaagtcgaacatacggagtaaggacggtcttagtgtaccgtttagacttacgtcggtaccgggacccgagggactaggtcgg

SEQ ID NO: 114737 - DNA, 799 bp, Homo sapiens
  misc_feature: GYAE6OF02JJW8G.15.86.H09.1.454.CMB.1.raw
  modified_base (747)..(747): a, c, t, g, unknown or other
  misc_feature (747)..(747): n is a, c, g, or t
tcagtctacgtagccacgaccggtgctcgatttagtgctatagacttgggtttggggggggaggaggagccccagccttgggatccccaagtgttttcattcagtgatcaggactgaacacagaggactcaccatggagttcgggctgagctgggttttccttgctgctatcttaaaaggtgtccagtgtgaagtgtcaggtggtggagtcgtgggggagtccgttggtaaacggccgtgggggtcccttaggagttcgtccgttgtggtggcctgtggatttcgactttcagtaagtggcgtggattggtaggttcgggtcccgccgagggccgtccggaggggaaggggcgtgggtacggtgggttggtacggtttacgtaaaaaggttaaaaatggtaacgttggtaggtaaggtaaaaatacgtaacgtaaccggttcggaccgtaaccccggtaaggaaaaagggtaacggaacgttccaaacgtaactaccgttaaccgaaggtaaagtaacttaaacgttaaaccgaaaaaacggtaccgggtttaagttaacgtttaagtacgtaaaaacgtagaaacgtaacgtaccgttaaaggaaaaccgtaacgggaaaccacgaaccgtaccgttacgttaaacttacgttaccgaacgtaaccgtagtaacgttacggaacgttagaccgtaagttacggtaacgtaaacggggtagtaaccgtaagttcgttaaccgtttanaccggttaagtacggttaccgggacccgtaacggggtaactacggttacggg

SEQ ID NO: 114738 - DNA, 647 bp, Homo sapiens
  misc_feature: GYAE6OF02HGVTI.15.86.H09.1.454.CMB.1.raw
  modified_base (323)..(323): a, c, t, g, unknown or other
  misc_feature (323)..(323): n is a, c, g, or t
  modified_base (504)..(504): a, c, t, g, unknown or other
  misc_feature (504)..(504): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgaggttggtccgcaggctcgagggagggctggngtgggttggacgtttacaaaagtaaatgatggtagaagaaatagacgtacggtgaccaccggtagaaaaggaagtattacacctatctacgaaagagtaattaaacgttaacgaaaaacggtacgggtttagttaactttagaactaaaatacgaaacacgtaccgtaaggaaaaacccgnggaaccacgaacgtcccgtaattacttaacgtacgtaccagagtacgttacggaagtgacagtaccggaagtaacgggaggtcttaagttcgttacttttagaattacgttcggacgggtacccgaagggtactaagttcggg

SEQ ID NO: 114739 - DNA, 669 bp, Homo sapiens
  misc_feature: GYAE6OF02F7Z7U.15.86.H09.1.454.CMB.1.raw
  modified_base (619)..(619): a, c, t, g, unknown or other
  misc_feature (619)..(619): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagccgtgggggtccttagagtctcctgtgtggcctctggattcactttcagtaatggctggatgagttgggtcccgcgaggcctccgagggaaggggctgggagttgggttggacgtttacgaaaagtaaaatgatggtagaagaaaatagacgtacggtagccgaacccggtagaaaaggaagtatttaccgaaccagttacctaacgaaaggagtaaataaacgtttaaccgaaaaaaccggtacgggttaagttaagtttttagaaacctaaaagtacggaaactaaggacccttaaggaaaacccgaaggaaccaacgacgtaccgtattaactttacgactacaacgagtacgttacggaatgactacgtacggaagtaaggacggtntagtcgtcttttagattacgtcggtggggaccctagggacgtagttcggg

SEQ ID NO: 114740 - DNA, 683 bp, Homo sapiens
  misc_feature: GYAE6OF02GA44H.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtgctctggattcactttcagtaatggctggatgagttggtccgccaggctccgagggaaggggctgggagtgggttggacgtttacaaaagtaaaatgaatggtagaagaaaatagaacgtacggtgaccaaccggtagaaaaggaagattaccaaccagtactacgaaagagaaattaacttaacgaaaaaaacggtacggttagttaattttagaactaaaatacggaaactaaggacctaacggaaaaaacccgtaggaaccaacaacgccgttactaatttaacgacgttaacccaacgtataacgttacgaagttcgactaagtaccgtaaggtaaagggcggtactaagttacggttccttttaaggtaacttacgtttccgggtacggggtaacccctaaggggaactaaggttccggg

SEQ ID NO: 114741 - DNA, 794 bp, Homo sapiens
  misc_feature: GYAE6OF02II9TX.15.86.H09.1.454.CMB.1.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtggggagccgttggtaagccgtgggggtccttagagtctctgtgtgctcngattcncttcagtaatggctggatggagttgggccgccaggctccgaggggaaggggcgtgggaggttgggttaggtacgtttaacgaaaaagttaaaacgtgaagttgggtaaggaaagtaaaaatacggaacgttacgggtaccgaccgtaacccggtaaggaaaagggaacgttacttaccgaaccgtaattaccgaacgaaaggtaagtaagttaaacgttaaaccggaaaaaacggtacgggtttaagttaagttgtaaactaaaagtacgaaaacgacgtaccaacggtaaaaaccggaggaaccgaacaaccgggtcccgttaacttaacgtttaaccgtaaccgtaaccctaacgtaacggttaacgttaaaccggggtaagttacgtaaccgtacgttaaccggtaacggtaaaacgggtacgggtcttaaacggttcggtttacttttaacgggtaacgtttaacggttcccggggtaacccggggggtaaccccgtaacggggtaccgtaaggtttcccgggg

SEQ ID NO: 114742 - DNA, 630 bp, Homo sapiens
  misc_feature: GYAE6OF02FM9ZC.15.86.H09.1.454.CMB.1.raw
  modified_base (333)..(333): a, c, t, g, unknown or other
  misc_feature (333)..(333): n is a, c, g, or t
  modified_base (351)..(351): a, c, t, g, unknown or other
  misc_feature (351)..(351): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgttgctattttagaaggtgtccagtgtgaggtgcaactggtggagtcgtgggggaggcctcgtccaggcccgggggggtccctgagactctcctgtgaagcctctggattcaccttgagcacttatggatgacttgggtccgccaggctccgagggagggctggagtgggnggccacataacgaaaagngtaggaagtgaacactaaccgtatgtagaactctgtagagtgggccattccaccgtctaccgagacgaccgacgaccaaagacctcaacctacactctagacaaattacgaaccaaccgtagacgacgaccggaaggaccgacgggtctggttacgtattaccgtgttacgtaggtagtacggtattggttcgtcggtcgggttccgggggaccgtaaccggggtaccccgttcgggtacccgtacccggttcccgtaccctaccgtaccgtacccccg

SEQ ID NO: 114743 - DNA, 773 bp, Homo sapiens
  misc_feature: GYAE6OF02HYH5Z.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtggggagtccgttggtaaagccggttcgggggttcccttaggagttccttccgtggtggtcggcctgtggtattctactttcgaagttaagtggtcttggagttggtaggttcgggtcccgaccgaggtcctaccggaggggacgggcgtgggagggttggggttcggtacgtttaacgaaaaagttaaaatgtagtggtagaaagtaaaagtacgtacgtacggtgaccgtaacccggtaaggaaacggtaaagtacgttaaccaaccgtaataccgtacgaaacgagtaaacttaaacgttaaaccgaaaaacggtcggtttaagtttaacgtttagaactaaaagtacgaaaacctaggaacccgttaaacgaaaaccggaacgtaaccgacgtaacgacccttacgttaattaccgtaacgtaccctaagaacgtacggtttacggaagttcgaacacgttaccggtaaacggtaaaggtcggtaacttacgttacgttagttttaagacgtttacgtacgggttaccgggacccgtaagggtaccttaggttacccgg

SEQ ID NO: 114744 - DNA, 996 bp, Homo sapiens
  misc_feature: GYAE6OF02IVLW0.15.86.H09.1.454.CMB.1.raw
tcagtctacgtagccacgaccggtgctcgatttagtgctatagacttgggtttggggggagaggagccccagccttgggactccccaagtgttttcattcagtgatcaggactgaacacagaggactcaccatggagttcgggctgagcttgggttttccttgctgctatacttaaaaggtgtccagtgtgaagtgcaggtggtggagtcgtgggggagtccgttaggtaaaacgccggttcggggggtaccctttaggacgttccgtcccgttggttggtacggcccttcgttgggtactttccgtacttttccaaggttaaacgttgggccttaggggtaagttcggaagggtttcgggggtaccccggaccgtaacggggtcccgttaccccgggaaggggggaaaccgggggggtccgttaggggggtaacggggtttagggggggttttacggggtaaacccgggttttttaaaccggaaaaaaaagggtttaaaaaaagtttgggtaaaggtttaggggttaaggtaaaacggtaaaaaaagttaacggtaaaccggttaacgggtacggtaacccgaacccccggttaaagggaaaaacgggtaaaacggtactttaaccgaaaccctaacgttaccgttaacgaaaacggtaacgtaaaacgtttaaaacgttaaaccgaaaaaaaaccgggttaccgggtttaagttttaaacgttttacggaaacctaaaaagttacggaaaaccgtacggtaacccggttaaacggaaaaaaacccgggtacggaaaccaaccgtacggtaacccgtttacttaaactttaacccgttacgtaaaccctaagtaacggttaagttaccgggtaaaggtacgtaccgtaagttaacccgggaaggttaaagggacggttaacttaagttcggttaacttttaggaatttaccgtcgggtaccgggtacccgtaacgggtaactaggtttacccggg

SEQ ID NO: 114745 - DNA, 709 bp, Homo sapiens
  misc_feature: GYAE6OF02H4SIE.15.86.H09.1.454.CMB.1.raw
  modified_base (313)..(313): a, c, t, g, unknown or other
  misc_feature (313)..(313): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatcggagttcgggctgagctgggttttcctgctgctatcttaaaggtgtccagtgtgaagtgcgtaggtggtggagtcgtgggggagccgttggtaaagccgtgggggtcccttaagagtctcctgtgtgcctcgtggattcacttttcgagttaagtggctggagtgtagttggggtcccncgtaggcctccgtaggggaacgggggtctagggtacggtggggtttcggtacgtttaacaaaaaagggttaaaatggaagtggtagaacgtaaaatgacgtacggtgaccgaccggttaggaaaacggtagtaacttacgaaccctagtacctagaaacggagaattaaacttacgaaaaaaccggtggttagtaattttaggaacaaagtacaaagacgtacgaaagaaaacccgnggtaaccacggtagtcccggttaataactttacctacggaacctacgagtaacgttcggaaagtccgataaccgtggaaacgtaacgggagtcccttagtacggtatttacggaattccgtacggtccggggaacccgttaaggacgttaagttccggg

SEQ ID NO: 114746 - DNA, 601 bp, Homo sapiens
  misc_feature: GYAE6OF02HSUD1.15.86.H09.1.454.CMB.1.raw
  modified_base (303)..(303): a, c, t, g, unknown or other
  misc_feature (303)..(303): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctctgtgtggcctctggattcactttcagtaatggctggatgagttcgggtccncgaggcctcgaggggaggggctgggaggtgggttggtacgtttacaaaagtaaaatgatggtagaagaaatagacgtacggngacaccgtagaaggaagtattcacatctanaagatataactacaaaacgtcgtagtattgactaaatacgaacagacctaagaaaaccgngaacacgngtaccgtntaactttacagtaccaactagtagttacggaagtgaacagtacgtaagtaaggtacggcttatgttacctttgattacgtcggtacgggccggaacggtacgtagttcgg

SEQ ID NO: 114747 - DNA, 849 bp, Homo sapiens
  misc_feature: GYAE6OF02HVM00.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacggccgtagggggactcccgttaggagtctccgtgtcgtcggtcctctggtacttctacgtttcagttaagtggtcgtggattggtaggttcggggtcccgcgacggtccgtccggaagggggtaacgggggctaggggagggttggggtttacgggtaacgtttaacgaaaaaaggttaaaacgtggagttagggtagaagtaaaagtagaacgttacggtacgaccgaccggtaagaaaacggtaagacttaccaacctaacttaccgtaaacgaaacgtaaggtaaatttaaacgtttaaaccgtaaaaaaaccgggtcggttttaaacggtttaaacgttttaagggaaacttaaaaagtcggtaaaaccgaaccgggtaaacccggttaaacccgggaaaaaacccgggtaaaccggaaccgtaaaacccgtaccggtaacccgttaacgtttaactttaaccgttaccgtaaaccttaacgaacggttaacgttacggggtaaagtacgtaccgtaacgtacggaaaccggttaaaaggggcggttaactacggttagtttacgtttagtacgtacggttacgggtaccgggtaccgggacggtaactacggg

SEQ ID NO: 114748 - DNA, 580 bp, Homo sapiens
  misc_feature: GYAE6OF02FWL9V.15.86.H09.1.454.CMB.1.raw
  modified_base (376)..(376): a, c, t, g, unknown or other
  misc_feature (376)..(376): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgcaggctccagggaaggggctgggagtgggttggacgtttacaaaagtaaaatgatggtgagaaaatagactacggngcaccgtgaaaggagacttcaaccatctacaagagataactaccaaaaacgacggtagtatttagacaaatgaacatacctagaaaaccgagaacacgagccgtactacttactagtaccacagagttacggaatgacagtcgagtaaggacggtactagtgtacttttagattagtcgtccggggacccagggaccaagtcgg

SEQ ID NO: 114749 - DNA, 643 bp, Homo sapiens
  misc_feature: GYAE6OF02FZX6B.15.86.H09.1.454.CMB.1.raw
  modified_base (433)..(433): a, c, t, g, unknown or other
  misc_feature (433)..(433): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttagggtaaagccggtgggggtcccttagacgtcctccgtgtgtggcctcgtggattcactttcaagttaagtggctggatggagttgggtcccgcgaggcctaccgaggggaaggggcgtgggaggtggggttggacgtttacgaaaaagtaaaagtgtagtaggtgaagaaaatgactaggtgccaccgtaggaaagagactcacatcanagagataactacgaaaacgnggttatattgacaagtanaacgacgacctaggaaacgagacacgacgcctacgtacttacagtaccagagtagttacggaagttcgacacgtaccggaaggtaaaggacggtacgttagttacgttaccgttttagaactttacggttcggtaccggggtaccctaacggggaccttaggttacccgggg

SEQ ID NO: 114750 - DNA, 683 bp, Homo sapiens
  misc_feature: GYAE6OF02HBS8G.15.86.H09.1.454.CMB.1.raw
  modified_base (332)..(332): a, c, t, g, unknown or other
  misc_feature (332)..(332): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttggtaaacgccgtggggggtcccttagacgtctccgtgtgtcggcctgtcggtattcactttcagtaatggctggatgaggttgggtccgcaggcctcgagggagggtcnggaggttgggttggtactttaacgtaaagtaaaatagagtagtagaagtaaatagtacgtacggtgtacgacgtacggaaagaagtactacgacatactacaagaagtaactaagttaaacgtaaacgaacggttgtaagtttcgaaacgtaataacgaacgaagtaaccgtaacgaaaccgtaacggaccaacgtaacgaccgttactaagttaccgtacgtaccgactaagtagtccgggtaagcctagaacgtaccggaagttaaaccgggaagtcctaaggtttcggtaccttttaggaccttacgttccgggtaccgggacccggtaagggtactaacggttcggg

SEQ ID NO: 114751 - DNA, 782 bp, Homo sapiens
  misc_feature: GYAE6OF02JYJ1E.15.86.H09.1.454.CMB.1.raw
  modified_base (712)..(712): a, c, t, g, unknown or other
  misc_feature (712)..(712): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctggtttcctgctgctatctaaaggtgtccagtgtgaagtgcgaggtggtggtagtcgtggggagtccgttaggtaaacgccgtgggggtcccttagcgtctcctaggtcgtcggccttcgtgggtactttcgtaacgttttcgaagttaagtggctgggaattggtacgttgggtccgccgaggtcctacggaaggggaagggtcgtggtaggttgggttgtaacgtttacaaaaaggttaaaagtggtaagtagggtaagaaagtaaaagtacggtaaccgtacggtcgaccgtaacccggtaaggaaaacgggtaacgtaactttaccgaaccgtaattaccgtaacgaaaggtaagtaaacttaaaacgttaaacgaaaaaaccggtcgggttagttaaacgtttaacgaacgtaaaagttacgaaacgtaacggacccgttaaaggaaaaccggtagggaacctaaccgacggttacccgttaataaacgttacgacgttaaacccacgtaaggtaacgttacgggaaacttgaccgtaagtaccgggtaagtaaacgggngtaacttagtacggttaacttttggaattaaccggttcggtaaccggggccaagggtactaaggttcggg

SEQ ID NO: 114752 - DNA, 785 bp, Homo sapiens
  misc_feature: GYAE6OF02IO3PK.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgtaggtgggtggagtcgtgggggagtccttggtaaagccgtgggggtcccttagagtctctgtgtgcctctggattctactttcagtaatggctggatggaggttcgggtccgccgaggcctaccggacggggaagggggtcctaggggtagggttgggggttacggtaaccgttttaacgaaaaaaggttaaaaaagtggtaaagtagggttaaggaaaaggtaaaaagtaaggtaacgtaacggtcgaaccgaacccggtaaggaaaacgggtaaagtaacttaccaaaccgtaataccgtaacgaaagtaagaattaactaaacgaaaaacggtacggttaagttaagttacgtaaactaaagtagaaacctaggtaacctaaacggaaaaccgaaggaaccgaccgtaacgtccgtaactttacgttaacgtaccgtaaaccacgtaagtacgttaacgggtaacgtcgacgtaacgtaacggaacgttaaaacgggggctaacggttaaagttcgttacgttttaacgacgtttaacgttccggggaaccggggttccccggaaagggttaccgtacggttccggg

SEQ ID NO: 114753 - DNA, 609 bp, Homo sapiens
  misc_feature: GYAE6OF02F5EFR.15.86.H09.1.454.CMB.1.raw
  modified_base (465)..(465): a, c, t, g, unknown or other
  misc_feature (465)..(465): n is a, c, g, or t
  modified_base (489)..(489): a, c, t, g, unknown or other
  misc_feature (489)..(489): n is a, c, g, or t
  modified_base (519)..(519): a, c, t, g, unknown or other
  misc_feature (519)..(519): n is a, c, g, or t
  modified_base (554)..(554): a, c, t, g, unknown or other
  misc_feature (554)..(554): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggagccttggtaaagcctgggggtcccttagagtcgtcctgtgtggcctctggattcactttcagttaatggctggagtgagttgggtccgccgaggctccaggggaaggggcgtgggagtggggttggacggtttacaaaaaggttaaaatagtaagtggttagaagtaaaactagaactacggtgacgaacccgtagaaaggagtacgttcacatctacaagagataatacaaaagtacgtgttatttaganaaatgaacagacctagaaaaccgngaacacgagccctgtaacttactggaccanaacgtagttacgaatcgctagtacgacgtaaaggngtactagtgtctttttagaattacgtcgtccggggaccctagggtactagtcggg

SEQ ID NO: 114754 - DNA, 784 bp, Homo sapiens
  misc_feature: GYAE6OF02IHFKX.15.86.H09.1.454.CMB.1.raw
  modified_base (601)..(601): a, c, t, g, unknown or other
  misc_feature (601)..(601): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaacggccggtcgggggtccccttaggacgttcctcctgtggtcggccctcgtggattctactttcagtaatggctggtatggtaggttcgggtcccgccgacggtccgtaccggaagggggaacgggggtcgtagggtagggttaggggttacgggtaacggttttaacgaaaaaacggttaaaataggtaagtagggtagaaagtaaaagtaacgaacgtacggtgtaccgaacccggtaggaaaaggaagtacttaccaacctatacctacgaaagtagtaacttaaacgtaaccgaaaaaacggtaccgggttaagttaagtttacgaactaaaagtacgaaacgtaccgacccgtaaacggaaaaacccgnggaaaccaacgacgtacccgttactaacgtttacctacgtaacccgaacgtaagtaacgttacgaaggtccgaacgtaacgtaaccggaacggtaaacgggtacggtacttaacgtcgttacgttttagaagttaccggttacggtaccggggacccgtaagggtaaccgttaggttaccggg

SEQ ID NO: 114755 - DNA, 808 bp, Homo sapiens
  misc_feature: GYAE6OF02H9XV0.15.86.H09.1.454.CMB.1.raw
  modified_base (222)..(222): a, c, t, g, unknown or other
  misc_feature (222)..(222): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggttttccgttgacgtgctatacgttaaaggtgtccagtgtgaagtgcgaggtggtggagtcgtgggggacnccgttggtaagccgtcggggggtacccttaaggcgttccgtccgttggtggttcggcccgttgtggtactttccgtacttttcaagttaaagtggtccgtgggtaagtggtaggtttcggggtcccggccgacgggtccgttaacccgggaaggggaagggggtccgtggggtaagggttgggggttacggttaaccggtttaaacgaaaaacggttaaaaataggaaggttggtagaaagaaaagtagtaacgtacggtacgtacgaacccggtagaaaagggtaacacttaccgacctaactcctagtaaagtacgtaattaaactaaaccgtaaaaaccggttacggtaagtttattagaacttaagtacaaacgtcgaactaacgggaaaccaaggtaccacgtacgtaccgttacttaagttaccgtacgtacccgaagtacgttagttaaccggtaacgtcggaaactacggtaccggaaagggttaaacggacggttctacggttaacggttacgttttacgtagttaccgtcggggtaccccgggtaacggacgggttaaccctagggtttacccggg

SEQ ID NO: 114756 - DNA, 672 bp, Homo sapiens
  misc_feature: GYAE6OF02G8YPH.15.86.H09.1.454.CMB.1.raw
  modified_base (306)..(306): a, c, t, g, unknown or other
  misc_feature (306)..(306): n is a, c, g, or t
  modified_base (448)..(448): a, c, t, g, unknown or other
  misc_feature (448)..(448): n is a, c, g, or t
  modified_base (632)..(632): a, c, t, g, unknown or other
  misc_feature (632)..(632): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaaaggtgtaccagtgtgaagtgcaggtggtggagtcgtgggggagtcgttaggtaaagcgtgggggtccttagagtctctgtgtgcctgtgtattctacttcagtaagtggctggatgtaggttgggtccncgaggcctcggaggggaggggcgtgggagggttgggttaggtacgtttaacgaaaagtaaagtgaagtggtagaagtaaaagtagaacgtacggtagccgaaccgtaaggaaaaggaacgtacttacgaactactacctaanaagtaaagaacttaaacgttaaacgaaaaccggttacggttaagttactttagaaactaaagtacaaacgacgtacggtaacgaaaaccggaggaaccacacgtaccctatacttacgacgttaacacgtagtagttacggtaagtcgacaagtaccgaaagtaagggacgtattagtacgttntttagagttcgacggtaccgggaccgtaggactaggtccg

SEQ ID NO: 114757 - DNA, 658 bp, Homo sapiens
  misc_feature: GYAE6OF02FG5CI.15.86.H09.1.454.CMB.1.raw
  modified_base (377)..(377): a, c, t, g, unknown or other
  misc_feature (377)..(377): n is a, c, g, or t
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtccccttagagtctcctgtgtggcctctggattcactttcagtaatggctggatgtagttgggtcccgccagggcctccgaggggaaggggcgtggagttggggttggacgtttacgaaaagtaaaatggaatgggtanaagaaaataggactacggtgcgacccgtagaaaggagattcaacatctacaagagataataacaaaacggcggttagtatttagacaaatgaaacagaccctagaaaaccgagacacacgcctacttaattacngtaacccaanaacggtaacgtttcggaaagttgaccgtaatacggacgggtaaaaggacggggtaacttagtacggtttacgtttttaggaactttaacggttccgttacggggggaccccgtaagggtaccgaaggtttcccgggg

SEQ ID NO: 114758 - DNA, 748 bp, Homo sapiens
  misc_feature: GYAE6OF02FPU3W.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttccttgctgctatcttaaaggtgtccagtgtgaagtgcaggtggtggagtcgtggggagccttggtaaagccgtgggggtcccttagagtctccgtgtgtggcctctggattcgactttcagttaatggtctggtatggtaggttgggtcccgccgtaagggccttaccgagggggtaacggggcgtagggaggttggggttacggtaacgtttaacgaaaaagttaaaaagtcgtaagttagggtagaagtaaaatagaacgttacggtagacctaacccgggtagaaaaggaacgtaacgttacgaccgtatcgtacgaaagtagtaataagtttaaccgaaaaacgtcggttagttaaacgtttgaagtaaacttaggaaaaccgtacggtacccgtaaacggaaaacccgaggaaccgtaaccgacggtacccgttagtaacttaaccgtcgtaaacccgtagaacggtacgtttacggaaacgttacgacttaacgggaaccgttaaagggcgtaacgttaaggtcgttaccgttttagacttacggttacgtcggggaacccgtaggggtacctaacggtgttacccgg

SEQ ID NO: 114759 - DNA, 658 bp, Homo sapiens
  misc_feature: GYAE6OF02GELF6.15.86.H09.1.454.CMB.1.raw
  modified_base (397)..(397): a, c, t, g, unknown or other
  misc_feature (397)..(397): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagttaatggctggatgtagttgggtccgccagggcctcgaggggaaggggctgggaggtggggttggtacggtttacaaaaagtaaaagtggagtggtagaagaaaatagacttacggtnaccgaccggtaggaaaggaagtacttacaaccgaactctacaagagaataaattaccgaaaaacgtacggtagttactttagactaaaagtagaacacgacctaacggaaaaccgaggaacacgaacgaccgtacttagttacctacgttaacccgaacgtagtacgttacggaagtcgacgaacgtcgtaacggtaaggacgtacttagtgttacgttttgaatttactcgggtacgggacccgagggtaccaggttcgg

SEQ ID NO: 114760 - DNA, 783 bp, Homo sapiens
  misc_feature: GYAE6OF02FUEH7.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgacgtgctatacttaaaggtgtccagtgtgagtgcaggtggtggagtctggggagccttggtaaagccgtgggggtcccttagagtctcctgtgtggctctggattcactttcagtaatggctggatgagttgggtccgccaggctccgagggacggggcgtggaggtgggttggtaccggtttacgaaaaaggttaaaactggaagttaggttagaagtaaaaatcgaaccgttacgggtagacctaacccggtaggaaaacgggaagtaacgtttccaaaccgatactaccgaaagtaacgtaattaaacttacgaaaaaaccgtacgggttagttaactttaggacctaaaagttagaaaccgtacgaacccgttaacggaaaaacccggtaggaacccgtaacgaacgtacccggttaccttaacgttaccgttacggttaacccctaacgtaacggttaacgttaaccgggtaacgttacggtaccgtacggtaacccggtaacgggttaaaacgggacgggtaacttaacggttacggttccgtttttaacggtaacgtttacggtcccggtttacgggggacccccgttaaggggaaccttaacggttccgggg

SEQ ID NO: 114761 - DNA, 678 bp, Homo sapiens
  misc_feature: GYAE6OF02G6OVI.15.86.H09.1.454.CMB.1.raw
  modified_base (435)..(435): a, c, t, g, unknown or other
  misc_feature (435)..(435): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttagggtaaacgcccgttggggggtccccttaggacgttcctccgtgtggtcggcccttctggtacttctacttttcgagttaaatggctggatgagttggtccgccgaggctccgagggaaggggtcgtggagtgggtggacgtttacgaaaagtaaaatgatggtgaagaaaatagacgtaggtgacaccgtaggaaaggagtatcacatctanaagagataatacaaaacgtcggtagttatttagactaaagtacgaactacgacccgttaaggaaaaacccggaggaaccaaccgtacgacccggttacttaacgttacctacgtaaccacgtaaggtaacgttacgaacggtgacaacgttaccggaacgttaaagggacggtacttaagtcggttcttttagtattacgttcggtaccggggccggtaaacgggtacgtaaggtttccgggg

SEQ ID NO: 114762 - DNA, 820 bp, Homo sapiens
  misc_feature: GYAE6OF02IO9H5.15.86.H09.1.454.CMB.1.raw
  modified_base (685)..(685): a, c, t, g, unknown or other
  misc_feature (685)..(685): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatactaaaagtgtccagtgtgaagtgcgaggtggtggagtcgtgggggacgccgttagggtaaacgtccgtcgggggtacccttaaggacggttccttccgttggttcggtcggtcccgttcgtgggtacttctactttcaagttaagtggtcgtggagttcggtaggttcgggtcccggccgtaggccgttaccggaaggggaaggggtcgttagggtaggttcggggttaggttaaccggtttaaacgtaaaaaaaggttaaaaacgtggaagttagggtaaggaaaagtaaaaacgtacggtaacggtacggtacgaccgtaaccgggtaagaaaacgggaacgtaacttaccgaaccgtaataccgtaacgaagtaagtaacttaaacgttaaaacgaaaaaccggtaggtttaacgtttaagttaagaactaaaaggtacgaaaccggacgtaaccggtaaacgaaaaaccggtcgaaacctaacgtacgtaccgttaacgtaactttaaccnggttaaacccgaataacggttaagttaccggaaagtccaacgttaacgtccggaaacggtaaggtcggtaacttaggttcgttaacgttagacgttaggtcccggtacggacggtaacgggacctaaggttccgg

SEQ ID NO: 114763 - DNA, 754 bp, Homo sapiens
  misc_feature: GYAE6OF02GQ49Z.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttaggtaaagccgtgggggtcccttagagtctcctgtgtggcctctggattctactttcagtaatggctggatgagttgggtcccgcaggctccgaggggaaggggcgtgggaggttggggtaggtacgtttacgaaaaaggttaaaagtagagtgggtagaagaaaatagactacggtgacgaacccgtaggaaaaggaagtacgttacaacctaattacgtacaagtaagtaattaaacttaaccgaaaaaacggtacggttaagttaacgtttagaactaaaagttacgaaacgaacgtaacccgtaacggaaaaacccggtacggaaaccaaccgacggtacccgttaaccgttaatttaaccgtaaccgttaaccctaaacgacggttaacgttaagggtaaacggttacgtaccgtaagttaaccgggaacgggtaaagggtacgggtaaccttaaggttcgttacgttttagaattaacgtttccggtccggggttaaccccgaaggggtaaccgtaggttacccgggg

SEQ ID NO: 114764 - DNA, 709 bp, Homo sapiens
  misc_feature: GYAE6OF02INVZT.15.86.H09.1.454.CMB.1.raw
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
  modified_base (588)..(588): a, c, t, g, unknown or other
  misc_feature (588)..(588): n is a, c, g, or t
  modified_base (639)..(639): a, c, t, g, unknown or other
  misc_feature (639)..(639): n is a, c, g, or t
tcagtctacgtagccacgaccggtgctcgattttagtgctatagacttgggtttgggggggggagaggagccccagccttgggatccccaagttgttttcattcagtgatcaggactgaacacagaggactcaccatggagttcgggctgagcgttgggttttccttgctgctatacttaaaaggtgtccagtgtagaagtgcgaggtggtggagtcgtgggggagccgttaggtaaacgccggtgggggtcccttagngtctctgtgtcgtcctgtgtattctctttcagtatggctgntgtggttcggccgccgaggcctacggaggggagggtgtgggtaggtggggttaggtacgtttaacgaaaaagtaaaagtgagttaggtagaaagtaaataggactacggtcgaccgtaaccggtaaggaaacgtaatcttaaccgaccaagttcctaacgaaacgaagtaacttaaacgtaaaccaaaaacggtacggttatttaagttaagaaacgttaaagtcgaaacacgtaaccgtaaaggaaacccggagaacctgaacgtcccgtacttaattaccgttaanaccctaagaacgttaggtaccgtaagctaacgactaacgggaacggtaagnggtacctttagtaggtttacttgacgttacgggtccggtccggggtaacctaagggtacgtaggttccgg

SEQ ID NO: 114765 - DNA, 882 bp, Homo sapiens
  misc_feature: GYAE6OF02H02JI.15.86.H09.1.454.CMB.1.raw
  modified_base (181)..(181): a, c, t, g, unknown or other
  misc_feature (181)..(181): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgctatacttaaaaggtntaccagtgtgaagtgcgagggtggtggagtcgtaggggagtccgttaggtaaacgccggttcggggggttacccttaggtacgttccgttcccgttaggtacggttccgggacccttcgttacgggtactttaccgtaaccgttttacctaaggttaaacgtcggggtaccgttagggagtttacgggttaggtttccgggggtacccccgccggtaacggtaccgttacccggggaaagggggtaacgggggtcgtaggggtacggggtttaggggttaccggttaaaccggttttaacggaaaaaaagtttaaaaagtcggttaaggtagggtaaaggtaaacgttaaaaggtacgtaaccggttaacgggtcggaacccgttaaccgggaaggtaaaacgggtactaacgtttaccgaacccgtattaccgtaacggtaaacgtaagtaaacttaaacgtaaccgtaaaaaacccgggtggtttaagttaacgtttacgaagtaaagtacgaacgttacggaaccctaacgaaaccgagtaacgaccgtaacgcccttaacggttattaccggtctaaccgtacgtaagtacgtaggtagtaccgtaacgagttaccggtaaaggtaggcgtaagttacggtacgttactttacgaacgtttcgtacccggtagggacccgacggtagtaggtccggg

SEQ ID NO: 114766 - DNA, 566 bp, Homo sapiens
  misc_feature: GYAE6OF02F7L2R.15.86.H09.1.454.CMB.1.raw
  modified_base (440)..(440): a, c, t, g, unknown or other
  misc_feature (440)..(440): n is a, c, g, or t
tcagtctacgtagccacgaccggtgctcgatttagtgctatagacttgggtttggggggagaggagccccagccttgggatccccaagtgtttccattcagtgatcaggactgaacacagaggactcaccatggagttcgggctgagctgggttttccttgctgctatcttaaaaggtgtccagtgtgaagtgcaggtggtggagtctgggggagccttggtaaagcctggggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcaccgtgaaaggaagattcaccatctacaagagaataattacaaaaacgacggtagtatttganaaatgaaacagacctagaaaccgagacacagccgtatattactgtaccacagtattcggaatgacagtacgacgtaaaggaggtctatgcttttagattagtcgtcggggacccagggacagtcgg

SEQ ID NO: 114767 - DNA, 807 bp, Homo sapiens
  misc_feature: GYAE6OF02I1CXR.15.86.H09.1.454.CMB.1.raw
  modified_base (146)..(146): a, c, t, g, unknown or other
  misc_feature (146)..(146): n is a, c, g, or t
  modified_base (164)..(164): a, c, t, g, unknown or other
  misc_feature (164)..(164): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
  modified_base (681)..(681): a, c, t, g, unknown or other
  misc_feature (681)..(681): n is a, c, g, or t
tcagtctacgtagccacgaccggtgctcgatttagtgctatagacttgggtttggggggggagaggagccccagccttgggatccccaagtgtttttcattcagtgatcaggactgaacacagaggactcaccatggagttcgggntgagcgtgggtttcctgntgctatacttaaaggtgtcagtgtgaagtgcgagggttggtgggagtcggtggggggatccgtttagggtaaaggtccggttaggggggtcccttaggagttcctcctggtcggtcgggtcccttcgtgggtacttctaccttttcgaagtaagtggtcgtaggtagtaggtggtttcggggtcccgaccgacggccgtccggaagggggtaacgggggcgttagggtagggttggggttaaccggtacgttttaanaaaaaaggttaaaagnggtaaggtagggtaagaaacgtaaaatacggaacgtacggtacgctaacccgggtaagaaaacgggaattacgtacctaaacgaacgtaccgttaacgaaagtaggtaaattaaacgttaacccggtaaaaaaacggccgggttttaagtactttaaaccggaattaaagaacgacgtaaccgtaccaacgggttaaaaccgaggtaccacgaccgttacggttactaaccttggacctaaccngtaaagttacgtagggttaactacgagttaaactaccgggaaacgttaagggactcctttaaggtcggtttaacttggtataccgttacggggtcccggaaaccgggttagaccccttagggccgg

SEQ ID NO: 114768 - DNA, 813 bp, Homo sapiens
  misc_feature: GYAE6OF02HZIIU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttgggctgagctgggttttccttgctgctatacttaaaaggtgtccagtgtgaagtgcaggtggtggagtcgtggggagccttggtaaagccgtcgggggtccttaggacgtcttcctggtgtggcctcgtggatttctactttcagtaagtggctggatagaggttcgggtcccgtcgacggccgtaccgaaggggaaggggtcgtagggtaggtgggttggtaacgtttaacgaaaagttaaaaatgaagtggtagaaagtaaaagtacgacgttacggtagaccgtaacccggtaagaaacggtaagaacttacgacctaatacgtaccgaaagtaacgtaattaaagttaaaccaaaaaacggtaccggttaagtttaacgtttagtaacgtaaaagtacgaaacgtacgaaccgttaaacgaaaaacccggagtaaccgaaccgtaacggtacccgtaacctttaacgtttaaaccgtacgttaaaccccgaacgtaacggttacgtttaacgggtaacgttagaacccgtaagtttaccgggaaaaccgggttaaacgggaacggtaaccgtttacggtttacgttacgttttttaaggaacgttttaaccggttacgggtacccgggggaaccccggttaaacggggacccgttaaaggttacccgggg

SEQ ID NO: 114769 - DNA, 675 bp, Homo sapiens
  misc_feature: GYAE6OF02JZ0JI.15.86.H09.1.454.CMB.1.raw
  modified_base (248)..(248): a, c, t, g, unknown or other
  misc_feature (248)..(248): n is a, c, g, or t
  modified_base (567)..(567): a, c, t, g, unknown or other
  misc_feature (567)..(567): n is a, c, g, or t
  modified_base (589)..(589): a, c, t, g, unknown or other
  misc_feature (589)..(589): n is a, c, g, or t
tcagtctacgtagccacgaccggtgctcgatttagtgctatagacttgggtttgggggggaggaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtgggggagcgttggtaaagccgtgggggtcccttagngtctcctgtgtggcctctggattcgctttcagtaatggctggatggaggttcgggtccgccgaggcctaccgaggggaggggcgtggaggtgggttggtacgtttaacgaaaagttaaaaagtgtagtaggtagaagaaacgtaagtacgtacgggtgacccgtaccggtaggaaaacgggagtacttcaaccgtatactacaaagagtaataactaacgaaaacgtaggttagtttattaggaactaaagtagaacgactaccctaaaggaaaaccgtaggaactacgaagtacctgtaaattactaacgtaccgaanaggtaacttacggaagtcgaanagtaccgaagtaaggtacggactttaagtcgttacgtttagaacgttagtccggtaccggggaccgagggtaaccgaggttccggg

SEQ ID NO: 114770 - DNA, 649 bp, Homo sapiens
  misc_feature: GYAE6OF02IYRUQ.15.86.H09.1.454.CMB.1.raw
  modified_base (588)..(588): a, c, t, g, unknown or other
  misc_feature (588)..(588): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtggggtcccgttagagtctctgtgtggcctctggattccactttcagtaatggcgtggatgtagttcgggtccgccgaggcctccgagggaggggcgtggaggtgggtggtacgtttacgtaaaagtaaaagtgagtaggtgaagaaaagtaggagtacggtgacaaccggtagaaaggaagactacgactatgtacaaagagtaataattaacgaaaacggacgttgtaattgaacaaagtacgaacacgtaccaaggtaaaacccgaggaaccgacgtacgaccgtaccttagttaacctacgtacccaactaggtaacttacgggaagtccgagtaactaccggaggtaaagggngtaactacgttgtacgttttagacgttagtacggtcgggacccgtaggtaagtacgtcggg

SEQ ID NO: 114771 - DNA, 687 bp, Homo sapiens
  misc_feature: GYAE6OF02HU7CJ.15.86.H09.1.454.CMB.1.raw
  modified_base (260)..(260): a, c, t, g, unknown or other
  misc_feature (260)..(260): n is a, c, g, or t
  modified_base (389)..(389): a, c, t, g, unknown or other
  misc_feature (389)..(389): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctctgtgtggcctntggattcactttcagtaatggctggagtgagttcgggtccgccgaggctccgaggggaaggggcgtgggaggtgggttggacgtttacgaaaagtaaaagtgagtggtagaagtaaatagacgtacggngacgtaccggtagaaacggaagtacttaccaacctaatcctacgaaagaagtaattaaacgttaacgaaaaacggtacggttagtttaagtttacgaactaaaacgtacgaaacacgtaccgtaacggaaaaccgaggaaccaacgtaacgacccgtacttaacgttaccgtacgtacccacgaagtacgttaccgaaagtcgaacgtactaccggtaacggtaagggacgtacgttaagttcgtaacttttgacttacgttacggaccgggtacccgtaagggtactaagttccggg

SEQ ID NO: 114772 - DNA, 594 bp, Homo sapiens
  misc_feature: GYAE6OF02GVYJG.15.86.H09.1.454.CMB.1.raw
  modified_base (407)..(407): a, c, t, g, unknown or other
  misc_feature (407)..(407): n is a, c, g, or t
  modified_base (427)..(427): a, c, t, g, unknown or other
  misc_feature (427)..(427): n is a, c, g, or t
  modified_base (452)..(452): a, c, t, g, unknown or other
  misc_feature (452)..(452): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttggtccgcaggctccgagggaggggctggaggtgggttggacgtttacgaaaagtaaaatgatggtagaagaaatagactaggtgcaccgtagaaaggagattacacatctanaagagataattacaaaacgngtagtatttagactaaagtagaacngacctagaaaaccgagaacacgacgccgtatacttactacgaccagtacgagttacggaagtcgactagtaccgacggtaaaggacggtacttagtgttactttagattacgtcggtcgggacccgtagggactagttcggg

SEQ ID NO: 114773 - DNA, 730 bp, Homo sapiens
  misc_feature: GYAE6OF02GIJPH.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtcccttagagtctcctgtgtggcctcgtggattctactttcaagtaagtggcgtggatggtaggttcgggtcccgccgaggcctaccgaagggggaacggggcgtagggaggttggggttaggtacgtttaagaaaaagtaaaagtgaagtaggtagaaagtaaaataggaacgtacggtcgacgaaccggtaggaaaaggaagtacttacacgtatctacgaaagataactaataacgaaaacggtacggttagttattagaactaaatacgaaactacgaaccgtaaggaaaacccggagaccaaccgaagtacccgttaattaacgtttaaccgtaccgtaaccgaaacgtaaggtaacgtttacgggaaacgttcgaacgtaacgtacgggtaacggttaaaggacggttacgttaagtggttaccttttaggaacttaacggttccgggtaccggggacccgtaggggtaactacgggtttccggg

SEQ ID NO: 114774 - DNA, 740 bp, Homo sapiens
  misc_feature: GYAE6OF02JEGAK.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtccagtgtgagtgcgaggtggtggagtcgtggggagtccgttaggtaaacgtccgtcgggggtccttagacgttctccgtgtggtcggtcctacgtggtacttctactttacgagttaactggcgtggagtggtgttacgggtccgccgtaggtccgtaccggagggaacggggtcgtggtaggtgggttacggtacgtttaacgaaaaagtaaagtggtagtagtaagaagtaaaagtagaacgtacggtgaccgtaaccggtaggtaaaacggagtaactacgaactacgtactacgaaagacgtaataacttaaaccgaaaggtaccggttattaagtacgaactaaaagtcggtaaactacgtactaaacggaaacgtaacgaaccgtaacgacgtcgtttaaacgtattaccgacgtaaacctaacgtacgtaacgttaacgtaacgttacgaaccgtaacgtacggtaacggtaaaggtacgtaacgttattacggtttacgtttagacgtttaaggtcccggtacgggaaccgtaacgggtactacggttcggg

SEQ ID NO: 114775 - DNA, 723 bp, Homo sapiens
  misc_feature: GYAE6OF02HQU4P.15.86.H09.1.454.CMB.1.raw
  modified_base (268)..(268): a, c, t, g, unknown or other
  misc_feature (268)..(268): n is a, c, g, or t
  modified_base (382)..(382): a, c, t, g, unknown or other
  misc_feature (382)..(382): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggnttctactttcagtaatggctggatgagttgggtccgcaggctccgagggaggggctggagtgggttggacgtttacaaaagtaaaatgagtggtagaagaaatagacgtacggngacgaacccgtaggaaacggaagacgttacacctaactctaacaagtaagaattaaattaaccgaaaaaacggtacggttaagttacgttttagaacgtaaaagtagaaacgacgacccgttaaggaaaaacccggtaggaaactaccgaacgtcccgttaaccttaagtttaaccgtacgttaaccaacgtacgtaacgtttacgggaaaggttcgaacctaggtaccgtaaccggtaaagggtaccgggtaacttaacggttcggttacgttttacggagtttaacgttccgggttacgggggaaccccgtaacggggtaccgtaaaggtttcccgggg

SEQ ID NO: 114776 - DNA, 683 bp, Homo sapiens
  misc_feature: GYAE6OF02I5O7N.15.86.H09.1.454.CMB.1.raw
  modified_base (349)..(349): a, c, t, g, unknown or other
  misc_feature (349)..(349): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttcgggtccgccgaggctccgagggaacgggcgtggaggtgggttggacggtttanaaaagtaaaatgagtggtagaagaaatagaacgtacggtagacgacccgtagaaacggaagactcaccgatcacgaagagtaataacttacgaaaaacggtcggttattaatttagactaaatagaaacacgtcgtaacgaaaaccggagaaccacgaacgtcccgtacttaacttaccgttacgaacctaaccgtaagttacgttacgggaaaggttcgacgtaacgttaccggaaaccgtaagggacgggtaacttagttacggtacctttttagaacgttacggtccggtaccggggaaccccgtaaggggtaaccctaaggttaccgggg

SEQ ID NO: 114777 - DNA, 636 bp, Homo sapiens
  misc_feature: GYAE6OF02GLJD4.15.86.H09.1.454.CMB.1.raw
  modified_base (442)..(442): a, c, t, g, unknown or other
  misc_feature (442)..(442): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagttaatggctggatggtagttgggtccgccaggcctccgaggggaaggggctgggagtgggttggtacgtttacaaaagtaaaatgagtggtagaagaaaatagactacggtgcacccggtagaaaggagacttacacctatcacaagagaataataacaaaacgngtagttatttagactaaatgaacacgacctaaggaaaacccgagaacaccagccgtactaattacgtatacccacgaagtcgtttaacggaagttacgcaacgttacgaaggttaaacgggacggacttaagttcggtacttttagattacggttcggtaccggggacccggtaagggacctaaggttccgggg

SEQ ID NO: 114778 - DNA, 683 bp, Homo sapiens
  misc_feature: GYAE6OF02F035U.15.86.H09.1.454.CMB.1.raw
  modified_base (464)..(464): a, c, t, g, unknown or other
  misc_feature (464)..(464): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgaggttcgggtcccgccaggcctccgaggggaaggggctggaggtgggttggacgtttacaaaaagtaaaaatgagtggtagaagaaaatagactacggtgcaccgtagaaaggagaattcacatcacaaagagaataacttaacaaaacgtacggttagttaatttagaanaaaagtagaaacacggacctaaggaaaaacccgacggaaaccaccgaacggtccctacgttaatttaacctacgtaacccaacgtaacgtacgttacgggtaaatacgacgtaagtaacggaaccggtaaaggaacggttacgtaagttacgggttactttttaggaacttacgttaccggttaccggggacccggaaggggtacccgtaagttccggg

SEQ ID NO: 114779 - DNA, 715 bp, Homo sapiens
  misc_feature: GYAE6OF02H958H.15.86.H09.1.454.CMB.1.raw
  modified_base (417)..(417): a, c, t, g, unknown or other
  misc_feature (417)..(417): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtaaagtgcaggtggtggagtcgtgggggagccttaggtaaacgccgtggggggtccccttagaggttcctccgtgtgtggcctcgtggattcactttcagtaatggctggatgaggtggtccgcaggctcgagggagggctggagtgggttaggacgtttacaaaagtaaaagtgataggtagaaagtaaaactagaacgtacggtagaccgtaaccgtaggaaaaggtaanacgttacgaacctatacctacaagagtaattaacttaacgaaaaacggtcggtaacgttaattttacggaactaaaagttagaaacgtaagtacctaaaggaaaaccgaggaacctaacgacgtacgtactaagttactacggtaaccacgaagtagttacggaacgttgaacgtaagtaccggtaacgttaaaacgggcggtaaccgtaagttaccgtttacgttttaacggaactttcggtaaccggtacgggggtaacccctaaggggtaaccctaaggtttacggttaacccgg

SEQ ID NO: 114780 - DNA, 687 bp, Homo sapiens
  misc_feature: GYAE6OF02GFTI2.15.86.H09.1.454.CMB.1.raw
  modified_base (246)..(246): a, c, t, g, unknown or other
  misc_feature (246)..(246): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagngtctcctgtgtggctctggatctactttcagtaatggctggatgagttgggtccgccgaggcctccgagggaaggggctagggagtgggttgggtacgtttacgaaaagttaaaatggatgggtagtaagaaaactagacgttaggcgacacccggtagaaaggaagacgttacacctagtacctacgaagagtaacgtaattaccgaaaaagtcggttagttattaggaactaaagtnaaccganacccgtaaaggaaaccgaggtaaccacgaacggtcctaacttagttacctcggtaacccacggtataacgtttccgggaaagtcgaaccgttagaccgggtaaccggtaaaggtcggaacggttaacttggttaacgttttacgtagttacggtttcggaccggggtaaccccgagggtaacctagggttcccgg

SEQ ID NO: 114781 - DNA, 926 bp, Homo sapiens
  misc_feature: GYAE6OF02HXU1Q.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagtcgggctgagctgggttttccttgctgctatcttaaaggtgtccagtgtgaagtgcagggtggtggtagtcgtgggggagtccgttagggtaaacgtccggtacgggggttcccttaggtacggtccgttccgttggtcgggtcgggtccttcgtcggtacttacgtaccttttacaacggttaacgttagggtctacgggtagtcggtacggttacggggttcccggaccgtaacgggtccgtacccggaagggggaagggggtcccggtagggggtagggttacgggggttacggggttaacggtttaaaccggtaaaaaacgggttaaaaacgtttagggtaacggtttagggtaggaaaaccgtaaaaaggttaacggtaaccggttaaccggttaccggaaccgttaaccccgggtaagggaaaacgggtaaaacggttacgtttaaccgaaccgttaacgttaccgtaacggtaaacgtaaggtaaactttaaacggttaaccgaaaaaacgggtttcgttacggtttaatttaccgggaactaaacgttacggaaaccgtacgtaccgttaacggaaacccggttaacggactaacgaccggtccgttacgtaacgtaaccgttcgacctacgtaagtacggttaccgaagttccgtaacgtaggtaccgtaacggtaacgggtacgttacgtaacggttactttcggtttaataacgggtttaccggttaaccgggtaccggggtaaccccggtaaggggttacccgttaaggttcccggg

SEQ ID NO: 114782 - DNA, 721 bp, Homo sapiens
  misc_feature: GYAE6OF02GMAQ2.15.86.H09.1.454.CMB.1.raw
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
  modified_base (494)..(494): a, c, t, g, unknown or other
  misc_feature (494)..(494): n is a, c, g, or t
  modified_base (675)..(675): a, c, t, g, unknown or other
  misc_feature (675)..(675): n is a, c, g, or t
tcagtctacgtagccacgaccggtgctcgatttagtgctatagacttgggtttggggggggagaggagcccccagccttgggatcccccaagtgttttcattcagtgatcaggactgaacacagaggactcaccatggagttcgggctgagctgggttttccttgctgctatacgttaaaaggtgtcctagtgtgaagtgcgaggtggtggagtcgtggggagtccgttaggtaaaggccggtgggggtcccttagngtctcctgtgtcggtcctcgtggtattctactttnagtaatggcgtgagtggtaggttcgggtcccgaccgaggtccgtaccggaagggggaacggggcggtaggggtggttggggttagggtaacggtttaaacgaaaaaaggttaaaagtaggtaagtaggtaggtaaagaaagtagaacgtacggtagtaccgtaaccggtaggaaaggagtaactcactactactacgaaganaataagtaacgaaaacgtcgttagttattagactaaagacgtaacgatacctaaacggaaacgaggaaccaacccaccggtaccttacgttaacttaccgtacctaaccgacttaagacgttaagaacgtgacgtacgtacggtacggaaagggtacgtcgttagttacgttcgttttaanagtttacggtcgggtaccgggaccgacgggtaacgtacggttcggg

SEQ ID NO: 114783 - DNA, 741 bp, Homo sapiens
  misc_feature: GYAE6OF02HYH1C.15.86.H09.1.454.CMB.1.raw
  modified_base (610)..(610): a, c, t, g, unknown or other
  misc_feature (610)..(610): n is a, c, g, or t
  modified_base (666)..(666): a, c, t, g, unknown or other
  misc_feature (666)..(666): n is a, c, g, or t
tcagtctacgtagccacgaccggtgctcgatttagtgctatagacttgggtttggggggggagaggagccccagccttgggatccccaagtgtttcattcagtgatcaggactgaacacagaggactcaccatggagttcgggctgagcctgggttttccttgctgctatacgttaaaggtgtccagtgtgtaagtgcgtaggtggtaggagtcgtgggggagtccgtttagggtaaacggcccggttcggggggtaccccttaggtacggttccttccgtggttcggtcgggtcccttcgtagggtacttccgtacttttcgaagttaagtggctggagtggtaggttcgggtcccaccgtacggcctaccgggagggggaaggggcgtggggtaggttggggttaggtacgttttaacgaaaaagttaaaagtgtaagtagggtagaaaagtaaagtacggaacgtacggtcgtaccgaaccggtaaggaaagggtaatacgttaccacctatacgtaacgaagtagtaacgttaactaaaccggaaaacggtggtttagttaatttacgaataaagtagaacctggtaacctaaaggaaaacccggngaacctacgacgtccgtacttaattcccgtagtaacccagtagtaccgtaggtaancgacgtagtacggtaagaaggtcgacttagtcgtacgtttagacttacggtcggacggtaccgaggtacaggtcg

SEQ ID NO: 114784 - DNA, 760 bp, Homo sapiens
  misc_feature: GYAE6OF02HPTEF.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaagtgtccagtgtgaagtgcaggtggtggagtcgtggggagccttggtaaacgcggtgggggtcccttagacgtctcctgtgtcggcctctggattcactttcagtaatgcgtggatagaggttgggcccgacgaggcctccgaggggaaggggcgtagggaggtggggttaggtaacgtttaacgaaaaagttaaaagtagaagtggtaagtaaagaaaaagtagaacgtacggtcgaccgaacccgtaagaaaacggataactaccaacctaataccagaagaagtaattaaacgtaacaaaaaacggtacggtagttaacgttataacgaaaagttagaaactaacggaccttaaacggaaaacccggtaagaaccgaacgaacggtacctaccgttaacttacctaacgttaaacccaactaacgtaacgttacgggtaaactcggtaaacctagttaaccggaacggttaaaaacgggtacggaaacccgtttaagtacggttaacttttaacggaacttttacggttaccgggtaccgggttaaccccgggaaaaggttacccggtaaagttcccgggg

SEQ ID NO: 114785 - DNA, 589 bp, Homo sapiens
  misc_feature: GYAE6OF02GN3YI.15.86.H09.1.454.CMB.1.raw
  modified_base (217)..(217): a, c, t, g, unknown or other
  misc_feature (217)..(217): n is a, c, g, or t
  modified_base (414)..(414): a, c, t, g, unknown or other
  misc_feature (414)..(414): n is a, c, g, or t
  modified_base (495)..(495): a, c, t, g, unknown or other
  misc_feature (495)..(495): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggganccttggtaaagcctggggggtcccttagagtctcctgtgtggcctctggattcactttcagtaatggctggatgagttgggtccgcaggctccgagggaaggggctgggagtgggttggacgtttcgaaaagtaaaatgatggtagagaaatagactacggtgacaccgtagaaaggagattacacatctacaaganataatacaaaacgtgtagtattgactaaatgaacagacctagaaaaccgagaaccacagccgtatattaccgtagtaccanaagtgttacggaagtgacagtacgacggtaaggaggacttagtcgtaccttttgaacttacgtcggttcggggacccaagggtacagttccggg

SEQ ID NO: 114786 - DNA, 706 bp, Homo sapiens
  misc_feature: GYAE6OF02G63CM.15.86.H09.1.454.CMB.1.raw
  modified_base (208)..(208): a, c, t, g, unknown or other
  misc_feature (208)..(208): n is a, c, g, or t
  modified_base (335)..(335): a, c, t, g, unknown or other
  misc_feature (335)..(335): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (539)..(539): a, c, t, g, unknown or other
  misc_feature (539)..(539): n is a, c, g, or t
tcagtctacgtagccacgaccggtgctcgatttagtgctatagacttgggtttggggggggaggagggaggccccagccttgggatccccaagtgttttcattcagtgatcaggactgaacacagaggactcaccatggagttcgggctggagctgggttttccttgctgctatcttaaaaggtgtccagtgtgaagtgcagggtggnggagtcgtgggggagtccgttggtaaagccgtcgggggtcccttaggacgtctcctgtggtcggccttcgtggtattctacgttttcaaggttaatggactgggagttacgaggtttcgggggtccncccgtagggccttccggaagggggacgggcgtgggaggttggggtggtacggtttaacaaaagtaaaatgagtggtagaacgaaataacggatacggtagaccgaaccggtagaaaaggagactacaccatcacgaagaagactaaagttaaccaaaaggtcggtaatatttgaactaangaacanactaagaaaccgacgtanaacgacgtacctagtaactacgtaacgtacgtaaccaagtaacgttaacggaagttaacgcgtaagtaccggtaaacggtaaaggtacgacggtaatttaccgtccggtttataacgttagttaccggggaccgggtttaccgaccgggtaacggtagttaaccggg

SEQ ID NO: 114787 - DNA, 644 bp, Homo sapiens
  misc_feature: GYAE6OF02FLBO8.15.86.H09.1.454.CMB.1.raw
  modified_base (353)..(353): a, c, t, g, unknown or other
  misc_feature (353)..(353): n is a, c, g, or t
  modified_base (475)..(475): a, c, t, g, unknown or other
  misc_feature (475)..(475): n is a, c, g, or t
  modified_base (515)..(515): a, c, t, g, unknown or other
  misc_feature (515)..(515): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggccgccaggctccgagggagggctggagtgggttgacgttacaaaagtaaatgatggngaagaaatgactaggtgcaccgtaggaaagaagattacactatctacaagacgaataactaccgaaaaacggcggttagttaatttagacaaaattcggaaacagtacctaaggaaaaccgnggaccaacgacgtacccgtataccttaatcggtaacccanaagtagttaccgggtaagtgaccgtaactacggtaacggtaaagggtacggtaacgtagttacggttaccgttttagaatttacgtaccgggttaccggggaccccgagggtaccgtaaggttccgggg

SEQ ID NO: 114788 - DNA, 672 bp, Homo sapiens
  misc_feature: GYAE6OF02FSX9P.15.86.H09.1.454.CMB.1.raw
  modified_base (345)..(345): a, c, t, g, unknown or other
  misc_feature (345)..(345): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctctgtgtggcctctggattcactttcagtaatggctggatgtagttgggtccgccgaggctccgaggggagggctggagtgggttgacgtttanaaaagtaaaatgatggtagaagaaagtagacgtacggtgacaccggtagaaacggagtactacgactataccgtacaagagtaattaaacgtaacaaaaacggtcggttagtaagttttacgaataaaactagaaacacgacctaaacgggaaaaacccgaggaacaacgacgtacccgtacttaactttaaccgtacgttaacccaacgtaagtaacgtttacgggaaagtcgactacgtacgaaggtaaaggacggtaactaggtcgttacgttttaagatttacggtccggtacgggggaccccaagggtacctaagttcgggg

SEQ ID NO: 114789 - DNA, 601 bp, Homo sapiens
  misc_feature: GYAE6OF02JOY6M.15.86.H09.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
  modified_base (596)..(596): a, c, t, g, unknown or other
  misc_feature (596)..(596): n is a, c, g, or t
tcagtctacgtagccacgaccggtgctcgatttagtgctatagacttgggtttggggttccgactgggcagtctcgaatagagctcttggaagtccctccaaccatggcctgggtctccttctacctactgcccttcattttctccacaggtctctgtgctctgcctgtgctgactcagcccccgtctgctatctgccttncgtgggancctgatccaagtctccaccgtgctacccctaagtgtggactcacgttacgaacccaccacctatccgaaagtggtaanccaacagaacgaccgacggggtaccttacccccgagtataattaacgtagaaagtttacggaatggatgacganccacaccggacggggtacgacgtccccgagtccgntccagtcggactctagtcgnggtcgngcccatccgacaccnctacctccgtaactccagttcgacgacgtaacgtggcgcgtaggtattcggaccttaaggttacgggagtagtcgtaccagtaacacggtagtacctgggacctaggacggttcgggtggttcggacggaacggacgactcgaccgtacgccgttacgnaccgg

SEQ ID NO: 114790 - DNA, 669 bp, Homo sapiens
  misc_feature: GYAE6OF02JFW1V.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgaggttgggtcccgccgaggcctccgaggggaggggctgggaggtgggttggacgtttacgaaaaagtaaaatgtagtagggtagaagtaaaagtagaacgtacggtgaccgtaccgtaggaaaggaagacttacgaccaatcacgaagagaacttaagtaacgaaaaacggtcgtagttacttagaactaaagtagaactacggacccttaaggaaaaccgtaggaccaaccgacgtacccgttacttaacttaccgtacgttaacccgaagtagttaacgttacggaagttcgactaagtccgaacggtaaggtacggtccttagtgttacctttagaattcgtcggtcgggaacccagggtacctaaggttccgg

SEQ ID NO: 114791 - DNA, 700 bp, Homo sapiens
  misc_feature: GYAE6OF02FKF27.15.86.H09.1.454.CMB.1.raw
  modified_base (322)..(322): a, c, t, g, unknown or other
  misc_feature (322)..(322): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttgggctgagctgggttttcctgctgctatcttaaaggtgtccagtgtgaagtgcaggtggtggagtctggggagccttggtaaagccgtgggggtcccttagagtctccgtgtgtggcctctggattcactttcagtatggctggatgtaggttgggccgcaggctccgagggaagggctaggngtgggttggacgttttacaaaaggttaaaatgtagtgggtgaagtaaaatagtaacgtacggtagaccgtacccggtagaaagggaagtacgtacgaaccatctacgaagtagtaactaaacgtttacaaaaacggtacgttagtaacgtttgacgaaagttacgaaccgtagaccgttaacggtaaaaccggacggtaaccaaccgtaagaccccgtttataacttttaacccgtacgttaacccagtaacgtacgtttacgggaacttacgcctagttacggtagttaaaagggcggtaacttacgtaggtttaaccgttttagtaagtacgtttaccggtaccggggtacccgtagggaaccgtaagttcccggg

SEQ ID NO: 114792 - DNA, 782 bp, Homo sapiens
  misc_feature: GYAE6OF02FW3S2.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttaggtaacgccgtgggggtcccttagacgtcctcctgtgtggtcctctggtattcactttcagtagtggctaggatggtaggttcgggtcccgccgaggcctcgaggggagggcgtaggaggtgggttggtacgtttacgaaaagtaaagtgtagtggtagaagtaaaatgtaacgtacggtagaccgaaccggtaggaaaaggacgtaacttaccgaacctaactctaacgaaagtaacgtaacttaacttaaaccggaaaaaccggtacggtttaagttaacgttttagaacgtaaagtacgaaacctacgtaccgtaaacggtaaaaccggcgtaaacaaccgtacgtcccgttaactaaccgtttactacgttaacccaagtaacgttaacgttacgggtaacgtacggtaaccgtaccgtaacggtaaccggtaaaagggtccgggtaacttttaaccgttacgggttttacgttttaggtaacccgtttacgggttaccggttacccggggggtaacccccgttaacgggggaccttaacgggtttacccggg

SEQ ID NO: 114793 - DNA, 744 bp, Homo sapiens
  misc_feature: GYAE6OF02IDQMK.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagtccgttagggtaaaacggccgtcggggggttcccttaggagttcctccgtggtggtcggtcctcgtggtattctaactttcagtaatggctggattggaggttcgggtccgccgaggcctccggaaggggacggggtctagggtaggttggggttggtacgttttaacgaaaaagttaaaactgtaagtggtaagaaagtaaaataggaacgtacggtacgaccgtaccgtaaggaaaggaagtaactccgaacctatactacgaaagataactaacttaaaccgaaaaggttacggttagttaactttagaacaaataccgaaactcgacctaaacggaaaaccgtgaacaacgtacggcccttacgttaaacttaccgaacgtaccaacgtaacggtaacgttacgggaaactcgtaacacgttaacggtaagggaacggtcggtacttacggtacgttacgtttacaaggttacgtccgggttaaccgggcccgtaaagggtacccttagggtaccccggg

SEQ ID NO: 114794 - DNA, 763 bp, Homo sapiens
  misc_feature: GYAE6OF02JJNHK.15.86.H09.1.454.CMB.1.raw
  modified_base (219)..(219): a, c, t, g, unknown or other
  misc_feature (219)..(219): n is a, c, g, or t
tcagtctacgtagccacgaccggtgctcgatttagtgctatagacttgggtttgggggggaggagggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggganccgttggtaaagccgttgggggtcccttagaggtcctccgtgtgtggcctctggtattctacgtttcagttaatggctggatgtaggttgggccgccgaggcctaccggaagggaggggcgtagggaggttggggttcggtacggttttacgaaaaagttaaaacgttggaattacgggtaggaagaaaaagtggaacgtacggtagcctaaccggaggaaaaggagtaacttcgaacctacgttactacgaaaggtaagtaaactaaactaacgaaaaacgtacgggttaacgttaagtttacgaacgtaaagtacggaaacgtaccgaccgtaaagaaaacccggtaggaactacaacgtacctacgttaaacttacgttaacggtaaccctaagtaacgttaacgttacggaaacggtacaccgtaacgttaccggtaacggtaaacgggtacgggtaaccttaagttacggttacgttttacggtaattacgttaccgggacgggttaaccccggaagggtaaccctaagggttcccggg

SEQ ID NO: 114795 - DNA, 754 bp, Homo sapiens
  misc_feature: GYAE6OF02IJC10.15.86.H09.1.454.CMB.1.raw
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggagccgttaggtaaagccgtgggggtcccttagagtcctcctgtgtgcctctggatcacttcagtaatggctggatgtaggttcgggtccgcgaggctccggaggggaggggcgtggaggttgggttggtacgtttacgaaaaagtaaagtgtaagtggtagaagtaaaagtagaacgtacggtcgaccgtaaccggtaggaaaaggaagtacttaccgaacctatactaacgaaagagtaaattaacgtaaaccgaaaaaacggtcggttagttaagtttacgaactaaagtacgaaaccacgtacccgtaaaggaaaaccgtaggaaccacgaccgtacccgtaacttaagtttacctaccgtaaaccctagtaacggttacgtttaaccgggtaaagtcgtaaccgaacggttacccgggtaaaggttaaaacgggcggtaacgtttaattcggtttaaccgtttttaggaacgtttacggtcccgggttacccgggggaacccgtaaggggttaaaccctgggttaccgggg

SEQ ID NO: 114796 - DNA, 782 bp, Homo sapiens
  misc_feature: GYAE6OF02I8EZQ.15.86.H09.1.454.CMB.1.raw
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaagccgtgggggtccttaggagtctcctgtgtgcctctggattcacttcagtatgcgtggatgagttggtccncaggcncgagggagggctggnggtggtaggtacgttacaaaagtaaaatgaagtggtagaagaaagtacgtacgacggtagacgacccgtaagaaaggtaacgtagttaccaactactacgtaacgaaacgtaagtaacttaaacgttaaaccgaaaaacggttacgggttacgtttaaagttttaacgaaacgtaaaagtaacggaaaaccgtaacggtaacccgtaaacggtaaaaaccgggaacggaaaaccgtaccgaaaccgggttacccgttaacttaaacgttttaaaccgtacccggttaaacccgtaaaccgtaaaggttaacgttaaccggggtaaatacgggaaccttacgggtaaccggtaaacgggtaaaacggtacggtaacgttaacgttaggttaacgttttagtaacggttacgttaccgggttacccgggaacccggttaacggggaactacgggtttaccggg

SEQ ID NO: 114797 - DNA, 645 bp, Homo sapiens
  misc_feature: GYAE6OF02F3HF2.15.86.H09.1.454.CMB.1.raw
  modified_base (217)..(217): a, c, t, g, unknown or other
  misc_feature (217)..(217): n is a, c, g, or t
  modified_base (468)..(468): a, c, t, g, unknown or other
  misc_feature (468)..(468): n is a, c, g, or t
tcagtctacgtagccacgaccggtgctcgatttagtgctatagacttgggtttggggggaggaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtctggggganccttggtaaagcctgggggtcccttagagtctcctgtgtggcctctggattcactttcagtaatggctggatgagttgggtccgccaggctccagggagggctggagtgggtgacgtttcaaaagtaaaatgatggtagagaaactgactacggtgcaccgtgaaaggagattcaccatctacaagagataatttacgaaaaacgtcggtagtaatttgactaaaattggaacagcccttagaaaacccgnggaacacgaagtccgttataacgtttactagttacccgatacggtaatttaccgggaaagttcggacctaagttccggacggttaaacgggacggtccttaaagttcggtcctttttttaggacttttaacttcggtttaccggggggcccctaagggggtaccctaagttccgggg

SEQ ID NO: 114798 - DNA, 675 bp, Homo sapiens
  misc_feature: GYAE6OF02H1XUH.15.86.H09.1.454.CMB.1.raw
  modified_base (260)..(260): a, c, t, g, unknown or other
  misc_feature (260)..(260): n is a, c, g, or t
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaagccgtgggggtccttagagtctctgtgtggcctntggattcactttcagtaatggctggatgaggttcgggccgccaggctccgaggggagggctgggaggtgggttggacgtttanaaaagtaaaatgagtggtagaagaaagtagacgtacggngaccgtaccggtagaaaggagattacactatcacgaagagtaataaacttaacgaaaacgtacggttagttattagaactaaagtacgaaacacggtaccctaaaggtaaaaacccggagaaccaacgaccgtaccgtaccttaagttaccgtacgtaaacccgagtaacggtacgttaacgggaacgttcgacctaaggtacccgtaaggtaaaaggcgggttaactaaggttacgttcgtttagacgttacgtaccgggtaccgggtacccgaagggtactaaggttcggg

SEQ ID NO: 114799 - DNA, 812 bp, Homo sapiens
  misc_feature: GYAE6OF02FTPL5.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaaggccgtggggggtcccttagagttcctcctgtgtggcctcgtggacttctactttcagtaatggctggatgtaggttcgggtcccgccgaggcctccgaggggaacggggcgtgggaggttggggttaggtaccggtttaacgaaaaaaggttaaaatggtaacgttagggtagaaaggtaaaagtacggtaacgttacggtacgaccgtacccggtaggaaaacggaagtacttaccgaacctaagttcctaacgaaaggtaacgtaattaaacgttaacgaaaaaacgggtacgggttattaacgttttacgaaactaaaatcggaaaaccgtaacggaccccgttaaaggaaaaacccggacggtaaccgaaccgaacggtaccccggttaacttaacgtttaccgagttaaacccctaagacggttaacgtttaccggtaaagttcgaacgtaacgttaaccggtaacgggttaaaacggtacgggtacttaacggttacggttaccgttttttagaaacgtttcggttaccgggttacccgggggtaccccgtaaggggtaccgtaaggtttcccgggg

SEQ ID NO: 114800 - DNA, 665 bp, Homo sapiens
  misc_feature: GYAE6OF02JULZY.15.86.H09.1.454.CMB.1.raw
  modified_base (481)..(481): a, c, t, g, unknown or other
  misc_feature (481)..(481): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccttggtaaagccgtgggggtcccttagagtcctccgtgtgtcggccttcgtggtattctactttcagtaatggctgagtgtaggttcgggtccgccaggcctccgaggggaagggcgtaggaggtgggttaggtacgtttaacgaaaaggttaaaactgagtaggtagaagtaaaagtagaacgtacgtagaccgaccggtaaggaaagaagactacactatctaacaagataataataacgaaacgtacggttatagttanactaaatagaacagacctaaggaaaacctagaaccacgacgaccgtactaattacacgtaaccagtaggtacttaacggacgtacgactaacgtaccgaaggtaaacggcgtaactaacgtttacgtacgtttagaacgttagttacccggacgggtaacccgtgggtaaaccgtcgttacggg

SEQ ID NO: 114801 - DNA, 727 bp, Homo sapiens
  misc_feature: GYAE6OF02GWSDX.15.86.H09.1.454.CMB.1.raw
  modified_base (246)..(246): a, c, t, g, unknown or other
  misc_feature (246)..(246): n is a, c, g, or t
  modified_base (679)..(679): a, c, t, g, unknown or other
  misc_feature (679)..(679): n is a, c, g, or t
tcagtctacgtagccacgaccggtgctcgatttagtgctatagacttggggtttggggggaagaggaagactgacggtcccttagagtctcctgtgtggcctctggattcactttcagtaatggctggatgagttgggtccgccaggctccgagggaaggggctggagtgggttggacgtttcaaaagtaaaatgatggtgaagaaaatagactacggtgcacccgtgaaaggagattcacatctnaagagataattacaaaaacgcggtgtatttgacaaatgaacagcctagaaaaccgaggacacagccgtctattactgtaccacagagttcggaagtggcaatcggaacggtaaaagggacggtactagttcgtcgttttagaattaatccggtacgggggacccgaggggaactaaggttcgggtacgtcgtccttctttcgaacgtccctacccgaaccgaacgggcccctaagtcccggttaccctttcccccggtggaccctaccccgttcccgaccaacggacgtcccgaaccgtcgggtacgggggctacggcggtacccgggtcccgtggggcctcggtacccggtacggtaccgtaacggtaaccctttacccgttaccggtaccgttaaccggttacggaccgttaggggaccggtacccggggnggttacccggggaacgtaaccgggaccggacgtacgtacggcgtacag

SEQ ID NO: 114802 - DNA, 801 bp, Homo sapiens
  misc_feature: GYAE6OF02JNLHL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgcgtgctatacttaaaaggtgtccagtgtgaagtgcgaggtggtggagtcgtggggagccgttaggtaaacgccgtcgggggtcccttagagtcgtccgtgtgtcggcctcgtggtacttctactttcgagtagtcggctggagtcgtaggttcggtccgcgtacggcgtccggagggacgggcgtggtaggtgggttacggtacggtttaacgtaaaaggttaaaacgtagtaggtaggtagtaaaggtaaaataacggtaacgtacggtacgaccgtaaccggtaagtaaaaggaagtaacgtacgtaacctacgtaacgtaacgaaagtaacgtaacgttaaacgttaacccgaaaaacggtacggtttacgtttaaagtttacgaaaacgttaaacgtaggaaacccgtaacgtacccggtaaaaacggaaaaccgaaccggtaaaccaacggaccgttaacccgtttagtttaaccgttaaccgtaaccgtaaaccgacgtaaacggttacgttaaccggaagttaccggaccgtaacgtaaacggttacggtaaaggtacggtacttacgttagttaaccgttagaacgttaccgttcgggaaccgggtcccgtaaggtaccgtcggtacggg

SEQ ID NO: 114803 - DNA, 887 bp, Homo sapiens
  misc_feature: GYAE6OF02HS1I7.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaagccgtgggggttcctagacgtctcgtgtggtcggaccttcgtgtattctactttcagtagtggactggatgtagttgggtccgcgacggctccggaaggggacgggtgtcgggtagggtgggttcggtaacgttttaacgaaaaggttaaaagtagtaggttacgggttaaggaaacgtaaaaaggttacgaacgttacgggtcggaaccctaaccgggttaaaggaaaagggaacggttaacttacccgaaacgtaagttacctaaacggtaacggaaagttaacgtttaaaacgtaaaaccggtaaaaaccggtgggtttaaacggttttaaattaccgtaaataaaacggtacggttaaaaccggaacgttaaacccgttaaaccggaaaaaaccgggtacccggtaaagtaaacccggtaacgtaaccccgtttaagtttaaaccggttaacccgtaacggaacccgtaaccgttaaaggtacggtttaacccggtaaagtaccggtaaccttaaaccgggtaacggtaaaccgggtaaagggttaccggtaacgtttaggtttacgttaaacggttttccggttaaaagttacccgacgggggttaccccgggttaaacccgggaagggttaaccctaggggtttaccccgggg

SEQ ID NO: 114804 - DNA, 663 bp, Homo sapiens
  misc_feature: GYAE6OF02J125G.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgtgggttttccttgctgctatcttaaaaggtgtccagtgtgaagtgcaggtggtggaggtcgtgggggagccgttggtaaagccgtcgggggtcccttagagtcctcctgtgtaggcctgtggtattcgtactttcgaagtaatggtcgtggatggtaggttcgggtaccgccgaggctccgaggggtaaggggcgtggaggtgggtacggtacgttaacgaaaagtaaaatggtagtggtagaagaaatagacgtacggtgaccgtaccgtagaaaggtagtatacactatacgtacaagtaagaattaactaaacgaaacgtacggttagttaactttagacgtaaaatacggaaactacgaaccgtaaggaaaacccgtagaaccaactaacggtcctaacttaacgttacaacgtacccagaattacgacggtaatcgacagtacgtagaaggtacgtctagttgtagttttgattacgtcggaccgggtacaaggtacgtattccggg

SEQ ID NO: 114805 - DNA, 821 bp, Homo sapiens
  misc_feature: GYAE6OF02FG2L2.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtgggggagccgttggtaaacgccgtgggggtccccttagagtcctccgtgtgtggcctctggacttcactttcagtaatggctggatggagttgggtcccgccaggcctcccgaggggacgggtcgtggaggttgggttgtacgtttaacgaaaaaggttaaaactggtaagtcgggtagaaagtaaaaacgtaggtaaccgtacggtggacccgaccccgggtaaggaaaacgggtaacgtacttaccgaacctaactcgtaccaaacggtaagtaactaaaaccgtttaaccgaaaaaaccggtcgggtttaacgttaacgtttaacgaaccctaaaagtaacgaaacccaacggtaccccgtaaaggaaaaacccggtaccgaaaccgaaccgtaccggtaccccgtttacgttaaacgtttacccgtaacggtaacccctaacgtaaacggttaccgtttaaccgggtaagttaccgactaaacggttacccggaaacgggtaaacgggtacgggtaacgttaagttacggtttaaccgttttagaacggtttaacggttcccggtaaccgggggtaccccgaaggggtaccttagggttacccggg

SEQ ID NO: 114806 - DNA, 598 bp, Homo sapiens
  misc_feature: GYAE6OF02F020X.15.86.H09.1.454.CMB.1.raw
  modified_base (265)..(265): a, c, t, g, unknown or other
  misc_feature (265)..(265): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (484)..(484): a, c, t, g, unknown or other
  misc_feature (484)..(484): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctntggattcactttcagtaatggctggatgagttgggtccgcgaggctccgaggggaaggggctgggagtggggttggacgtttacaaaaggtaaaatgatggtagaagaaaatagactacggtgacaaccgtaggaaaggagattacaccatctacaaganaataattacgaaaacgnggttatatttgacaagtagaacagcctaagaaaccgagacanacgcctactatactacgtaccacagtagttacggaatcgactacgacgtaggtaaggaggcttagttgttctttgaattcgtcgttccggggacccagggtactaaggttcggg

SEQ ID NO: 114807 - DNA, 678 bp, Homo sapiens
  misc_feature: GYAE6OF02F6WUQ.15.86.H09.1.454.CMB.1.raw
  modified_base (400)..(400): a, c, t, g, unknown or other
  misc_feature (400)..(400): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgaggggaaggggctgggaggtgggttggtacgtttacgaaaagtaaaatgagtggtagaagaaaatagaacgtacggtgccaccggngaaaggaagattcaccatctacgaaagagaataacgttacaaaaacgtacggtagtaatttgacaaatagaaacacgaccctaaggaaaaaccgaggaacaacgacgtacccgttacttaacgtttaacctacgttaaacccaactaaggtaacgtttaccgggaaagtcgacgtaacgtaccggtaacgtaaagggaggtaccttagttacgttcgtttttagaagtttacgttccggtaccgggggtaccccgaagggggtacctaaggttccggg

SEQ ID NO: 114808 - DNA, 622 bp, Homo sapiens
  misc_feature: GYAE6OF02H9ECE.15.86.H09.1.454.CMB.1.raw
  modified_base (326)..(326): a, c, t, g, unknown or other
  misc_feature (326)..(326): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcacctaagagtgagcatcgaacctacaccatcgaatggtactcaacagacgaccaagggaaacctcccccagtaatataatagaaagtttaagagtgatggnacgccaacaccgaaggggacggactccccgatcgcttcgatggctccngttcgngggctgaccgctaccncacctaatcctaccaacctcacgttcctagacgagtgacggtcgtgtagtactacctacgtcggtaggacgaagccggccaaacgtaacgtaagtgtaacgtcggaccgtaaagggttaccgggttggggttacggttaccggggaccgggttaaacgggaacccgacgggttccgtaacccgggttaaccccggtttaccggttaaccggggtcctaacccgggg

SEQ ID NO: 114809 - DNA, 630 bp, Homo sapiens
  misc_feature: GYAE6OF02FVOZW.15.86.H09.1.454.CMB.1.raw
  modified_base (354)..(354): a, c, t, g, unknown or other
  misc_feature (354)..(354): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtggggggtcccttagagtctcctgtcgtggcctctggattcactttcagtaatggctggatgagttcgggtccgccaggcctaccgaggggaagggcgtaggaggtgggttggacgtttanaaaagtaaaatgaagtggtagaagaaatagacgtacggtgcaaccgtagaaaggaagatacaccatactacaagtagaataataaccgaaaaacgtcggttaagttatttagactaaatagaacagacctaagaaaccgagaaccacgacgcctactattactacgtaccacgtagacgtttcggaagtcgagtagtacgagtaaaggcgggtacttaagtggttacttttagtacttacggtcggttacgggcccggtaaggacgtagtaccggg

SEQ ID NO: 114810 - DNA, 742 bp, Homo sapiens
  misc_feature: GYAE6OF02F4OLE.15.86.H09.1.454.CMB.1.raw
  modified_base (461)..(461): a, c, t, g, unknown or other
  misc_feature (461)..(461): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaaggtgtccagtgtgaagtgcgaggtggtggagtcgtgggggagccgttgggtaaacggccgtggggggtcccttaggcgtctccgtgtgtggcctcgtggtattcactttcagtaatggctggatgtaggttgggtccgccgaggcctccgaggggaaggggcgtgggaggtgggttcggtaacgtttaacgaaaaaggtaaaagtggataggtagaagtaaaatagacgtacggtagacctaaccggtaaggaaaggaagtacttaccgaacctaacttccgtanaaagaagtaacttaaattaaccgaaaaacgggtaggttacgtaagtttacgaactaaaagtaacggaaaccaccggaaaccccgaaaaccggtaggaaacctaaccggaagcccgttaacttacgttaaccgtacgtaacccaagtacgtaacgtttacgggaattcgacgttaacgacggtaacggttaagggacgtacgttagtacggtttcttttaaggagtttacgttcccgggacggggtaacccgtaagggtaccgttaggttccgggtacccgg

SEQ ID NO: 114811 - DNA, 797 bp, Homo sapiens
  misc_feature: GYAE6OF02JVH2B.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttccttgctgctatcttaaaaggtgtccagtcgtgaagtgcgaggtggtggagtcgtgggggacgccgttggtaaagccgtgggggtcccttagagtctccgtgtgtggcctcgtggatctacttcagttaagtcggacgtggactggtagttcgggtacgtcccaggtcctaccgaggggaacgggccgtaggaggtcgggttaggtaccggtttacgaaaaaggtaaaaagttgtaacgtagggtagaaaggtaaaagtagaaccgtacggtagaccgtaacccggtagtaaagggtaaacgactttacgaaccgtacttccgtaacgaaagaacggtaattaaacgttaaccgaaaaaccggttacgggttacgttaaaggttttacggtaaacgtaaaacgttacgaaaacgaaccgtacccggtaaacgtaaaaaccccgggaacgtaaccgtaaaccacgggttacccgtaacgttaatttaaacccggtaggtaaccctaaccgtaagggtacctttacggggaagtacgaccgtaaggttccgaaggttaaacggaccgtacgttaaaggtcggtttaacgtttacggtattacgttaccggtggggtaccccagggttaacctacgggtttccggg

SEQ ID NO: 114812 - DNA, 846 bp, Homo sapiens
  misc_feature: GYAE6OF02FWCBX.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttaggtaaacgccgttggggggtcccttaggagtccttcctggtgtggcctcgtggattctactttcagtaatcggctggatgtagttcgggtccgccgaggcctcgaaggggaacggggtctgggaggttggggttacggtacgtttaacgtaaaaaggtaaaagtgtaagtagggtaggaaagtaaaagtacggaaccgtacggttacgaccgtaaacccggtaggaaaaacgggtaagtaactttaccgaaacccgtataccgtaacgaaaaggtaacgtaaattaaacgtttaaccgaaaaaaacgggtcggttaagtttaaacgtttcgggaaactaaaagttacggaaaaccgtaacggtacccgttaaacggaaaaacccggaaggtaacccaacgtaaccggtacccgttattaaaccgtttaaccgtaacgtaacccgtaacgtaacgggtaacgttttaccgggaaacgttcgaacgttaacctacccgggttaaacggtaaaggggtacgggttaaccttaaggtttacggttaccgttttttaaggaaccgttttaggtacccggggttaccgggggtaccccgtaaggggtacccttaaagggttcccggg

SEQ ID NO: 114813 - DNA, 711 bp, Homo sapiens
  misc_feature: GYAE6OF02G8ILO.15.86.H09.1.454.CMB.1.raw
  modified_base (547)..(547): a, c, t, g, unknown or other
  misc_feature (547)..(547): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtgggggagccgttggtaaagccgtgggggtcccttagagtctcgtgtgtcggcctcgtggattctactttcagtaatggtctggatgtaggttcgggcccgccgaggtctccggaagggacggggcgtgggtaggtggggttggtacgtttacgaaaaagtaaaagtgagtaggtagaagaaaagtagtaacgtacggtagaccgtaaccggtaaggaaaaggaagtaactaccgtaacactactacgaaagaagtaattaaacgttaacgaaaaaccggtcggttaagtttaacttagaaacaaagtacaaccgtaagacctaaagggaaaacccgnggaaccaccgtacggacgttaaccttaacttaccgtacgtaacccgaagtaggtaacgttaccgggaacgtgaactacgtaacgaaggttaaagggcgtaacgttattggtacttttaggaattacgttccgggaccgggtacccgaaggtacgtacgtcgggg

SEQ ID NO: 114814 - DNA, 771 bp, Homo sapiens
  misc_feature: GYAE6OF02HRQJV.15.86.H09.1.454.CMB.1.raw
tcagtctacgtagccacgaccggtgctcgatttagtgctatagacttgggtttggggggggagaggagcccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtggggagccgttggtaagccgtgggggtcctagagtctcctgtgtcggcctcgtggtattctactttacgagttaagtggtactggatggtaggttcgggtcccgccgtacggtcgtcccggaaggggaacggggtcgtagggtagggttaggggttcgggtaacgtttaacgaaaaaggtaaaagtgaagtaggtagaaagtaaaataagaacgtaggtcgaccgtaaccgtaggaaaaggtaacgtagtaccgactactccgtaagaagtaagtaattaacgttaacgaaaaaccggtacgggttattaagtttacgaaactaaaacgttagaaacctacgtaacccgtaaaggaaaacccggacgaaccaaccgtaacgtacccgttaacttacgttaacccgttaaccgtaaccgtaaccgtaagtaaccggtttaccggaaagtcgtaacgtaacgtaaccggaacggttaaacgggacgtaactaggtttacggttaccttttaagacgtttacgtacgggccgggttacccgaagggtaccgtaggttccggg

SEQ ID NO: 114815 - DNA, 778 bp, Homo sapiens
  misc_feature: GYAE6OF02JD5J6.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtgggggtcccttagagtctcctggtgtcggcctctggattctactttcagtaatggctggatgtaggttcggtccgccgaggtctaccggaggggaacggggtcgtgggtaggttggggttcggtaacggttttaacgaaaaaaggttaaaaagtggaagttaggggtaagaaaggtaaaaagtacggaacgttacggtacgaccgtaacccggtaaggaaaacggtaagtacttaccgaacctattacctacgaaagtagtaaactaaacgttaaaccgaaaaacggtacggttaagttaatttacggaactaaaagtcgaaaacctacgtaaccctaaacggaaaacccggtaggaacctaaccggacgtaccccgtactttaaacttaccgtaccgtaaccacgtaagttacggttaaccgaagtacgacgtaacgtaccggtaacggtaaagggtcggtaaccgttataggtttacccgtttagtaacgttacggtacccgggttacggggacccggtaacgggtaacctaggttcccgggg

SEQ ID NO: 114816 - DNA, 822 bp, Homo sapiens
  misc_feature: GYAE6OF02F1PWI.15.86.H09.1.454.CMB.1.raw
tcagtctacgtagccacgaccggtgctcgatttagtgctatagacttgggtttggggagctctgggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttaggtaaacggtccgtggggggtacccctttaggacgttccgtccgttggttggtcgggtcccttcgttggtactttcctacgttttccgtaagttaaagtggtacttgggacttggtaggtttcggggttcccggcccgtacgggccgttaccggaacgggggaaacgggggccgttaggggtagggtttgggggtttaggtaacggttttaaacgtaaaaaaggttaaaaaagtaggtaacgttagggttaacggtaaaaggtaaaaacgttaacggtaaacggttaacggtaccggtaccgtaaaccccggttaaggaaaagggtaaacgtaacttaccgtaacctaactacgttaacgaaagtaagtaaattaaacgttaaaacgaaaaaaccggttagggttaagtttaacgttagaacctaaaagttacggaaaactcgtaaccgtaacgaaaaccgggtacgaacgaactaacggtccgtattaacgttactacgtaacccgacgtagtaactacggtagcgactaggaccgtaaggtaaaggcgaacttgtacgttatttagacttacgtcggtacggaacccgg

SEQ ID NO: 114817 - DNA, 710 bp, Homo sapiens
  misc_feature: GYAE6OF02IC50J.15.86.H09.1.454.CMB.1.raw
  modified_base (309)..(309): a, c, t, g, unknown or other
  misc_feature (309)..(309): n is a, c, g, or t
  modified_base (394)..(394): a, c, t, g, unknown or other
  misc_feature (394)..(394): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcgaggtggtggagtcgtgggggagccttggtaaagcctggggggtcccttagacgtctcctgtgtggcctctggattcacttttcagtaatggactggatgagttgggtccgacgnggctccgaggggacgggcgtgggaggtgggttggtacgtttacaaaaagtaaaagtgacgtaggtagaagaaatagactacggtnacgaccgtagaaagacgtattacactagtctacgaaagagtaattaaacttaaacgaaaaacggtacgggttatttaaccgtttaggaaataaaaacgtgaaaccgtagaacccgttaacggaaaaaacccggtaggaaacctaaccaacgggtaccttaacgttaacgtttaacccgaggttaaaccccaagtaacgtacgtttaccgggaagtccgaactacgtacggaacggttaaaggcggtaacttactggtacttttacgagttaacgtccgggttacggaccccggtaagggtacctaaggtttcgggg

SEQ ID NO: 114818 - DNA, 943 bp, Homo sapiens
  misc_feature: GYAE6OF02IX43I.15.86.H09.1.454.CMB.1.raw
  modified_base (808)..(808): a, c, t, g, unknown or other
  misc_feature (808)..(808): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagtcgtgggttttccttgctgctatacgttaaaaggtgtccagtgtagaagtgcaggtggtggagtcgtggggagtccgttaggtaacgtccggtacgggggttcccttaggacgttcctcccgtggtcggttcggtcccttcgtggtattccgtacgtttacgagttaactggtctaggagttggtacggttcgggtcccgtccgacgggtcctaccggaggggtaagggggccgtggggtacggttcggggttacgggtaacgtttaacgaaaaaaggttaaaacgtaggtacgtaggttaacggaaagtaaaaggtaacgtaacggttaacggtacgtaaccggtaacccggtaaggaaaacggggtaacgttaacgtaccgtaacccgtaagttacccgtaacgtaaacggaacgttaaacttaaacgttaaaccgaaaaaacgggttacggtttacgggtttaacttttaacgggaaaccgttaaaaacgttacgggaaaaccttaccggtaaccggttaaaaaccgggaaaaaccggtaacccggaacccgttaaaccgtaaccggtaccccggtttaaacggtttaaccgttaccgttaaacccggtaaccctaaacgggttaggttaaccggttttaacgggaaaccggtttnaaaacccggtacgttaaacggggaaccggttaaagggttaaccgtcctttaaggttccgttttaaggttttaccgtagtttaacgggttcccgggaaccggggttacccgtaggggtaacccttagggttccggg

SEQ ID NO: 114819 - DNA, 627 bp, Homo sapiens
  misc_feature: GYAE6OF02FON0J.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgttaggtaaagccgtggggggtcccttagagtctcctgtgtggcctctggattcactttcagtaatggctggatgtaggttcgggtccgccgaggctccgaggggaaggggcgtgggaggtgggttgacggttacaaaaagtaaaatgagtggtagaagaaaatagactacggtgacgaccggtagaaaggagatcacatcacaagagataatacaaaacgtcggtagtagtttgactaaatagaacagactaagaaaaccgtacggaacacgacgaccgttactaacttacgtagtaacccagaacgtacgttacggaagtcgactagtaccgaagtaacggaggtactagtcgttacgtttagaattacgtacggtcgggacccgagggtactaaggttccggg

SEQ ID NO: 114820 - DNA, 719 bp, Homo sapiens
  misc_feature: GYAE6OF02I4TLY.15.86.H09.1.454.CMB.1.raw
  modified_base (443)..(443): a, c, t, g, unknown or other
  misc_feature (443)..(443): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtgggtggtagtcgtgggggagtccgttagggtaaacgccggttcggggggtccccttaaggagttcctccgtggttggtcggcccttcgtggtattcctacttttcagttaagtggcgtggatggtaggttcgggtcccgcgaggcctccggaaggggacgggggctggggaggttcggggttggacgtttaacgaaaaaggtaaaagtgaagtgggtagaaagtaaaagtagacgtacggtnacgtacccgaaggaaaggaagtacttccaactatccgtacaaaggacgtaaataactaaacgaaaaacgtacggtagttaagttagaacgtaaatacgaaacgacgaccgtaaggaaaaccgaggaacacgaccgactcttaatacctactaaccgacaagtacgttacggtaagacgtacgtaacgtacggtaacggtaaggacggttactagttacggttacgttttaggattacgttccgggccggtacccggaacggtacgtaaggttccgg

SEQ ID NO: 114821 - DNA, 641 bp, Homo sapiens
  misc_feature: GYAE6OF02GR7P6.15.86.H09.1.454.CMB.1.raw
  modified_base (579)..(579): a, c, t, g, unknown or other
  misc_feature (579)..(579): n is a, c, g, or t
tcagtctacgtagccacgaccggtgctcgatttagtgctatagacttgggtttggggggagaggagccccagccttgggatccccaagtgttttcattcagtgagtcaggactgaacacagagggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctcgtggattcacttttcagtaatggctggatggtagttgggtcccgccgaggcctccgagggaaggggctgggagtgggttggtacgtttacaaaagtaaaatgatggtagaagaaatagactacggtgacgaccgtaggaaaggaagattacaacctatctacgaaagagtaataattaacaaaaacggtcggttattaagtttagactaaaatacgaaactacgacccgtaaggaaaaccgaggaaccagacgtccgtacttattacgtacgtaacccagtagtagttcggaagtcgacagtaccgagtaaggnggtacttagtcgttactttagaattgtaccggtcgggacccgtaagggtacctaggttccgg

SEQ ID NO: 114822 - DNA, 600 bp, Homo sapiens
  misc_feature: GYAE6OF02GSA6P.15.86.H09.1.454.CMB.1.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (396)..(396): a, c, t, g, unknown or other
  misc_feature (396)..(396): n is a, c, g, or t
tcagtctacgtagccacgaccggtgctcgattttagtgctatagacttggggtttggggtccactgggcacgtctcgaatagagctcttggaaggtccctccaaccagtcggcctgggtctccttcctaccgtactcgcccttcattttctccacaggtcctcgtgtgctctgcctgtgctgactccagcccccgtntgctatctgccttgctgggancctgatcaagctcactgcacctaagngtgagnatcgaactacaccatcgaatggcatcaacagagaccagggaacgtccccccagtactataaatcgaaagttaacgagtgattggactagccaactacgaagggggaccggatcccgaatcgcttcgagtaggggctaccagttcgngggactacgaccgctaacctcaccatcctacccaacctccagtcctagaccgaatcggagtctgaacgttattccgtacgtcgtagggtaagaacgtacggtacccaagtacctaaagttcgtagtacggaccgaaggtaaccgggttagggtggttaccgggaggaacgggaccaaggccgttacgaccgttcgtaggtaccg

SEQ ID NO: 114823 - DNA, 630 bp, Homo sapiens
  misc_feature: GYAE6OF02I8H6U.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactaaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtggcctctggattcactttcagtaatggctggatggagttgggtccgccaggctccgaggggaaggggctgggaggtggggttggtacggtttacgaaaaaggttaaaatggtagtggtagaagtaaaagtaggacttacggtcgacacccggtagaaaggaagattcacatctacaagagataataacgaaaacgcggtattattcgaataaagtcgaaacacgacctaaggaaaacccgtaggaaccacgacgcccgtactaacttacgctaaccagagtacgttacggatgacataccgaaggtaagcggtagtatcgttgtttagagttacgtcggtacggggacccagggtactaggttcggtaccg

SEQ ID NO: 114824 - DNA, 707 bp, Homo sapiens
  misc_feature: GYAE6OF02F8I2D.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggttttccttgctgctatcttaaaaggtgtccagtgtgaagtgcaggtggtggagtcgtggggagccgttaggtaaaggccgtgggggtcccttagacgtctccgtgtgtggcctcgtggattcactttcagtaagtggcgtggatgtagttgggtcccgcgaggctccgagggaaggggcgtggaggtgggtggtacgtttacgaaaagtaaatgatggtagaagaaatagacgtacggtagaccgaaccgtagaaagaagattacactatacgtacaaagagtaataactaaccgaaaaacggtacggttagttaagtttacgaactaaagtacgaaacgaacgtacccgtaaacggaaaaccgacgtaaacgaaccgtaccgtaccgtaccgttaaacgttaaccgtacgttaaacccgaacgtaacggtaacgttacgggtaacgtacgtacgtaacgtacggtaaaccggtaaggtaacggtacttacgttacgttcgtttaagtacgttacgtccggtacggggtacccgaagggtaaccaggtttccggg

SEQ ID NO: 114825 - DNA, 646 bp, Homo sapiens
  misc_feature: GYAE6OF02IAUQR.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtaccagtgtgaagtgcgaggtggtggagtgtggggatccgttaggtaaacgccgtcgggggtcccttagagtctccgtgtgtgcctcgtggattcacttcgagtagtgcgtgagtgtaggttcggcgcgagcgacgagggagggtcgtggtaggttgggtagtaacgtttaacgaaaagtaaagtgtagtaggtagaagaaatagtacgtacgtgacgacgtagaaaggtagtactacacgactacacaagataataataaccgaaaaggtgttgtacttagaacaaatcgaaacacgtacgaaacgtaaacgacgtaacacgcgttacctaccgttaagttcctaacgtccaaacgtaggtagttaaccggatacaacgacgtaacgggtaacgaaacggtgtacgtaagttcttgtttaagaacttttcggaccggtcgggaacctaacgggattggttccgg

SEQ ID NO: 114826 - DNA, 711 bp, Homo sapiens
  misc_feature: GYAE6OF02JTVJC.15.86.H09.1.454.CMB.1.raw
tcagtctacgtagccacgaccggtgctcgatttagtgctatagacttgggtttggggggggtaggagggagccccagccttgggatccccaagtgttttcattcagtgatcaggactgaacacagaggactcaccatggagttcgggctgagctgggtttccttgctgctatcttaaaggtgtccagtgtgaagtgcgaggtggtggtaggtcgtgggggacgtccggttggtaaacggccggtacgggggttcccgttagtacgtccgtccgtgtcggtcggcctctggtacttctactttcagtaactggtctaggtactggtacggttcgggtcccgtcgacggcgtaccgaggggacggggtcggtcggtaggtggggttaggtacggtttacgaaaaggttaaatggtagtaggtacggaagtaaaataggactacggtgaccgtaccggtaggaaacggtaagtaacgtactaacacttacgaagaaggtaatataaattacgaaaacggtcgttagttatacgataaagtacgaacgacaccgaaggtaacccgaagacactaacggtactattaacgttcgacgttaccaaacgtacgtagttacggaattcgaactcgttacgaacggttaaggcgtaacggtacttagtccgttttaagacctggttacccggacggtaccgaacgggtgacggttaccgg

SEQ ID NO: 114827 - DNA, 663 bp, Homo sapiens
  misc_feature: GYAE6OF02GTLMH.15.86.H09.1.454.CMB.1.raw
  modified_base (323)..(323): a, c, t, g, unknown or other
  misc_feature (323)..(323): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttgggtaaacgccgtggggggtcccttagagtcctcctgtgtcggcctcgtggattcactttcagtaatggctggatgagttggtccgcaggctccgaggggnggggctgggaggtgggttggacgtttacgaaaagtaaaagtgaatgggtagaagtaaaatagacgtacggtgaccgaccgtaggaaaacggaagtactacaccatcacaagacgaataataaccaaaaacggtcggtagttaatttagaactaaagtacgaaacagacctaaggaaaaccgtggaacacgaacgaccgtacttaacgttactacgtaaccacgagtaacgttacggaaagtcgaacgacgtaccggaagtaagggacgtcgtaagttcggttcgttttagacttacgtacggtacccggggacccgtaacggggtacctaaggttccggg

SEQ ID NO: 114828 - DNA, 720 bp, Homo sapiens
  misc_feature: GYAE6OF02JD52T.15.86.H09.1.454.CMB.1.raw
  modified_base (308)..(308): a, c, t, g, unknown or other
  misc_feature (308)..(308): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttggtaaagccgtgggggtcccttagagtctcctgtgtggcctcgtggattctactttcagtaatggctggatgagttgggtcccncgaggctcgagggagggctggagtgggttgacgttacaaaagtaaatgtagtggtgaagtaaaagtagaacgttacggtacgacgaacccgtaggaaaaggaaagtacgttacgaacctattactacgaaacggaagtaagttaaacgttaaccgaaaaaacggtcggttagttaactttaaggactaaaagtacgaaacagtacccgtaacggaaaacgacgaaccaacgacgacccgttagtaactttaccgacgttaaccaagtaacggtacgttaccgttaaaggtcctaactacggtaaccgggtaaacggttaaagggtacggttacttagttcgtttacggttttagtacgttacggttacccggttaccgggggaaccctacgggggttactaccggtttcggg

SEQ ID NO: 114829 - DNA, 626 bp, Homo sapiens
  misc_feature: GYAE6OF02HW6A8.15.86.H09.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (320)..(320): a, c, t, g, unknown or other
  misc_feature (320)..(320): n is a, c, g, or t
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (467)..(467): a, c, t, g, unknown or other
  misc_feature (467)..(467): n is a, c, g, or t
  modified_base (534)..(534): a, c, t, g, unknown or other
  misc_feature (534)..(534): n is a, c, g, or t
  modified_base (561)..(561): a, c, t, g, unknown or other
  misc_feature (561)..(561): n is a, c, g, or t
tcagtctacgtagccacgaccggtgctcgatttagtgctatagacttgggttgggggggagaggagccccagccttgggatccccaagtgtttcattcagtgatcaggactgaacacagaggactcaccatggagttcgggctggagcgtggtttccgtgctgctatctaaaggtgtcagtgngagtgcgaggtggngngtcgaggggncttaggaanccggtaggggtcctaggngtctcgtgtgtcgcctgtaggtattcactttnagttaacggtctgatgaggtcggtacgcaggacctcggagggagggctgggnggttgggtagtacgtttaacgaaaagttaaaatggtgtacgtaggaaactaaagtcgtaacgacggtnaccgacggtagaaagtanacgtacacgtancgtacaagtagtataactaacgaaacgtagtagtattcgaataaacgtnaacgtatacgaaagaaaccggagacaacgagtctataagtacctatagacagtcgttaagaccgttnaccgtaagtacgaacgggtaagtacgngttaagtcgttaacgttagtaacgttcggtacggttaccggaccggtaattacccgtaggttccg

SEQ ID NO: 114830 - DNA, 629 bp, Homo sapiens
  misc_feature: GYAE6OF02FQGXL.15.86.H09.1.454.CMB.1.raw
  modified_base (350)..(350): a, c, t, g, unknown or other
  misc_feature (350)..(350): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
  modified_base (564)..(564): a, c, t, g, unknown or other
  misc_feature (564)..(564): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctcgtggattcactttcagtaatggctggatgtagttgggtccgccaggctccgaggggaaggggctgggaggtgggttggacgtttanaaaagtaaatgagtggtagaagaaaatagacgtacggtagacacccgttagaaaggaagacttacaccatctanaagtaanataactaacgaaaacgnggttagtatttacgataaatgaacagtacctacggaaaaccgaggaacacgacgtccgtactaacttacgagttacccatacgtattacgaagtcgactagtcgaacggtaaaggngtacttaattcggtacttttagaattacgtcggtaccggggacccgaagggtactaggttccggg

SEQ ID NO: 114831 - DNA, 914 bp, Homo sapiens
  misc_feature: GYAE6OF02HU1NP.15.86.H09.1.454.CMB.1.raw
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagtcttgggttttccttgcctgcttatacttaaaaggtgtccagtgtgaagtgcaggtggtggaggtcgtgggggagtccgttagggtaaaacgccggtggggggttcccttaggtacgtacgtcccgttggtggtaggtcccttcgttacggtatttaccgtaccttttcgaagttaaagtcgggtaccttagggaagttaggtaacggttcgggggttaccccgacccgtaacgggtacccgtaccccggtaaggggggaaacgggggtccggttaggggtagggttacggggggtttacgtaaaccggttttaaaccgtaaaaaaaggttaaaaaaacgttggtaaagttagggtaaggaaaaggtaaaaacgtaagaaaccgttaacggtacgaaccggtaaccccggtaaggaaaacggtaaacgtagttaaccaacctaacgttaaccaacctaaaaggtaacgtaaattaaaactaaaccgaaaaaacccgggtaaccggtttaagttaacgttagtaaacgaaaataacgtaaacgacgaaccctaaacggaaaaaacccggtaacgggaacaaccgtaagtacccgtaacttaacgtttaaacctacgtacaacgaggttaacgtacggtaagtacgataaccgtacggtaacgtaaagggtacggtaacccgtaagttacggttactttaggtaacgttaacgttaccgggttaccggggtaaaccccggtaacggtaaccgtaaggtttaaccggg

SEQ ID NO: 114832 - DNA, 638 bp, Homo sapiens
  misc_feature: GYAE6OF02JA6DH.15.86.H09.1.454.CMB.1.raw
tcagtctacgtagccacgaccggtgctcgatttagtgctatagacttgggtttgggggggagaggagccccagccttgggatccccaagtgttttcatttcacgtgatacaggacgtgaacacagaggactccaccatggagttacgggctgagctggtttcttgctgctatcttaaaaggtgtccagtgtgaagtgcaggtggtggagtcgtggggagccttggtaaagccgtgggggtcccttagagtctcctgtgtggcctcgtggattcactttcagttaatggctggatgagttgggtccgcgaggctccgagggaaggggcgtggtaggtgggttaggacgtttacgaaaagtaaaactgtactggtagagtaaatagacgtacggtgctaccgtagaaagagattacacgatctacaagagataatacgaaaacgtacggtgtactttggactaaatcgaacacggtacctagaaaacggtgaaccacgtaacgtccgtaaccttaagttaccgtacgtaacccgacgtaagttacgttaccggtaaagtcgactacggtacgacggttaaggacgtctttaaggcttacgttttaccgattacgtcgtcgggaccagggtacaggttcgg

SEQ ID NO: 114833 - DNA, 652 bp, Homo sapiens
  misc_feature: GYAE6OF02GZA8X.15.86.H09.1.454.CMB.1.raw
  modified_base (399)..(399): a, c, t, g, unknown or other
  misc_feature (399)..(399): n is a, c, g, or t
  modified_base (459)..(459): a, c, t, g, unknown or other
  misc_feature (459)..(459): n is a, c, g, or t
tcagtctacgtagccacgaccggtgctcgatttagtgctatagacttgggtttggggggagaggagtcccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaacgccgtggggggtcccttagagtctcctgtgtggcctctggattcactttcagtaatggctggatgagttgggtccgccaggcctccgaggggagggctggagtgggtggacgtttacgaaaagtaaatgagtggtagaagaaatagactacggtgcaccgtagaaacgganattcacatctacaagagtaataacgtaccaaaaacgcggtattaagtttgaacaaagtanaacacgcctaaggaaaccgagaacacacgtccgtaccttagttacctacgtaccacgacgtacgttacggaagttcaccgtagtaccggtaacggtaaacggacgggtacttaacgttcgttacgttttaacgagtttaccgttaccggggtaccgggtaaccccggtagggtaaccgtaaggttacccgggg

SEQ ID NO: 114834 - DNA, 989 bp, Homo sapiens
  misc_feature: GYAE6OF02JTFNB.15.86.H09.1.454.CMB.1.raw
tcagtctacgtagccacgaccggtgctcgatttagtgctatagacttgggtttgggggtaggagggaggccccagccttgggatccccaagtgttttcattcagtgatcaggactgaacacagaggactcaccatggagttcggctgagctggtttccttgctgctatcttaaaggtcgtccagtgttgaagtgtcaggtggtggtagtcgtggggtagccgtttgggtaaagtccgttggggggtccccttagggtaggttccgttccgttcggttggttccgggtcccttccgttagggtacgtttccgtacctttttacgacgttaaacgttgggtccgttgggtaagttcggtaaggtttcggggtcccggtccccgagggtccgtacccgtacgggggaaacgggggtccgttcggggtagggtggggttacggggttaccggttttaaccggtaaaaaaggttaaaaacgttagggtaaacgttaggggttaggtaaaacggttaaaaggttaaacggtaaacgttaaccgggtagggtaccggttaaaccccgggttagggtaaaaaaccggggaaggtaaacgtttacccggtaaaccgtaaacggttaccctttaacgaaaccgggtaaggtaaacttaaaccgtttaaaccgtaaaaaacggtacccgggtttaaaggtttaagttttaaacggtacgtaaaaaacggtttagaaaccgtaaaggttaccccgttaaggaaaaacccgggtaacgacgtaaaaccggtcgtaacccggtttacttaaacgttaaccctttacgaacccggtaaccttaaggtaaccgttagggggttaaaaccttggggaccttaaacgttaccgggtaaccgttaagggtaaccgggtaaccctttaaagggttcctttaacggtttccgttaagttacgtttaccggggtaccggtaccccggtaagttaacgggtacgttacgggg

SEQ ID NO: 114835 - DNA, 673 bp, Homo sapiens
  misc_feature: GYAE6OF02JRM8P.15.86.H09.1.454.CMB.1.raw
  modified_base (185)..(185): a, c, t, g, unknown or other
  misc_feature (185)..(185): n is a, c, g, or t
  modified_base (221)..(221): a, c, t, g, unknown or other
  misc_feature (221)..(221): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
tcagtctacgtagccacgaccggtgctcgatttagtgctatagacttgggtttggggggggtaggagggagccccagccttgggatccccaagtgttttcatttcagtgatcaggactgaacacagaggactcaccatggagttcgggctgagctgggttttcttgtctgctatacttaaaggtntccagtgtgaagtgcaggtggtggagtcgtgggggngcgttaggtaagccgtgggggtccttagagtcctacctgtgtggcctcnggtattcacttttcgatagtggctggngtgaggttcggtcgccgtaggctccgagggagggctaggnggtggtggagtttacgaaaggtaatagatggtaganaaatagataggncgtacgaggaagtagatcaacatcataganataataccgaaaagtacggttataagtttacggactaaagtagtaaacgaacgtaccctaaggaaaacccgtaggaacccgtagaaccggaaccttacgttacgtaaacttccgaacgtaaccgaggtaacttacggggatacgtaacgtacggaaccgttaggtaacgggaaggtacttacgggtttggttacctttagggtaattacggtacgggttcccgggggtaaccctaacgggggtagtaaccgtttcggg

SEQ ID NO: 114836 - DNA, 665 bp, Homo sapiens
  misc_feature: GYAE6OF02IWAYF.15.86.H09.1.454.CMB.1.raw
  modified_base (569)..(569): a, c, t, g, unknown or other
  misc_feature (569)..(569): n is a, c, g, or t
tcagtctacgtagccacgaccggtgctcgatttagtgctatagacttgggtttggggggagaggagccccagccttgggatccccaagtgttttctattcagtgatcaggactgaacacagaggactcaccatggagttcgggctgagcttgggtttttcccttgctgcttatcgttaaaaggtgtccagtgtgaagtgcagggtggtggtaggtcggtgggggagtcccgttggtaaaacggcccggttgggggggttcccctttaggacgttccgtccctgttggtcggtccgtcgtggacttcctaccttttcgagtaactggctggatggagttgggtccgccgaggccgtcccgaacgggaacggggtcgtgggaggtggggttaggtacggtttacgtaaaaggtaaaagtgtaagttggtagaagtaaatagacgtacggtgacgacccgtagaaaggagtatacgacatcgtacgagagataactacaaaacgcgtagttattagacaaatacgaacacgactaagaaacgagacacgagacctactatactacgtaccanagtacgttacgaagtcgactagtacgacggtaaggaggtacgtagttacgtactttagattcgtacggtcgggacccgtaggtaccgtagttccgg

SEQ ID NO: 114837 - DNA, 634 bp, Homo sapiens
  misc_feature: GYAE6OF02JIC11.15.86.H09.1.454.CMB.1.raw
  modified_base (217)..(217): a, c, t, g, unknown or other
  misc_feature (217)..(217): n is a, c, g, or t
  modified_base (581)..(581): a, c, t, g, unknown or other
  misc_feature (581)..(581): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctggggganccgttggtaaagccgtgggggtcccttagagtctcctgtgtggcctctggattcactttcagtaatggctggatgagttggccgcaggctccgagggaaggggctggaggtgggttggacgtttacaaaagtaaagtgagtggtagaagaaaatagacgtacggtgaccaccgtagaaaggaagacttacaacctagtctacgaagagaataattaacaaaaacggtcggtagttaatttagaactaaagtagaaacgacgaccctaaggaaaacccggagaaccaacgagtacccgttattaacttaacgtacgtaacccagtaggaacgttcgggaaatcgacagtaccgaacggtaaaggngtactatgtacttttagacttacgtcggacgggacccgaaggtacctagtcgg

SEQ ID NO: 114838 - DNA, 607 bp, Homo sapiens
  misc_feature: GYAE6OF02FWIUT.15.86.H09.1.454.CMB.1.raw
  modified_base (508)..(508): a, c, t, g, unknown or other
  misc_feature (508)..(508): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagagtctcctgtgtggcctctggattcactttcagtaatggctggatgagttgggtccgccaggctccagggaaggggctggagtgggttggacgtttcaaagtaaaatgatggtgagaaatagactacggtgcaccgtagaacggaagattacgaaccatcctacaagacgaataattacaaaaacggacggtagttaatttggactaaatagaaacagacctaggaaaacccgaggacacacgccgtactattactacgtaccanagtattacggaaagttgactaactcgaacgtaaaggacggtcttaagtggtactttttgaattagtcggttcggggaccccgagggtaactagttcggg

SEQ ID NO: 114839 - DNA, 843 bp, Homo sapiens
  misc_feature: GYAE6OF02HPA1I.15.86.H09.1.454.CMB.1.raw
tcagtctacgtagccacgaccggtgctcgatttagtgctatagacttgggtttggggggagaggagccccagccttgggatccccaagtgtttttcattcagtgatcaggactgaacacagaggactcaccatggagttcgggctgagcttgggttttccttgctgctattacgttaaaaggtgtccagtgtgaagtgcaggtggtggagtcgtgggggagtccgttaggtaaacgtccggttcgggggttcccttagacgttctccgtggtgtcggcctcgtggtattcctactttcgaagttaagtggtcgtggtagtggtaggttccggggtcccgccgacggccgtaccgggaaggggaacgggggtcggttagggtacggggttcgggggtttaggtaaccggtttttaaacgaaaaaaaggttaaaaagtggtaagttagggtaacgaaaggtaaaaagtagtaacgttacggtaccggtaccgaaccggtaaaggaaaaggtaaagtacgttaacaacccgtaataccgaacgtaaagtaagtaacttaaacgttaaacgaaaaaacggttacggttaagtttaattaacgaacttaaaagtacgtaaaccggtagaacccgttaaaggaaaacccggagaaccgtaacgaacgttccgttaacgttaagttaaccgttaccgtaacccaagaacgtttaaccgttagggtaaagttgaaccgtaacggttaaccggaaagttaaccgggttaaggtaccgtttagtttacggttcgttttaaaggacgtttaacgggtcgggtacccgggtacccgaagggactacgggttccgg

SEQ ID NO: 114840 - DNA, 613 bp, Homo sapiens
  misc_feature: GYAE6OF02G1LNV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatctaaaggtgtccagtgtgaagtgcaggtggtggagtcgtgggggagccgttggtaaagccgtgggggtcccttagagtctcctgtgtcggcctctggattctactttcagtaatggctggatgagttgggtccgccgaggctccgaggggaacggggctggaggtgggttggacgtttacaaaagtaaaatgagtggtgagaaatagactagtgcaccgtagaagagtatcacatcacaagagataattaacaaaacggtacggttagttattagactaaagtagaacacgacctaacggaaaccgaggaacacgacgtaccgtcttatacctacgtaccacgaagtacgttacggaagtgactacgtacgtacggtaaggacggtactagtagttcgtttagtagttacgtcggtcgggacccgtagggtactaggttccggg

SEQ ID NO: 114841 - DNA, 741 bp, Homo sapiens
  misc_feature: GYAE6OF02GFS1F.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagccgttaggtaagccgtgggggtcccttagagtctccgtgtgtggcctcgtgtacttctactttcgaagtaatggctggatggtaggttcgggtcccgccgacggtccgtaccggaagggggaacggggcggtgggagggttggggtttacggtaacggttttaacgaaaaaggttaaaaagtgtaagtagggtagaaagtaaaagtagtaacgtacggtacgaccgaaccggtaggaaaaggaagtaacttacaacctatacgtacaaagtaagtaaataaacttaaaccgaaaaacggtacggttagttaagtttacgaactaaatacgaaacacgaccgtaacggaaaaaccggagaacaaccgacgacccttactaagttacctacgtacccaagtacggtaacgttaccggaagtcgaactagtaaccgtaacgtaaagggtacgtattaacgttacggttcttttaaggactttacggttacggaccgggtaacccgtacgggtacgtaggttccgg

SEQ ID NO: 114842 - DNA, 785 bp, Homo sapiens
  misc_feature: GYAE6OF02F51UP.15.86.H09.1.454.CMB.1.raw
  modified_base (199)..(199): a, c, t, g, unknown or other
  misc_feature (199)..(199): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgtggttttccgtgacgtgctatacgttaaaggtgtccagtgtagagtgngaggtggtggagtcgtggggagtccgttaggtaaggccgttgggggtcccttaggacgttcctccgtgtgtcggccttcgtaggtacttacactttcgagtaagtggtctggatggtacggttcggtccgcgacggtcctacgacgggagggcgtgggtacggttggggttacggtacgtttaacgaaaaaggtaaagtagtagttacggtaagtaaggtaaagtacgtaacgtacggttacgaccgtaaccggtaggaaaggacgtacttacgaactctacgttacgaaggtaataacgttaacgtaaaacgaaaacgggtacgttagttaaagtttaaccgaagtaaaaccgttggaaaacgtccggtaaacccgtaacgggtaaaaacccggaggaaacccgtaaaccgtccgacccggtttaaatttaccgtacccgtacgggtaaacccctagacggttacgtaaaccgggtaagtcgtaacgtaaccgtaaggaccggttaaggaccgtagtttactgggtttacttaaggtacgtggttcccgggtacggtaaccggacggttaacgtaggttacccgg

SEQ ID NO: 114843 - DNA, 670 bp, Homo sapiens
  misc_feature: GYAE6OF02F6CIU.15.86.H09.1.454.CMB.1.raw
  modified_base (348)..(348): a, c, t, g, unknown or other
  misc_feature (348)..(348): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtctgggggagccttggtaaagccgtgggggtcccttagagtctcctgtgtggcctctggattcactttcagtaatggctggatgagttggccgcaggctcgagggaggggctggagtgggtggtacgttacgaaaagtaaangatggtagaagaaatagaacgtacggtgaccgtaaccggtagaaaaggaagacttacaacctactactaacgaaagagtaattaataaccgaaaaacggtacggtagtttaagtttagaactaaagtacgaaacgagacctaacggaaaaccgtaggaaccacgacggtacctacgttaacttacgtacgtaaccacgtaagtacgttacgggaattcggaactagtaaccggtaaggtaaaggacggttaacttagttacgttacgttttagtagttaccgttcgggtaccgggacccggaagggtaacctaggttccggg

SEQ ID NO: 114844 - DNA, 755 bp, Homo sapiens
  misc_feature: GYAE6OF02IHDBH.15.86.H09.1.454.CMB.1.raw
  modified_base (254)..(254): a, c, t, g, unknown or other
  misc_feature (254)..(254): n is a, c, g, or t
  modified_base (699)..(699): a, c, t, g, unknown or other
  misc_feature (699)..(699): n is a, c, g, or t
  modified_base (705)..(705): a, c, t, g, unknown or other
  misc_feature (705)..(705): n is a, c, g, or t
  modified_base (714)..(714): a, c, t, g, unknown or other
  misc_feature (714)..(714): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgaccttggttttccttgctgctatcttaaaaggtgtccagtgtgaagtgcgaggtggtggagtcgtgggggagtccgttaggtaaagccggtggggggttcccttagngtctccgtgtgtggcctcgtggattctactttcgaagttaacgtggtctggaagtggtaggttcgggtccgaccgaggtccgtccggaagggggaacgggcgtagggtacgggttggggttaggtaccgtttaacgtaaaaagtaaaagtggtagtaggtagaaacgaaaatgaacggtacggtagaccgaaccggtaggaaaacggtaagtaacgtttaccgaaccgtacgttaccgtaacgtaaaggaacgttaaaacgttaaacgttaaacgaaaaaaacccgggttggtttaacgtttaaagttttagaaaccgttaaaagttaccggaaacgaccggtaacgtaaacggaaaaccggacgtaacaacgaccgtacctttaacgtaacttaccgtacgtaacgacgtaggttacctaggaagtcacagtaccgaagtacgngttacnggtaccttntagaacttcgaggttcgggacctagggactacggtggttcc

SEQ ID NO: 114845 - DNA, 772 bp, Homo sapiens
  misc_feature: GYAE6OF02HBCPX.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtctgggggagccttggtaaagccgtgggggtccttagagtctcctgtgtggcctctggattcactttcagtaatggctggatgtaggttcgggtccgccgaggcctccgaggggaaggggcgtgggtaggtggggttaggtacgtttaacgaaaaagttaaaagtgagtggtaggaaagaaaagtagacgtacggtacgaccgtaacccggtaaggaaaagggtaagtaactttaccaaccgtaactacgtaacaaaggaagtaattaaacttaaaccgaaaaaccggtagggttacgtttaagtttacggtaactaaaagttacggaaacctacggtaacccgtaaaggaaaaacccggtacgggaaaccaaccgtaccggtaccgtttacgttaacgtttaaccgttaaccgtaacctaacgtaaacggttacgtttacgggaaacggtacgtacgaaccgttaacgggtaacggttaaacgggacggttattaacgttacgttgttttaacgtagttacgttccgggtaccggggtacccgtaagggaaccttagggttcggg

SEQ ID NO: 114846 - DNA, 804 bp, Homo sapiens
  misc_feature: GYAE6OF02FY4WJ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccttgggtaaacgccgtggggggttccccttaaggagtctccgtgtgtcggcctctggattcactttcagtaatggctggatggtaggttcgggtcccgccgagggcctaccggaaggggaacgggggcgtggggaggttaggggttcggtaacggtttaacgaaaaaaggttaaaataggtagtagggtaagaaaggtaaaatagacgtaacggtgaccgtaaccggtaggaaaaggtaaagtacttaccaacctacgtaccttaacgaaagtaaggtaaattaaacgttaacgaaaaaacgtcgggttaaagtttattttacggaaataaaacttacggaaactaccgtaacccggtaaacgtaaaaacccgggacgggaaactaaacccggcgtaacccggttaaccttaacgttaacgtaccgttaaccgaactaacggttaccggtttaacggaaggtacgaacgtaacgtaccggtaaaggtaaagggtacggttaccttaaggttacgtttacggttttagaacgtttcgttaccgggtaacggggaccccgtaaggggtactaacgggtttacccggg

SEQ ID NO: 114847 - DNA, 714 bp, Homo sapiens
  misc_feature: GYAE6OF02H2FR4.15.86.H09.1.454.CMB.1.raw
  modified_base (300)..(300): a, c, t, g, unknown or other
  misc_feature (300)..(300): n is a, c, g, or t
tcagtctacgtagccacgaccggtgctcgatttagtgctatagacttgggtttgggggggaggaggaggccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagtccgttggtaagccgtgggggtcctaggagtctctgtgtgctctgattctacttcagtatggactggatggagttgggtccnccgaggctccgaaggggacgggcgtgggaggtgggttaggtacgttttacaaaaaggttaaaagttggaagtgggtaggaaagaaacgtagaacgtacggtgacgtacccggtagaaaaacggtagaagttccgaccgaattaccgtaagaaggaacgttaaagttaacgttaacgaaaaacggtacgggttaagttagtttaagaactaaaagtacgaaagacgaaccgtaaagaaaaccggagaacacgaacgtaccgtaacttaattaaccgtagtaccaacgaaggtacgttaagacgtacgaacttaggaccggtaagtaaagggacggtcttaacgtggtaaccgtttttagaagttttccgtacggtacccgggggtaacccgtaagggtacctaagggtttccggg

SEQ ID NO: 114848 - DNA, 615 bp, Homo sapiens
  misc_feature: GYAE6OF02H7UJN.15.86.H09.1.454.CMB.1.raw
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (446)..(446): a, c, t, g, unknown or other
  misc_feature (446)..(446): n is a, c, g, or t
  modified_base (551)..(551): a, c, t, g, unknown or other
  misc_feature (551)..(551): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtcctcctgtgtcggcctctggattctattttcataatggctgatgngttcgggtcgcgagcgtcgagggagggctggtaggtgggtgacgtttanaaaagttaaangagtgganaagaaatagactacggtnacaccgtagaagacgatacacatcctagaagagaataatacaaaacgtcgtagttaattgacaaanagtaacagaccctaagaaaccgagacacgtcgaccgtactaattaccgtactaacgtactagtacgttacggtaagtcgaactacgtacgaaggttaaggacgtntaagtcgttaagtttacgacttacggtcggtaccggggaccgtaagggtaccgtaggttccggg

SEQ ID NO: 114849 - DNA, 731 bp, Homo sapiens
  misc_feature: GYAE6OF02JFQZ5.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtgcctcgtggacttcactttcagtaagtggtctggtagtggtaggtttcgggtcccgccgaggctccgaggggtaaggggtctgggaggttgggttggtaacgtttacgaaaaaggtaaaagtggagtggtagaaggtaaaatagacgtacggtcgacgtaaccggtagaaaggaagattacactatactacgaaagacgtaattaacgtaacgaaaacggtacggttagttaagtttacgaactaaaagtagaaacacgaccgtaaggaaaaccgaggaccacgacgtacccgttacgttaacttaccgtacggtacctaacgtaacgttacgttaacggaacgtacgtacgtaacgtacggtaacggtaaaagggtcggtaacgttaacgttacggttaccgtttttaaggtaaccgtttacggttaccggttacccggggaacccgtaacggggtaacttaacgggttcggg

SEQ ID NO: 114850 - DNA, 660 bp, Homo sapiens
  misc_feature: GYAE6OF02HHDM5.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtcccttaggacgtctcctgtgtcggcctctggattcacttcagtaatggctggatgaggttcggtccgccaggctccgagggagggctggagtgggttggacgtttacaaaagtaaaatgagtggtagaagaaagtagacgtacggtcgacaccggtagaaagaagtacttaccaactactacacgaaagtagtaataactaaacaaaacggtaggtatattacgactaaatcgaaactacgaccgtaaagaaaaccgaggaccgaacgtcgaccgtattaacgttaccgttacgtaccaacgtagtaacgttacggaaagtgaacctacgtacgtaaccgtaaagggacgtcgtacgttacgttcgtttagtaacgttacgttcgggtacggacccggtaacggtactaacggttccggg

SEQ ID NO: 114851 - DNA, 695 bp, Homo sapiens
  misc_feature: GYAE6OF02I29EA.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaagccgtgggggtcccttagagtctcctgtgtggcctctggattctacttcagtaatggctggatgagttgggtcccgccgaggctccgaggggaagggggctgggaggtggggttggtacgtttacgaaaaagtaaaatggaatgggtagaagtaaaagtggaactacggtgacctaacccggtaggaaaacggaagacttacaccaatactacaaagagtaattaaacttaacaaaaacggtcggtaagttattagaactaaagtagaaacacgaccgtaacggaaaaccgtacggaaccacgacgtacccgtacttaacttaacgtacgtaccaacaggtaacgttacgggtaaagtcgactaacgtaccggaacggtaaagggacggtacgttaagtacggttacttttaggaatttacgtccgggttacggggaccccgtaaggggtacgtaacggttccggg

SEQ ID NO: 114852 - DNA, 971 bp, Homo sapiens
  misc_feature: GYAE6OF02I2A6Q.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggtttttccttgctgctatacgttaaaaggtcgtccagtgtagaagtgctaggtggtggagtcgtgggggacgtccgtttagggtaaacggtccggttcgggggggttaccccttaggtacggttccgttcccgttggttcggttcgggtccttccgttggtactttccgtaaccttttcgaagttaaagtcgggtccgttagggtaagttagggtaacggttttccgggggtccccgtaccccgtaacggggtccgtaccccgggtaaaggggggtaacggggggtaccgttagggggtaacggggtttagggggggtttaccggggttaacggtttttaaaccgaaaaaaagggtttaaaaaagtcggtaaaggtttaggggttaagaaaagggtaaaaaacgttaaggtaacccggttaacgggttacggaacccggtaaaccccgggtaggaaaaaacgggtaaacgttaacgtttaccaaacccgtacttaccgtaaccgaaaagtagtaaactaaagttaacccgaaaaaacggtcgggtttaagttaagtttagaaccgtaaagttaacgaaacctacggtaaccctaaacgggaaaacccgaaggaaccgtaaccgaacgtaccgttaacgttaacttaaccggtactaaaccgtaaccgtaacggttaacgttaacgggaaagttccgaacgtacgttacggtaacggttaaacgggtacggtaccgttaagttcggtttaaccgttttacgtaacgtttacggttcgggtaccgggtacccggtaacgggtacgtaacggtttccggg

SEQ ID NO: 114853 - DNA, 733 bp, Homo sapiens
  misc_feature: GYAE6OF02IBW43.15.86.H09.1.454.CMB.1.raw
  modified_base (322)..(322): a, c, t, g, unknown or other
  misc_feature (322)..(322): n is a, c, g, or t
  modified_base (608)..(608): a, c, t, g, unknown or other
  misc_feature (608)..(608): n is a, c, g, or t
tcagtctacgtagccacgaccggtgctcgatttagtgctatagacttgggtttgggggggaggaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcggtgggggagtccgttaggtaaaggccggtcgggggttccttaggaggttcgttccgtgtggtcgggtcctcgtacggtattctacgtttcaacgttaacgtggtcgtaggngtggtaggttcgggttccgcctagggcctaccggagggggaacgggtcgttgggaggttgggttcggtacgtttacgtaaaaagtaaaagtgagtagtagaagtaaaacaggtaacgtacggtacgccaaccggtaagaaacggtaagacgtaccgactaactctaacgaagaagtaaacttaactaaacaaaaccgggtacgggtaagttttaataacgtaagtaaaacgtagtaaagacggtaccctaaagggtaaaacccggaacggtacaaaccgacggtanaccgtttaataacctacggaacctaacgagtacgttacgggatacgtacacgtacgaggtaaaccggggtaactagtacgttgtttagacttgtacgggtcggaaccggaaggtcctaaggtcgg

SEQ ID NO: 114854 - DNA, 696 bp, Homo sapiens
  misc_feature: GYAE6OF02G1RH1.15.86.H09.1.454.CMB.1.raw
  modified_base (603)..(603): a, c, t, g, unknown or other
  misc_feature (603)..(603): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgttgggttttccttgctgctattacttaaaaggtgtccagtgtgagtgcaggtggtggagtcgtggggagtccgttaggtaaacgccgttgggggtcccttagcgtctcctgtgtcgcctcgtggtattcacttcagtatggctggatggtacgttggcccgcgaggcgtcgaggggaggggtcgtagggtggtgggtggtacgtttaacgaaaaagtaaaagtgagtaggtaggaaagaaatagtacgtaggtacgaccgacgtagaaaggatacgtacactatacacgaagagtaactaaacgtaacgaaaacggtcggttaagttacgttagaactaaaagtacgaaacgaacggtccgtaaacggaaaacccggagaacccacgaccgtacctttaacttaacgttacgtaccgtaacctaagtacggttacgttaacggaacggttancgtaaccgttaagggaacggttaaggcggttaacttgtacgttcttagttagtacggtcggtaccgggaccggtaggtacgtacggttccggg

SEQ ID NO: 114855 - DNA, 793 bp, Homo sapiens
  misc_feature: GYAE6OF02JK18N.15.86.H09.1.454.CMB.1.raw
tcagtctacgtagccacgaccggtgctcgatttagtgctatagacttgggtttgggggggggtaggagggaggccccagccttgggatccccaagtgttttcattcagtgatcaggactgaacacagaggactcaccatggagttcgggctgagctgggttttccttgctgctatcttaaaggtgtccagtgtgaagtgcaggtgggtggagtcgtggggggagccgttgggaaagccgtggggggttcccttaggaggttcctcctggtgtggcctctgggtattcactttcagtaattggcctggatggtaggttcgggtccggtccgagggtcctccggtaaggggaacggggggtcctggggaggttggggtttagggacggttttaccgaaaaagggttaaaaattggtaagtggggttagtaaagggaaaaagttacggaacgttaacgggtacggtacccggtaacccggtaggtaaaaacggggaaagtaacgttttacgaaacccggtattacccgtaccgtaaaggtaacggtaaacgtttaaacttaaacggaaaaaaccggttaccgggttaagttaaaggttttacgaaaccgtaaagtaacgaaacgtacgaaccgtaacgaaaaccggaagtaacgaacgacgaccgtacttacgtactacgtaaccaaccgagtacgtaacgtaaggtcgactacgtaggacggtaaggacgtaacctagtaggttctttataggttacttcggtacgggtacccggacgggtagtaacggttcggg

SEQ ID NO: 114856 - DNA, 670 bp, Homo sapiens
  misc_feature: GYAE6OF02H2XCK.15.86.H09.1.454.CMB.1.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (494)..(494): a, c, t, g, unknown or other
  misc_feature (494)..(494): n is a, c, g, or t
  modified_base (518)..(518): a, c, t, g, unknown or other
  misc_feature (518)..(518): n is a, c, g, or t
  modified_base (565)..(565): a, c, t, g, unknown or other
  misc_feature (565)..(565): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgttggggggtcccttagacgtctcctgtgtggcctctggnttcatttcagtaatggctggntgagttgggtccgcaggctccgagggagggctgggagtgggttggtacgtttacgaaaagttaaaagtgtagtaggtagaagaaaagtagacgttacggtacgcgtaacccggtagaaacggtaagacttcaaccatactacgaagagtaataattaacgaaaaacgtcggttagttaatttaggaactaaagtagaaacgngacctaacggaaaccgagaaccanacgccgtactaagtttcaacggttacccaagagtaacttcgggaaancggtcctaagtccggtaacgttaaagggcggtaacgttatacgggttaacctttaggaccttagtccggttaggggaaccccagggttaaccaggtttacccggg

SEQ ID NO: 114857 - DNA, 1015 bp, Homo sapiens
  misc_feature: GYAE6OF02I6FSA.15.86.H09.1.454.CMB.1.raw
  modified_base (942)..(942): a, c, t, g, unknown or other
  misc_feature (942)..(942): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcggctgagctgggttttccttgctgctatacttaaaggtgtccagtgtgaagtgcaggtggtggagtcgtgggggagtccgttagggtaaacgccgtggggggttcccttaggtacgttccttcccgtggttcggtcgggtcccttcgttagggtaactttccgtaactttttccgaaggttaaacgttgggccgttagggtaacgtttacgggtaacgggtttcgggggttcccccgggaccgtaacggggtcccgttaccccgggaagggggggtaaacggggggtaccggttaggggtaacggggtttacggggggtttacggggttaaccggtttttaaaccggtaaaaaaaagggtttaaaaaaacggttagggtaaaggttacggggttaaggaaaacggtaaaaaagttaacgggtaaaccggtttaacgggttaaccggtaacccggtaaaccccgggttaacgggtaaaaaacggggtaaacggttaaaccgtttaacccgaaacccgttaacgttaccgttaaccgtaaaacggtaaaggtaaacgttttaaactttaaacccgggaaaaaaaaccgggtttcggggtttaaacgttttaacggtttacggaaaccgttaaaaagtaccgggtaaaaccgtaacgggttaacccctaaaagggaaaaacccggtacggtaaaccacggtaaccggtccccgtttaagttaaccttaaccgttacgttaacccacgttaaggtaacgtttacgggaaagtccgaacgtaacttaccgggaagttaaacgggnggtaataccgttagttacgtttagtaagttcgtaccgggtccggggaaccggtaacggtacgtacggttcggg

SEQ ID NO: 114858 - DNA, 767 bp, Homo sapiens
  misc_feature: GYAE6OF02IOASW.15.86.H09.1.454.CMB.1.raw
tcagtctacgtagccacgaccggtgctcgatttagtgctatagacttgggtttggggggggaggaggagccccagccttgggatccccaagtgttttcattcagtgatcaggactaaacacagaggactcaccatggagttcggctgagctggtttccttgctgctatcttaaaaggtgtccagtgtgaagtgcgaggtggtggagtcgtgggggagccgttaggtaaaggccgttggggggtcccttagacgtcgtcctgtgtggcctcgtggattctacttttcgagtaagtggacgtggagtggtaggttcggggtaccgccgaggtcctaccggaggggaagggcgttgggaacggtggggttggtaaccgtttacgaaaaaggtaaaagtgtagtagggtaggaagtaaaatacggtagtacggtgaccgtaccggtaagaaagggaagtaattacgaacctagtaccgtacgaaaggagtaaagtaaacgtttaaccgaaaaaacggtaccgggtttagttaacgtttacggaaataaaggtagaaacgtaacgacgtaaacggaaaaccggaagtacaaccgtaacgtaccgttactaacgttactaccgtaaccgtaaagtaccgtaagttaccggaaagttacgtacgtaacgttacggtaaacgaagggtacggtaaccgtaaggtaccgttagtttacgaacgtaggttaccggtacggggtacccgtaacgggacgttaacggtcggttacccgg

SEQ ID NO: 114859 - DNA, 842 bp, Homo sapiens
  misc_feature: GYAE6OF02FY00G.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctggtttccttgctgctatcttaaaaggtgtccagtgtgaagtgcaggtggtggagtcgtgggggagccgttaggtaaaacgccgtggggggtccccttaggagtccgtccctggtgtaggtaccttcgtgggtacttctactttcaagtaatggtcctggtaatggtaaggttcgggtacccgtacgaggtacctacccgaggggtaaacgggggtccgtagggaagggttcggggttaggtaaccggtttaaccgtaaaaaaggttaaaaagtggtaacgttagggtaggtaaagtaaaaacgttaggaaccgttaacggtacggtaccgtaaccccgggttaaggaaaaacgggtacgtacgtttaccgaaacccgtagttaccggttaacaaaggtacgtaaacgtaaacgtttaacgaaaaaacggtcggttaagttaacgtttaggtaaccgtaaaagtacggtaaacctaacggtacccgtaaaggaaaaccggacggaacgaaccgacgtaccggtaacttaacttaacgtaccgtaacctaacgtacggtaacgttaccgggtaagttccgactaccgtacgtaaccggtaaacggtcggtaaccttacggttacgttaccgtttttaaggacgttaacggttccggttaaccggggacccgtacgggttaaccaacggtttccggg

SEQ ID NO: 114860 - DNA, 627 bp, Homo sapiens
  misc_feature: GYAE6OF02GDI8Y.15.86.H09.1.454.CMB.1.raw
  modified_base (427)..(427): a, c, t, g, unknown or other
  misc_feature (427)..(427): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtctgggggagccttggtaagccgtgggggtcccttagagtctcctgtgtggcctctggattcgactttcagtaatggctgggatgagttcgggtccgccaggctccgagggagggctggagtgggttggacgtttacaaaagtaaatgagttggagaagaaaatagtacgtacggtagccaccggtagaaaggaagattacaacctatacctacaaagganaattaacttaacgaaaaacgcggtattaattagactaaatagtaacagccgtaagaaaccgagaacacgacgccgttactaacttacctacgtaccacgagtacgttacggaagtcgactagtccggtaacgtaaggacggtactagttcgtactttagagttacttcggtccgggacccgagggtacctaaggttccgg

SEQ ID NO: 114861 - DNA, 1013 bp, Homo sapiens
  misc_feature: GYAE6OF02JFGW9.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtggggggtcccttagagtctcctggtgtggcctctggtattcactttcagtaatggctggatgaggttcgggccgccgtaggcctaccgaggggaaggggtcctagggtaggttgggttacgggtaacggtttacgaaaaaaggttaaaacgtggtaagttacgggtagtaaaggtaaaaagttaacgaaccgttaacgggtacggtacccgtaacccgggttaacggaaaaagggtaacgtaacgtttacccgaaaccgtaacgtttaccgtaacgaaaggtaacgtaacgttaaaaccgttaaacccgtaaaaaaaaccggggtccgggttttaacgggttaaacgtttttacggaaaaccgttaaaaacggttaaaccggtaaaacccgtaaacgggttcccccggttaaaaaaaaacgggaaaccccgggttaacgggaaaacccgtaaacccgggtaaacccgggttaccccggtttaaccgtttaaaccggttttaaacccgttaaaccccgggttaaacccccgtaaaacgggtttaaaccggtttaacccgggttttaacccgggggtaaaaccgggtttaccgtaaacccgggttaacccgggttttaaacccgggaaaccgggggttttaaaaacggggaccggtttaacccggttaagggttacccgggtttaacgtttttaaccggaaacgtttaccgggttacccggggttaccccggggggtaacccccggtaaaggggggttaccccttaaaggggtttacccgggg

SEQ ID NO: 114862 - DNA, 784 bp, Homo sapiens
  misc_feature: GYAE6OF02JYV30.15.86.H09.1.454.CMB.1.raw
tcagtctacgtagccacgaccggtgctcgatttagtgctatagacttgggtttggggggaggaggagccccagccttgggatccccaagtgttttcattcagtgatcaggactgaacacagaggactcaccatggagttcggctgagctggtttccttgctgctatcttaaaggtgtccagtgtgaagtgcgaggtggtggagtcgtggggagccgttaggtaacgccgtggggtccttagagtctctgtgtggctctggattcacttcgagtatggcgtggatgtagtcggtcccgcgaggccgtccgtaggggacgggtcgtaggtaggtcggttaggtaccgttttaagaaaacgttaaaaagtcgtaagtggtaggaaagtaaaagtagtaaccgtacggtagaccgtaaccggtacggaaaaggtaacgaacgttaccaccgtaacgtaccgtaacgaaggtaagtaacgtaaacttaaaccgaaaaaccggtgggtttaaccgttaagtttacggaaataaaaccgtacgggtaaaccacgtaaccgttaaacggaaaacccggtgggaaacctaacgtaccggtaaccgtttaacgttaacgttacgttaacccggtaacctaacgtacggttaaccgttaacgggtaacttaggaaccgtaaccggtaacgtaaccgggttaaacggaaggttccttaacggttcgttaccgttttaagagttacggttacccgggaccggggtacccttaaggggtacccgttaagtttccgggg

SEQ ID NO: 114863 - DNA, 687 bp, Homo sapiens
  misc_feature: GYAE6OF02JIF2X.15.86.H09.1.454.CMB.1.raw
  modified_base (262)..(262): a, c, t, g, unknown or other
  misc_feature (262)..(262): n is a, c, g, or t
tcagtctacgtagccacgaccggtgctcgatttagtgctatagacttgggtttgggggggagaggagccccagccttgggatccccaagtgtttcattcagtgatcaggactgaacacagaggactcaccatggagttcgggctgagctgggttttcctgctgctatcttaaaggtgtccagtgtgaagtgctaggtggtggagtctgggggagccgtttggaaagcctgggggtcccttagacgtctcctgtgtggcctanggattcactttcagttaatggactggactggagttcggggtccgtccagggtctccgaaggggtaacggggctagggaggtgggttagggacgttttacgaaaaagtaaaatcgattacgggtagaggtaaaagtgtactacggtaggacctaccgtaggaaaggatacgttacgacctatctacgaactagactaataccgaaaagtcggtagtagttagacaaatagactagtacctaggaaaaccggtaggaacacgtaacgccgttactaacttacgtcctaacccaagtacggtaacttacgggtaacggttagaccgttaagtaacgggtaccgttaaagggcggtaacctaaggttcggtaaccttttgaagttacgttccgggtaccgggtcccaaggggtacccctaggttccggg

SEQ ID NO: 114864 - DNA, 737 bp, Homo sapiens
  misc_feature: GYAE6OF02GXQZG.15.86.H09.1.454.CMB.1.raw
  modified_base (335)..(335): a, c, t, g, unknown or other
  misc_feature (335)..(335): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggtatctactttcagttaatggctggatgtagttgggtccgccgaggcctccgaggggaggggcgtgggnggtggggttggtacgtttacgaaaaagtaaaagtgagtagggtagaagtaaaagtacgacgtacggtcgaccgaacccggtagaaaagggaagtacttacgaacctactactacaaagtagtaattaaattaaccgaaaaacggtgggttaagttaacgtttagaactaaacgtaggaaacacgtacctaaacggaaaaccggagggaaaccaccggtacgtaccgttaacttaacttaaccgtaccgtaacccaacgtaacggtaacgttacggggaaacgttggaaccctagttaccgggtaaccgggtaaagggacggtacctttaaggttcggttacgttttagtaagttacgttccgggtacgggggtaccccggaagggtaccgtaaggttccggg

SEQ ID NO: 114865 - DNA, 673 bp, Homo sapiens
  misc_feature: GYAE6OF02IXAT8.15.86.H09.1.454.CMB.1.raw
  modified_base (472)..(472): a, c, t, g, unknown or other
  misc_feature (472)..(472): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttgggtaaacggccgtggggggtccccttaggaggttcctccgttggtggttcgggcccttccgtgggtactttctacttttcagttaaatgggctgggattggaggtttcggggtcccggccagggcctccgagggggaagggggcgtggggaggtgggggttgggtacggttttacaaaaaggtaaaaatgagtggtagaagaaaatagactacggtgacaccggtagaaagaagattcacatctanaagagataatacaaaaacgtacgtagtattagactaaatagaacacgaccgtaagaaaaccgaggacacgacgacccgtctaacttacgtacgtaccaacgagtagttacggaagtcgacgacgtacgtaacggtaaggaggtctacgtgttcgtttagtagttacgttcggtacgggtcccgaagggtactaggttcggg

SEQ ID NO: 114866 - DNA, 711 bp, Homo sapiens
  misc_feature: GYAE6OF02HK618.15.86.H09.1.454.CMB.1.raw
  modified_base (243)..(243): a, c, t, g, unknown or other
  misc_feature (243)..(243): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagcctgggggtcccttagngtctcctgtgtggcctctggattcactttcagtaatggctggatgagttggtccgccaggctccgaggggaaggggcgtggtaggtggggttggacgtttacgaaaagtaaaatgagtggtagaagaaatagactacggtgacgaccgtagaaaggaagacttaccgaacctatacctacgaaagtaagtaattaaacgttaccgaaaaaacggtacgggtttagttaaacgttttagaactaaaattacggaaactaacgtacccgtaaggaaaaacccgacgggaaccaaccgaacgtacccgttacttaacgtttaaccgtacgttaacccaacgtaagtaacgtttaccgggaagttacgacgaacgttaccggaacggttaaagggacggtcttaagttcggttagttttaggaatttacgtccggtacggggtaccccgtaaggggtacctaaggttccggg

SEQ ID NO: 114867 - DNA, 849 bp, Homo sapiens
  misc_feature: GYAE6OF02IWU2M.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacgttaaaaggtgtccagtgtagaagtgcgtaggtggtggagtcgtggggagtccgttagggtaaagccggtgggggtccctagtcgtctccgtgtgtcggcctctggtactctacttacagtaagtcggcgtaggattggtaggtttcggggcccgtcgacggtccgtaccggaggggtaacgggggtcggtagggtacggggttggggttacggttaacggtttaaagtaaaaaacggttaaaagtagtaaggtaggtaaggaaacgtaaagtacgtaacgtaacggtacaccgtaccggtaaggaaaggaacgtaactaccgaactactactacgaaagtagtaaacgtaataaacgtaaaacggtacggttagttaagttacgtaagtaagtaacgaacgtacgaccgtaaacgaaaaccggtacgaaccgtacgtaccggtaccctagttaccttaacgtacccgttaaccgtaaaccgtacgggttaaacgttaacggggttaacctaccggtaaaccgttaacccgggtaaccggttaacgggtaaaccgggtaacgggttaacgtttaccgttaacgggttttactttaaccggttaaaggttacccgggtttacccgggttaacccggggtaacccgggttaacggggtaaccggtttaaggttacccgggg

SEQ ID NO: 114868 - DNA, 703 bp, Homo sapiens
  misc_feature: GYAE6OF02I6E75.15.86.H09.1.454.CMB.1.raw
  modified_base (529)..(529): a, c, t, g, unknown or other
  misc_feature (529)..(529): n is a, c, g, or t
tcagtctacgtagccacgaccggtgctcgatttagtgctatagacttgggtttggggggggagaggagcccccagccttgggatccccaagtgttttcattcaggtgatcaggactgaacacagaggactcaccatggagttcgggcctgacgctgggttttccttgactgctatcgttaaaaggtgtccgagtgtgaagtgcaggtggtggagtcgtgggggatccgttaggtaaacgccgtgggggtcccttaggacgtctccttagtgtcggcctcgtggattctactttcgagtaatgctggatgtaggttcggtacccgccgaggcctacgaggggagggctggtaggtgggtgtacgtttacaaaagtaaatgagtggtagaagtaaagacgtacgtacggtcgtaccgaccggtagaaaggacgtaacgttccaactatacctagaaagataataactaacgaaaaacggtggttaagtaacgtttagaacgtaaatcgaaactcgaccgtaagaaaaccgngaaccgacgacgtcccgtaattattaaccgacgttaacccacgttaattaccgttacggaacgtcgacgtaagtaccggtaacggtaaaggtacgggtaacttaggtaccgtttaacgtttcgtaagttaaccgtcgggtaaccgggtccccgaaggtacggtacttaccgggg

SEQ ID NO: 114869 - DNA, 630 bp, Homo sapiens
  misc_feature: GYAE6OF02JPVFH.15.86.H09.1.454.CMB.1.raw
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
  modified_base (549)..(549): a, c, t, g, unknown or other
  misc_feature (549)..(549): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagctgggttttccttgctgctatcttaaaggtgtccagtgtagaagtgacgaggtggtggagtcgtggggagtcgttaggtaagccgtgggggtccctagagtctccgtgtgtcggcctcgtgtacttcgtactttcaggttaatggcgtggattgaggttggtccgcaggctcgaggaggggctggtagtggtcggtacgtttacaaaaggtaaangagtaggtagagaaatagacgtagngtccacgtagtaaacgatagttcaactatctacaaggtataactaacgtaataaaaccgcgttaagtattaacgtacaaatgaaactacggactaacgaaacgtaagaccacaagtacctattacgtactacgaacctacgagtagttacgaacggttanactacgtacgacgttaagacggtctaagtcggttaactttagtagtagtaccggtggtaacccgcgggttaactgtacggg

SEQ ID NO: 114870 - DNA, 769 bp, Homo sapiens
  misc_feature: GYAE6OF02FX9F3.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtatggctggatgagttcgggtccgccgaggcctccgaggggaagggggcgtgggaggtggggttacggtacggtttacgaaaaagttaaaagtggaagtgggtagaagtaaaagtagaacgtacggtgaccgaacccggtagaaaggaacgtacttaccgactatctacgaaagagaattaagttaaccaaaaacggtcgggttattaagttttacgaactaaaagttacggaaactacggtaacccgttaaaggaaaaacccggtggaaaccaaccgaacggtcccgtttaactaaacgtttaacccgacgttaaccccgaagttacggtaacgtttaccggggaagttcggaaccgtaagttacccgggaaaaggtaaacgggtacggtaaccgtttaggttaccggtttacgtttttaacggaggtttaacggttcccgggtaacccggggggacccctaagggggtaacctaagggtttcccgggg

SEQ ID NO: 114871 - DNA, 816 bp, Homo sapiens
  misc_feature: GYAE6OF02H8X6H.15.86.H09.1.454.CMB.1.raw
tcagtctacgtagccacgaccggtgctcgatttagtgctatagacttgggtttgggggggagaggagccccagcccttgggatcccccaagtgttttcattcagtgatcaggactgaacacagaggactcaccatggagttcgggctgagctgggttttccttgctgctatacttaaaaggtgtccagtgtgaagtgcgaggtggtggagtcgtggggggagtccgttaggaaaggccggtggggggtcccttaagagtcttccgtgtagtcggcctctggattcactttcagtaactggctaggagtgaggttcgggtccgccgtaggctaccgaggggaagggcgtggaggtgggttaggtaacgtttaacaaaaagtaaaatgagtggtagaagaaaagtacgaacgtaacggtcgacgtaccggtaagaaaaggaagtaactaccgtacaattcgtaacaagaataagtaaactaaacgaaaaacgtacggttaagtttaagttagaaactaaagtaacgtaaacaacggtaacctaaaacggtaaaaaccggtaacggaaaccaacgtaaccggtacccggttaaaccttaaacgtttaaccgttaaccggtaaacccctaacgtaaacgggttaacgttaaccgggtaaaggtccgtaaaccgaacggttaaccggaaaacgggttaaaacgggtaaccggtaccttaaagtttacggttaacccgttttttaagaacgttttaacgtacccggggttaaccgggggtaaccccggaaacggggttaaccccgtaaagggtttcccgggg

SEQ ID NO: 114872 - DNA, 742 bp, Homo sapiens
  misc_feature: GYAE6OF02FV881.15.86.H09.1.454.CMB.1.raw
  modified_base (367)..(367): a, c, t, g, unknown or other
  misc_feature (367)..(367): n is a, c, g, or t
  modified_base (674)..(674): a, c, t, g, unknown or other
  misc_feature (674)..(674): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtagaagtgcaggtggtggagtcgtgggggagtccgttggtaaagtccgtgggggtcccttagagtcgtcctgtgtcggccttctggtacttcgtactttcagtaatggctggtatgtaggttggtccgcgaggcctacgagggaggcgtggagtgggtacggacgtttagaaaagtaaanggaagtggagaagaaatagacgtacggtcgaccgaaccggtagaaagggtaagtactaccgactagtaccacgaaagtaactaacttaagttaacaaaaccgggtaggtttcttaaagttttcgaaaacgttaaagtacgaaaaccgtacggtacccgtaaagggaaaaacccgtaggaaccctaaacggccgtaacccgtttagttaaccctttagaccggttaacccagtaccgttaaggttacccggtaaacggtaaccaacgttacggaaggtaaacggtacgtacgttaagtaccgggtttnttttaacggaacttttcgggacccgggttaccggggaaccggtaacgtaacgttaaggtttcccgggg

SEQ ID NO: 114873 - DNA, 788 bp, Homo sapiens
  misc_feature: GYAE6OF02JB4QM.15.86.H09.1.454.CMB.1.raw
  modified_base (313)..(313): a, c, t, g, unknown or other
  misc_feature (313)..(313): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaacgccgtgggggtcccttagagtcctcctgtgtcggcctctggattctactttccgagtaagtggctggatggaggttcgggtccnccgaggcctccgaaggggaaggggcgtgggtaggtggggttggtacgtttaagaaaaagttaaaaagtggtaagttgggtaggaaagtaaaactagaacgttaacggtgaccgtaacccgtaaggaaaacggtaaagtacttaccgaacctatcctaacaaagtaacgtaaattaaacttaacgaaaaaaccggtacggttagttaagtttacggaactaaaacgtacgaaaccgaacgtaaccgttaacggaaaaacccggtaggaaccaaccggtaacgtacccgtttaactaaccgtttaacgtaccgtaacccctaaagtaacgtaacgttaaagggtaaaccgttacggacctaacgtaaccggaaacgggttaaaacgggacggtaacctttaacggttaggttcgtttttaagaacgttacgtcggggttacccgggacccgtaaacgggtaccgtaggtttaccggg

SEQ ID NO: 114874 - DNA, 636 bp, Homo sapiens
  misc_feature: GYAE6OF02HM069.15.86.H09.1.454.CMB.1.raw
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (348)..(348): a, c, t, g, unknown or other
  misc_feature (348)..(348): n is a, c, g, or t
  modified_base (557)..(557): a, c, t, g, unknown or other
  misc_feature (557)..(557): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatcttaaaaggtgtccagtgtgaagtgcaggtggtggagtcgtggggagccgttggtaaagccgtgggggtcccttagagtctctgtgtgcctcgtggattcactttcagtaatggctgntgagtggcncagctcgagggaaggctggaggtgggttggtacgtttacgaaaaagtaaaangagtggtagaagaaaatgtaactacggtgacaccgtaggaaaacggtagacttacgaactactacgtacaaagtagaacttaaagttaaccgaaaaaacggtcggttagttaaagtttagaacgtaaatacgaaacagacctaacggaaaaccggtagaacaacgagccttataacttacgtacgtaaccagtaacgagttacgaagtnacgtatacggaagtaaggtaggtactagtgtactttagacttacgccggtacgggacccgtaagggacctaagttcggg

SEQ ID NO: 114875 - DNA, 631 bp, Homo sapiens
  misc_feature: GYAE6OF02G9BV9.15.86.H09.1.454.CMB.1.raw
  modified_base (263)..(263): a, c, t, g, unknown or other
  misc_feature (263)..(263): n is a, c, g, or t
  modified_base (468)..(468): a, c, t, g, unknown or other
  misc_feature (468)..(468): n is a, c, g, or t
  modified_base (479)..(479): a, c, t, g, unknown or other
  misc_feature (479)..(479): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttggtaaagccgtgggggtccttagagtctcctgtgtggcctntggatcacttcagtatggctggatgaggttggtcccgcgaggcctcggagggaaggggcgtgggaggtggggttggtacgtttaacgaaaagtaaaatgtagtaggtagaagaaagtagacgtaggtcgacaccggtagaaaggaagatacacactactacgaagagtaataataacgaaaacggtcggttattaagttacgaanaaagtgaaacncgtactaacggaaacgacggacacgacgtaccgtacttacgttataccgtaaccacgtaagtgttaacgggaagtcgactagtacggaacgtaagggtacgtactagttcgtactttagaattcgtacgtggaccggaccggaggagtacgg

SEQ ID NO: 114876 - DNA, 609 bp, Homo sapiens
  misc_feature: GYAE6OF02F6998.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttggtccgcaggctccgagggagggctggagtgggtgacgtttcaaaagtaaatgatggtagagaaatagactagtgcaccgtgaaagagatcacatctacaagagataattcaaaaacgtcggtagtatttgacaaatgaactagacctagaaaaccgtgaacacgagccgtatattacacgtaccaacaggtattacggaagtacgacgtaactaccggaacgttaaagggaacggtacgttaagttacggttaccttttaggtacttaacgtccgggttacgggacccgtaagggtaccgtagttaaccgggg

SEQ ID NO: 114877 - DNA, 905 bp, Homo sapiens
  misc_feature: GYAE6OF02G0161.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccgagtgtgaagtgcaggtggtggagtcgtgggggacgtccgttaggtaaaggtccggtcggggggtcccctttaaggtacgttacctccgttggtggttcggtcccgtacgtggtactttctactttcgaagttaaatcgggtcgtcggagttggaggttcgggtcccgccggtaggccttaccggaagggggtaacgggggtcgtagggtagggttcgggggttaggtaaccggttttaacgaaaaaaggttaaaaacgtagtaaggttagggtaaggaaaggtaaaaaagttacggtaaaccgttaaccgggtacggaccgtaaccccgggtaagtaaaacggggtaagtaaccgttaaccgtaccgtaaaccgttacttaacgaaacgtaagtaaacgttaaacttaaaccgaaaaaaccgggttacggttaacggtttaaagtttacgtaactaaaacgttaggaaacccgtaaacgaaccccggaaaacggtacgggtaccaaacgacgtacccgttacgtaacttccgttagtaaccctacgtacgggtaacttacgggtaacgtacgtacgtaaccgtaaccgggtaaaccgttaagggtacggtaccgtttaacggacggttttaccgttttagttaacggttacctttaccgggggtaacccgggggtaccgtaacccggggtttaaaccggacggtttccgggttaaccccgg

SEQ ID NO: 114878 - DNA, 719 bp, Homo sapiens
  misc_feature: GYAE6OF02HF4QM.15.86.H09.1.454.CMB.1.raw
  modified_base (659)..(659): a, c, t, g, unknown or other
  misc_feature (659)..(659): n is a, c, g, or t
  modified_base (679)..(679): a, c, t, g, unknown or other
  misc_feature (679)..(679): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttaggagtctcctgtggtggcctcgtggattcacgttttcagtaagtggctggagtgaggttcgggtccgccgtaggccttccggaaggggaacgggctagggaggtgggttaggacggttttaacaaaaaggttaaaaagtgaagttgggtaagtaaaggaaaaagtaaggtaacgtaacggtagaccgaacccggttaaggaaaaggtaagtactaccaactacgtactaacgaagagtaaacttaattaacaaaaacgtacggttagtagtttagaactaaagagtaaaccacggtaccgtaaacggaaaaaccgaacgggaaacctacgaaccggtacgttaacttaactaacgtttaacggacccaaatacggtaagttacgaacgtgaaccaacgtacgaaggttaaacggngtaacctatgttaacgttanaagttacgcggttaccgggaccggtaagactaggtaccgg

SEQ ID NO: 114879 - DNA, 712 bp, Homo sapiens
  misc_feature: GYAE6OF02F4HHA.15.86.H09.1.454.CMB.1.raw
  modified_base (533)..(533): a, c, t, g, unknown or other
  misc_feature (533)..(533): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtggggggagccgttagggtaaagccgtgggggggtccccttaggaggtctcctgtgtggcctctggattcactttcagtaatggctggatggtggttcgggtcccgcgaggcctccgaggggacgggggctgggaggtggggttggtaccgtttaacgaaaaagttaaaagtgagtaggtaggaagtaaaagtagaacgttacggtgaccgaccgtaggaaaggaagtacttaccaaccattctaacgaagagtaataacgtaacaaaaacggtgttagttaatttagaactaaatcgaaactacgaccttaagaaaaccgganaacgacacggccttagtaacttaaccgtcgtaacccaagtacgtaacggttacgggaaacgttcgaaccgtaaggtaccggtaaggttaaacgggacgtagttaccgttagtttaccgtttagtaacgttacggtttaccgggaacgggtcccgaaggggttaccctaggttacccggg

SEQ ID NO: 114880 - DNA, 566 bp, Homo sapiens
  misc_feature: GYAE6OF02FL7LT.15.86.H09.1.454.CMB.1.raw
  modified_base (487)..(487): a, c, t, g, unknown or other
  misc_feature (487)..(487): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccttggtaaagcctggggggtcccttagagtctcctgtgtggcctctggattcactttcagtaatggctggatgagttgggtccgcaggctccgaggggaaggggctggagtgggttggacgtttacaaagtaaaatgatggtagagaaatagactacggtgacaccgtagaaaggagattcacatctacaagagataattacaaaacgcgtagtatttgacaaatgaacagcctagaaaccgaggacacagccgtactattacgagtaccanagtacttacggaagtcgacagtcgacggtaaggaggtctagtgtctttgattatcggtacgggccagggacagttcggg

SEQ ID NO: 114881 - DNA, 977 bp, Homo sapiens
  misc_feature: GYAE6OF02H6B6T.15.86.H09.1.454.CMB.1.raw
tcagtctacgtagccacgaccggtgctcgatttagtgctatagacttgggtttgggggagaggagccccagccttgggatccccaagttgttttcattcagtgatcaggactgaacacagaggactcaccatggagttcgggctgagctgggttttccttgctgctatcttaaaaggtgtccagtgtgaagtgcgaggtggtggagtcgtgggggagtccgttagggtaaacgccgttcggggggttacccctttaaggacgttccttcccgttggttcggtcgggcccttcgttagggtacttttaccaaccgtttttccgaaggtttaaagtcggggtaccttagggtagttagggtaacggtttcgggggtccccggtaccccggagggtcccgttaacccgggaagggggaaacgggggtccgttagggggtaacgggttgggggtttacgggtaacggtttttaaccgaaaaaaggtttaaaaaacgtaggtaaggtagggttaggaaaaggtaaaaagtaacgggaaaccgttacgggtacgaccgtaaccccggtaagggtaaaacgggtaaacgtaacgttaaccgaacctaacgttaccgtaccgaaaaggtaacgtaaacgtttaaacttaaaccggtaaaaaaaccgggttacgggtttaagtttaacgttttacggtaaaaccgttaaagttaaacgaaaccgtaacggtaacccgtaaacgggtaaaaaccccggaagggtaaccaacccggtaacggtaacccggtactttaaacgttaccgttaaccgtaaacccgtaaccgttaacggtaacgttttaaccgggaagttacgaaccgtaacgttaaccgggtaaacggttaaacggggacggttacgttaacgttcggttaacgtttttagacgttacggttaccgggttaccgggggtacccgtaacgggtacggttaacggttccgggg

SEQ ID NO: 114882 - DNA, 693 bp, Homo sapiens
  misc_feature: GYAE6OF02JBATP.15.86.H09.1.454.CMB.1.raw
  modified_base (312)..(312): a, c, t, g, unknown or other
  misc_feature (312)..(312): n is a, c, g, or t
  modified_base (655)..(655): a, c, t, g, unknown or other
  misc_feature (655)..(655): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttggctgctatcttaaaaggtgtccagtgtagaagtgcgaggtggtggagtcgtggggagccgttggtaaagccgtgggggtccttagacgtctccgtgtgtggcctcgtggtatcgtacttcgagtaatggctggatgtaggttggtccgcnggctcggaggagggcgtggaggtggttggaccgttagaaaagttaaaacgtgagtgtagaagtaaaatagaacgtacggtgaccgaaccgtagaaaggtaagaattacaccgtacgttcaacgaagtaacgtacttaaataaccgtaaaaagtaacgggttagtttaaagttcggaaacttaaatacggaaacgttacgaaccgtaacgtaaaaccgacggtaaaccaacctacgtacggttacctaacgttacgtacgtaaacccaagtacgtaacttacgggtaaactcggaaccttacggtaaccgaggtaaacggacggttccgaagttcgtcgtttanaagttacggtcgtccgggacctacggatacgttacggg

SEQ ID NO: 114883 - DNA, 756 bp, Homo sapiens
  misc_feature: GYAE6OF02G100O.15.86.H09.1.454.CMB.1.raw
  modified_base (571)..(571): a, c, t, g, unknown or other
  misc_feature (571)..(571): n is a, c, g, or t
tcagtctacgtagccacgaccggtgctcgatttagtgctatagacttgggtttggggggagaggagcccccagccttgggatccccaagtgttttcattcagtgatcaggactgaacacagagactcaccatggagttcgggctgagctgggttttccttgctgctatacgttaaaaggtgtccagtgtgaagtgcgaggtggtggagtcgtgggggagtccgttaggtaaagccggtgggggtcccttagacgttctccgtgtgtcggcctcgtgtattctactttcgagtagtggctggatggaggttcggccgccaggcgtccggaggggagggcggtggtagggtgggttggtaacgtttaagaaaaagttaaaagtgtaagtggtagaaagaaaagtacggtaacgtacggtacgaccgaaccggtaaggaaaaggtaagtaacttaccaacctactacctaacgaaagtaagtaaattaacgttaaaccgaaaaacggtcggttaagtttaatttacggaactaaaagtacggaactaccggtaccgtaaacggaaaaacccggngaaccaacgtaccgtaccttacgttaacttacgaccgtaacgacgtaaggttaacgttacgaagtcgtaacgtacgtaccgggtaaagggtaacggtacgtaccgttagtttaccggtttacgtttagtaaccgttccggtaccgggtacccggggtaaccggtaagggtacgttacggttcggg

SEQ ID NO: 114884 - DNA, 794 bp, Homo sapiens
  misc_feature: GYAE6OF02H8TW0.15.86.H09.1.454.CMB.1.raw
  modified_base (167)..(167): a, c, t, g, unknown or other
  misc_feature (167)..(167): n is a, c, g, or t
  modified_base (180)..(180): a, c, t, g, unknown or other
  misc_feature (180)..(180): n is a, c, g, or t
  modified_base (334)..(334): a, c, t, g, unknown or other
  misc_feature (334)..(334): n is a, c, g, or t
  modified_base (618)..(618): a, c, t, g, unknown or other
  misc_feature (618)..(618): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttcctgctgntatcttaaaaggngtccagtgtagaagtgcgtaggtggtaggagtcgtgggggagtccgttagggtaaacgccgtggggggtccctttaggacgtcctccgtagtggtcggcctcgtggattccactttcgagttaatggtactgggactggtagttcgggtacccncgtaaggcgtaccgaagggaacgggggtctgggacggttggggtaggtaacgtttaacgaaaaaagttaaaaagtggtaagttgggttaagaaaggtaaaaacgttaggaaaccgttaacgggtaccgaaccgtaaacccggggtagaaaaacggaacggttaactttacgaacccgtaaatccgtaacgaaacgtaagaacctttaaataaccgaaaaacgggtacgtagttaactttaggaactaaagactaaacgaacggtacctaacgggaaaaaccggngaaccaacgttaacgacccgttagtaacttaccgtacgtaacccgataaacgggtcgtttaacgaagtcggaactaacgttacgaaccggttaaagtccgggtaacttagttaaggtcgttttaccaagtttacgttccgggaagggccccttaaacgggggataacggttcgggg

SEQ ID NO: 114885 - DNA, 777 bp, Homo sapiens
  misc_feature: GYAE6OF02JXQXS.15.86.H09.1.454.CMB.1.raw
  modified_base (288)..(288): a, c, t, g, unknown or other
  misc_feature (288)..(288): n is a, c, g, or t
  modified_base (688)..(688): a, c, t, g, unknown or other
  misc_feature (688)..(688): n is a, c, g, or t
tcagtctacgtagccacgaccggtgctcgatttagtgctatagacttgggtttggggggaggagggagccccagccttgggatcccaagtgttttcattcagtgatcaggactgaacacagaggactcaccatggagttcgggctgagctgggtttccttgcttgctatcttaaaaggtgtccagtgtgaagtgcgaggtggtggaggtcgtgggggagccgttgggtaaacgccgtggggggtcccttaggcgtcgtccgtgtgtcggcctcgtggattcacttttnacgtaatcggctggtatgtacggttgggtcccgcgaggtcctaccgaggggaaggggtcgtgggacggttgggtacggtacgtttacgaaaaagtaaaacgtgaagttgggagaagtaaagtagaacgtacggtcgaccgtaaccggtaagaaaggggtaaacagtttacaacccgtaatccgtaagaaccggtaaagtaacttaaacgtttaacccggaaaaaaacggtccggggttttaatttaaacgtttaacgggaaaccttaaaagttaacggaaaccgtaaacgtaacccggttaaaggaaaaacccggaggtaaacccgaacgtaaccgtacgtacgttaacttttaaccgacgttaaccgaacggtagtaacgtttaaccgggaatccgtanaccggtagtaaccgtaggcgtaacgttatacgtgttttaacggacttacggttcggtccggggaaccctaaggggtcctaacggtcggg

SEQ ID NO: 114886 - DNA, 797 bp, Homo sapiens
  misc_feature: GYAE6OF02F71OT.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttagggtaaacgccggttggggggttccccttaggacgttcttccgtggtcggtcggtcctcgtggtacttctacttttcagtaagtggctggatggtaggttcgggtcccgccgaggccgtaccggaaggggaaggggcgtgggtaggttggggttaggtaacggtttaacgaaaaaaggttaaaagtggtaagtaggtagaaagtaaaagtacggaacgttacggtagaccgtaacccggtaaggaaaacggtaatacttacccaaccgtaactaccgtaacgaaaaggtaataaacgttaaacgtttaaaccgaaaaaacggttacgggtttagttaaatttacgaaacttaaaagtaacggaaacctacggtaaccctaaaacgggaaaacccgtagaaaccaaccgtaacgtacccgttaacttaagttaccgtaacgtaaccaacgtaacggtaacgttaacgggaagtcgaactacgtaacccggtaaggtaaaggcggtaactagttacggttattttagaagttgttaccgggtaccggggacccgtaagggtacctaggttccgg

SEQ ID NO: 114887 - DNA, 760 bp, Homo sapiens
  misc_feature: GYAE6OF02FXN3K.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaacgccgtcgggggtccttagagtctcctgtgtggcctcgtggattcactttcagttaatggctgggataggtaggttgggtcccgccgagggcctaccgaggggaaggggccgtgggtaggttggggttaggtaacggtttaacgaaaaaggttaaaaagtaggtaagtagggtaggtaaaacgtaaaaagtacggtaacgttaacgggtacgtaccggaacccggttaaggaaaacgggaagtaacgtttaccgaacctaacgttacctaaccgaaaggtaacgtaacttaaagttaacccaaaaaaccgggtaacgggtttaagttaagttttacggaaacgtaaaactacggaaacgtaacggaccgttaaccggaaaaacccggaggaaacccgaacgtaaccgtaccggttaacttaacttaccgttaccgtaaccaacgtaacgtacgttacggaagtcactaagtcggaacgtaaggacggtactagtgttatttagatcggtcgtcgggacgtacgatagtcgg

SEQ ID NO: 114888 - DNA, 830 bp, Homo sapiens
  misc_feature: GYAE6OF02GHRNP.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctgggggagccgttggtaaagccgtgggggtcccttagagtctcctgtgtggcctctggattcacttcagtaatggctggatgagttggtccgcgaggctcgaggggaaggggcgtgggaggtgggttgggtacgtttaacgaaaaggttaaaaataggaattgggtagaaggtaaaaataggaacgttacggtcggaccgaaccccggttaggaaaagggtaaggtaacgttaccaaaccgtaactacccgttaacgaaaggtaaaggtaaacttaaacgttaaccggtaaaaaaaccggtacgggttaagtttaagtttttaacggaaccgtaaaaagttacgaaaacgtaacggtacccgttaaaacggaaaaacccggaaacgggaaccgtaaccgaacgggttaccccgtacgtttaaacgtttaacgttaccggttaacccaaccgtaacgggtaacgttttaaccggggaaagttacggtaacgtaacgtaccgggttaaaccggtaaaggggtaaccggtacgttaaagttcggttaaccgtttttaaggtaacgttacgttcccgggtaacgggggtaccccgtaaacgggggtaacctaaggggtttacccgggg

SEQ ID NO: 114889 - DNA, 690 bp, Homo sapiens
  misc_feature: GYAE6OF02I0DBH.15.86.H09.1.454.CMB.1.raw
  modified_base (600)..(600): a, c, t, g, unknown or other
  misc_feature (600)..(600): n is a, c, g, or t
tcagtctacgtagccacgaccggtgctcgatttagtgctatagacttgggtttggggggagaggagccccagccttgggatccccaagtgttttcattcagtgatcaggactgaacacagaggactcacccatggagttcgggctggagcttgggttttccttgctgctatacgttaaaaggtgtaccagtgtgaagtgcgtagggtggtggagtcggtaggggagccgttaggtaacgccgtcgggggtcccttagacgtctcctgtgtcgcctcgtggattctactttctagtatggcgtgagtgtaggttcggacccgcgaggccgtacgagggaacggggtcgtgggaggttggggttaggtacgtttaacgaaaaaggttaaaagtaggtaagtggtaagaaagtaaatacgaacgtacggagtaccgaaccggtagaaaacggatagttaccactatacacaaagtataataaactaacgaaaacggtagtagtattagaaactaagtacgaactaacgtaccgtaaaggaaaccgaagacgacaccggtaccttactaaagttaccgtacgactacagtaacggtacgttaancggactaagtaccggaaggtaacggtagtaagtaccgttggttctttaggattacggtccggtcgggaacccgtaggtaccgtgtaccgg

SEQ ID NO: 114890 - DNA, 623 bp, Homo sapiens
  misc_feature: GYAE6OF02G3TNU.15.86.H09.1.454.CMB.1.raw
  modified_base (187)..(187): a, c, t, g, unknown or other
  misc_feature (187)..(187): n is a, c, g, or t
  modified_base (327)..(327): a, c, t, g, unknown or other
  misc_feature (327)..(327): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
tcagtctacgtagccacgaccggtgctcgatttagtgctatagacttgggtttggggtccactgggcagtctcgaatagagctcttggaagtccctccaaaccatggcctgggtctccttctacctactgcccttcattttctccacaggtctctgtgctctgcctgtgctgactcacgcccccgtntgcatctgccttgctgggagcctcgatcaagcctcacctgccaaccctaagtagtgagcataccgaacctacaccatcgaatggtatacaacagagaccagggaactcccccagtactataatagaaagttaagagtagngtggcagaccacaccgaagggggacggactccccgatcgctnagtggctcgagttcgngggtctcgaccgtctacctccacctactcctacccaccctcacgttactcgacgatggacggtcgtagtacgtatccgacgtaggttgggaagacggaacgaccaacctaactaaagttggacgttacgggacccgtaaagggtaccgggggtttggggttacgggttcggggacgggtaacgggtaaccggaaggtccggtaccggtacccggttaccggtacggtccgtaacccgg

SEQ ID NO: 114891 - DNA, 675 bp, Homo sapiens
  misc_feature: GYAE6OF02F6GI8.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttggtaaagccgtgggggtcccttagagtctcctgtgtggcctctggattcactttcagtaatggctggatgagttgggtccgccgaggcctccaggggaaggggcgtggagtgggttaggtacgtttacaaaagtaaaatgatggtagaagaaaatgtaacgtacggtgacgaccgtaggaaaaggaagacgttcaacatctacgaagataataacttaacgaaaaacgtacggttagttaatttacgaactaaagtacgtaaactacgtaccgtaacggaaaacccgagaaccacgacgtcccgtattacttacgtacgaaccacgaagttacgttacgggtaactcgtacacgttacggtaacgtaaagggtacgtacgttactttaggtacctttttaggaatttacgtttccggggaccgggtacccggaaggggtaccgacggttcggg

SEQ ID NO: 114892 - DNA, 729 bp, Homo sapiens
  misc_feature: GYAE6OF02FFF8O.15.86.H09.1.454.CMB.1.raw
  modified_base (147)..(147): a, c, t, g, unknown or other
  misc_feature (147)..(147): n is a, c, g, or t
  modified_base (273)..(273): a, c, t, g, unknown or other
  misc_feature (273)..(273): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcggctgagcngggttttcctgctgctatcttaaaaggtgtccagtgtgaagtgcaggtggtggagtcgtgggggagccgttgtaaagccgtgggggtcccttagagtctcctgtgtggctctggattcgtactttnagtaatggctggaatcgtaggtttcgggtccgccgaggccgttaccgagggggtaaggggcgtggaaggttggggttacgtacggttttaacaaaaaaggttaaaaatggtaagttgggtagtaaacgaaaaagttacggaacgttacggtacgtccgaaccccgggtaagtaaaacgggaaagtacttaccgaacctagttaccttaacgaaacggaagtaaacttaacgttaaacgaaaaaccggtacggttagttaagttttagactaaagtacgaactacgaaccttacggaaaacgagtaaccacagccgttatacttacgctaaccagtagtaacgttacggaagttcgaccgtagtacgtaaccggtaaggacggtacttaagttggtaccgtttttagaacgttaactcgggttaacggggaccctagggggtaacctaggttaccgg

SEQ ID NO: 114893 - DNA, 791 bp, Homo sapiens
  misc_feature: GYAE6OF02JQIZ2.15.86.H09.1.454.CMB.1.raw
  modified_base (177)..(177): a, c, t, g, unknown or other
  misc_feature (177)..(177): n is a, c, g, or t
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (352)..(352): a, c, t, g, unknown or other
  misc_feature (352)..(352): n is a, c, g, or t
  modified_base (707)..(707): a, c, t, g, unknown or other
  misc_feature (707)..(707): n is a, c, g, or t
  modified_base (723)..(723): a, c, t, g, unknown or other
  misc_feature (723)..(723): n is a, c, g, or t
tcagtctacgtagccacgaccggtgctcgatttagtgctatagacttggtttggggggaggaggagccccagccttgggatccccaagtgttttcattcagtgatcaggactgaacacagaggactcaccatggagttcgggctgagctgggtttccttgctgctatcttaaaggtntccagtgtagaagtgcaggtggnggagtcgtggggganccgttggtaaacgccgtgggggtccctagagtctccgtgtggtggcctcgtaggtattcacgtttcagttaatggactgggatgtaggttcgggtccgtccgacgggctacccgtaggggaacggggtcctaggggnggttagggttcgggtaaccggttttaccgtaaaaaggttaaaaagtggtaaggttacgggttaggaaagtaaaaagttacggaacgttaaccgggtggaacccttacccgggtaagaaaacgggtaacggtaattaccgaaaccccgtaagtttaccgtaacgtaaaaccggtaaggtactttaaaacgtttaccggaaaaaaaccgggtccgggtttaagttaagttttaacgaaccgtaaaagtacggtaaaccgacgttaacccgaaacggtaaaaccggacgggtaaccaaaccgtgacccgttactaacgttacgtaccacctacggaaacgtgttaaccggaggttaanccgtagtaccgggtanaaagggcgtacgtatggttaaccttggtaattcggacgttccgggaccggtagaccggtagttccggg

SEQ ID NO: 114894 - DNA, 630 bp, Homo sapiens
  misc_feature: GYAE6OF02HG5LG.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtcggttcgtgacgtgctatacgtaaagtgtcagtgtgaagtgcagtggtgagtctggggagccttgtaagctgggggtccttagagtctcctgtgtggtcctctaggattcgactttacgagtaatggctggatgagttggtcgcaaggctccgagggaggctggagttaggtgtacgttacaaaaggtaaatacgtagtgtagagaaaataggaactaggtgcacccgtagaagaagattacgacaagtctagaagagtaacgtaattaccgaaaaacgtaccgggttattaagttagaacgtaaaagtagtaaacaacggcctaaacggaaaacgacgggaaacctagaacgaccggttacaacttacgtacgtaccaaccagtattaccggaagtccgatacgtaagaccgttaaggacggtctagtagtacttagtactagttacgaccgggtaccgaacggtacgtagttacggg

SEQ ID NO: 114895 - DNA, 703 bp, Homo sapiens
  misc_feature: GYAE6OF02F7M7N.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttagggtaaagccgtgggggtcccttagagtctcctgtgtggcctcgtggattctactttcagtaatggctggatgtaggttgggtcccgccgaggctccggaggggagggggcgtgggaggtgggttggacgtttacgaaaagtaaaatgatggtagaagaaaatagacgtacggtagaccgaacccggtaggaaaagggaagtacttacaacctatcctacaagagtaataacgttaacaaaaacgtacggtagtttaagtttgaactaaatacgaaactacggacctaaggaaaaaccgacggaaccaaccaacggtccgtaccttaattaccgtacgtaccaacgtacggtaacgtttacgggaagttcgaaccgtacgttaccggaacggtaaacgggacggttaaccgttagtacggtttaccgtttagtaacgttcgtccgggttacggggaccccgtaagggtactaaggtttcgg

SEQ ID NO: 114896 - DNA, 653 bp, Homo sapiens
  misc_feature: GYAE6OF02JH2BM.15.86.H09.1.454.CMB.1.raw
  modified_base (609)..(609): a, c, t, g, unknown or other
  misc_feature (609)..(609): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtccttagagtctcctgtgtggcctgtggattcacttcagtaagtggctggagtgtaggttcgggtccgccgaggcgtccggaaggggaaggggcgtgggaggtgggttcggtaacgtttaacgaaaaagtaaaagtggaagtggtagaagaaagtagacgtacggagacgaccggtaggaaaggaagtattacgacactctacgaaagataactaactaacgaaaacggtggttagttaagttagaacaaagtacgaacgtacgacctaaggaaaaccgagtacaacgtagtacctagttactacttacgaactacgaacgtacgtacgagtagactagtaaccgagtaaaggaggtacctaagtcggttntttaacgagttacggttacggcgggacccgaaggtactggtcgg

SEQ ID NO: 114897 - DNA, 819 bp, Homo sapiens
  misc_feature: GYAE6OF02IQ5Y7.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttcctgctgctatacttaaaggtgtccagtgtgaagtgcgaggtggtggagtcgtgggggagtccgttaggtaaacgccggttgggggtcccttaggacgttcctccgtgtgtcggtccttcgtggtattctactttcagtaatggtctaggtattggtaggttcgggtacccgccgaggtccgtacccgggtaagggggaacgggggtccgtaggggtagggttcgggggtttacgggtaaccggtttaaacggaaaaaacgttaaaagtacggtaagttagggtagtaaagtaaaagtaggtaaccgttaacggtacgaccgtaaccggtaggtaaaaacgggtaacgttaacttaccgaaccgtatacgtaacgtaaaggtacgtaaattaaacgttaaaccgtaaaaacggtacggttaattaagtttacgaactaaagtacgaaacgtacggaacctaacggaaaaccgtacgaaccgtactacggttacctacttaacttacctacgtaacccgtaagtaacgttaagtaaccggtaagtacgtaacgacggttaaccggtaacggttaaggtacggtacgttaacggtacgtttcgtttaaggtacttaacgggttcggtacccggggtaccgtaaggtacccgtaggttcccggg

SEQ ID NO: 114898 - DNA, 628 bp, Homo sapiens
  misc_feature: GYAE6OF02HL2SN.15.86.H09.1.454.CMB.1.raw
  modified_base (484)..(484): a, c, t, g, unknown or other
  misc_feature (484)..(484): n is a, c, g, or t
  modified_base (532)..(532): a, c, t, g, unknown or other
  misc_feature (532)..(532): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaagtgtccagtgtgaagtgcaggtggtggagtcgtgggggagccttggtaaagccgtgggggtcccttagagtctcctgtgtgcctctggattcacttcagtaatggctggatgagttggtcgcgaggctccgagggaagggctggagtgggttggtacgtttacgaaaagtaaaagtgaagtggtagaagaaaatagactacggtgacaccgtagaaagaagacttacaaccatactacgaagtacgaattaataacgaaaaacgtggtataagtttagaacaaatagaaacacgacctaacgaaaacgngaacacacgcctagtaatacgtactaccactaagacgttacggaagtnacgtagtaccgtaaggtaaaggacggtataacgttcgtaacgttttagaacgttacggtacggtaccgggacccggtaaggtacgtaagtaccggg

SEQ ID NO: 114899 - DNA, 673 bp, Homo sapiens
  misc_feature: GYAE6OF02F0740.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtggggggtccccttagagtctcctgtgtggcctctggattctactttcagtaatggctggatgaggttcgggtccgccaggctccgaggggacggggctgggaggtgggttcggacgtttacgaaaagtaaaatgaagtggtagaagaaaagtagaacgtacggtgaccgacccggtagaaaagggatacgttacaaccgtatcctaacaaagagtaattaacttacaaaaacggtggttagtactttagactaaatagaaacgacgaccgtaacggaaaaccgagaacaacgacgtacccgtactaacttacgtacgtaacccagtacgtaacttaccgggaactcggtactacgtacgtacggtaaaggacggtactaagtcgttacgttttgaacgttcgtacggtaccgggtaccgtacggggaacttaggtccggg

SEQ ID NO: 114900 - DNA, 780 bp, Homo sapiens
  misc_feature: GYAE6OF02HWXG4.15.86.H09.1.454.CMB.1.raw
  modified_base (732)..(732): a, c, t, g, unknown or other
  misc_feature (732)..(732): n is a, c, g, or t
tcagtctacgtagccacgaccggtgctcgattttagtgctatagacttgggtttggggggggagaggagccccagccttgggatccccaagtgttttcattcagtgatcaggactgaacacagaggactcaccatggagttgggctgagctgggttttccttgctgctatcttaaaaggtgtccagtgtgaagtgcaggtggtggagtcgtggggagccgttggtaaagccgtgggggtccttagagtctctgtgtcggcctcgtggattcgactttcagttaagtggctggattggtaggttcgggtccgccgaggctccggaaggggaacgggtcgtgggagggttggggttaggtaacgtttaacgaaaaaagttaaaaagtggtaagttagggtagaaagtaaaagtagaacgtaacggtgaccgtaaccgtaaggaaaaggtaagtaacttaccgaacctaattaccgtaacgaaagagtaaactttaaacgttaaaaccgaaaaaaccggttacgggttaagtttaaagttttacggaactaaaaaacgtcggaaaacgtacggtaccgttaaaacggaaaaaacccgggtaggaaacccaacggaaccgtcccggttaaattacgttaaccgtacgtaacccgaagtaacgtacgttacgggaaattcggaactaggtaaccggaacggttaaagggcgtacgttaacgttagttccgttttaanacgttacgtacgggtaccgggaacccgtaagggtacgtaacgttcggg

SEQ ID NO: 114901 - DNA, 772 bp, Homo sapiens
  misc_feature: GYAE6OF02HG09X.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtgggggagccgttaggtaaagccgtgggggtcccttagagtctcctgtgtcggcctcgtggattctactttcagtaagtggcgtggagtgtaggttcgggtccgccgaggcctccggaaggggaaggggcgtagggaggttggggttaggtaacgtttaacgaaaaagtaaaaagtggaagtaggtagaaagtaaaagtagtaacgtacggtagaccgaaccggtaaggaaaaggaagtaacgtaccaaccgtattacctaacgaaagtaagtaagttaaactaaaccgaaaaaacggtcgggttaagtttaagtttagaaactaaaagtacgaaacgacgtaaccgaaacggtaaaaccgaacggaaaccacgaaccggtaccttaaccgttaacttaaccgttaccgtaacccgaacgtaacgtaacgttaacgggtaaacgtacgtaacgtaaccgttacggaacgggttaaacggaaggtaccttaggttacgtttacgtttaaggtacttaacggtccggtaaccggggacccgaaggggtaactaaggtccggg

SEQ ID NO: 114902 - DNA, 677 bp, Homo sapiens
  misc_feature: GYAE6OF02GLJ3F.15.86.H09.1.454.CMB.1.raw
  modified_base (166)..(166): a, c, t, g, unknown or other
  misc_feature (166)..(166): n is a, c, g, or t
  modified_base (313)..(313): a, c, t, g, unknown or other
  misc_feature (313)..(313): n is a, c, g, or t
  modified_base (657)..(657): a, c, t, g, unknown or other
  misc_feature (657)..(657): n is a, c, g, or t
tcagtctacgtagccacgaccggtgctcgatttagtgctatagacttgggtttgggggggagaggagccccagcattgggatccccaagtgttttcattcagtgatcaggactgaacacagaggactcaccatggagttcgggctgagctgggttttccttgctgntatcttaaaaggtgtccagtgtgaagtgcaggtggtggagtcgtgggggagccgttaggtaaagccgtggggggtcccttagacgtctccgtgtgtcggcctctggattcactttcagtaagtggctggatggtaggttcgggtccncgaggctccgaaggggacggggctagggaggttggggttacggtacgtttacgaaaaaggttaaaacgtggagtaggtagaaagaaaagtagacgttacgggcgtaccgaccggtaagaaaggtaagtaacttaccaacctactactacgaaggaagtaattaaacttaaacgaaaaaccggttcgggttaagttaactttacgaacttaaaagtcgtaaaccacggtaaccgtaaagaaaacccgggtagaaccaacgacggtctacttaatacgttacgaccacgtaagttacgttacgaaagtcgactagtacgacggtaaggctatacgtgttattgatntcggacggaccaggactagg

SEQ ID NO: 114903 - DNA, 616 bp, Homo sapiens
  misc_feature: GYAE6OF02HUHJR.15.86.H09.1.454.CMB.1.raw
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (456)..(456): a, c, t, g, unknown or other
  misc_feature (456)..(456): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttagggaaagccgttggggggttcccttaggacgttcctcgtgtgtcggcctctgggattcactttcagtaatggctggntgngttgggtcgcaggctccgagggagggctggngtggggttggacgtttacaaaagtaaaangagtgtagaagaaatgacgtagtgcacgtagaaganatcacatcncaagagataataacaaaacgtcgtagttattacgactaaatagaacncgactaaggaaaacgagaacgaccagtcccgttactaattacctacgttaccaagtagtaccgttagacggatcaagtcgtaacgtaacgggagtcctaagttggttacttttaggacttacgacgggttacgggacccgaagggtactaggtaccgggg

SEQ ID NO: 114904 - DNA, 707 bp, Homo sapiens
  misc_feature: GYAE6OF02GZYRC.15.86.H09.1.454.CMB.1.raw
  modified_base (647)..(647): a, c, t, g, unknown or other
  misc_feature (647)..(647): n is a, c, g, or t
  modified_base (660)..(660): a, c, t, g, unknown or other
  misc_feature (660)..(660): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttggtaaagccgtgggggtccttagagtctcctgtgtgcctctggattctacttcagtaatggctggatgtagttcggccgcaggctacgagggagggcgtggaggtgggttggacgtttacgaaaagtaaaatgagtggtagaagtaaaagtacgtacgtacgggtagaccgtaacccggtaaggaaaagggtaagtaacttaccaaccgtattacctaccgaaagaagtaattaaactaaccgaaaaaccgggtaggtttacgttagtttacgaactaaaagttacggaaacaccggtaccctaaacggaaaaccggacggaaacccgacgaacgtacccgttaacttacttaacccgtactaccccgagtaaccgttaagttaccggggaactggactaacgtaccggtaaggtaaacgggngtactattggttntttagatttagcggttaccgggacccgaaggtacgtaaggttccggg

SEQ ID NO: 114905 - DNA, 685 bp, Homo sapiens
  misc_feature: GYAE6OF02HOFCT.15.86.H09.1.454.CMB.1.raw
  modified_base (309)..(309): a, c, t, g, unknown or other
  misc_feature (309)..(309): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggattcgggctgagctgggttttcctgctgctatacttaaaaggtcgtccagtgtgaagtgcaggtggtggagtcgtgggggagccgttgggtaaagccgtcgggggtcccttagagtctcctgtcgtggcctctggattcactttcagtaatggctggactgaggttcgggtccncgaggcctacgaggggaagggtctggaggtgggttggtacgtttacaaaagtaaatcgtaagtggtacgaacgtaaatacgacgtacggttgaccgtaacccgtaggaaaggaacgtactaccaactacttacctacgaaagtatactaaaattaccgaaaaacgtcggttagttaattacgaactaaagttacgaaactacgtacctaaaggaaaacccggtaggaactaccgacgtcctacgtattacgtacctaacacgtacgtacgtttacgaagtcaccgtaagtacgaaccggttaggaaccgttacgtacttaggtctttagtaattcggtaccggtaccgggtacccgaacggtacgtacggtaccgg

SEQ ID NO: 114906 - DNA, 669 bp, Homo sapiens
  misc_feature: GYAE6OF02GAI3X.15.86.H09.1.454.CMB.1.raw
  modified_base (555)..(555): a, c, t, g, unknown or other
  misc_feature (555)..(555): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttggtaaagccgtgggggtcccttagagtcctcctgtgtggcctcgtggattcactttcagtatggctggatgagttgggcccgccaggcctccgaggggaggggcgtgggaggtggggttggacgtttacaaaaaggttaaaataggtagtagggtagaagtaaaagtagaacgttacggtacgccgtaacccgtaggaaaagggaagacttaccaacactctacgaagagaattaaactacgaaaaacggtacggttagttaactttaggaactaaagtacgaactagacctaaaggaaacccggaagacgaacgacgtccgtactacttaaccncgttaacccaagtacgaggttaccggaatcggctacgaacggacgtaaaggcggtattgtcgttcgtttagagttacgtcgggtccgggacccgtaagggtacctaggttccgg

SEQ ID NO: 114907 - DNA, 825 bp, Homo sapiens
  misc_feature: GYAE6OF02GMRDK.15.86.H09.1.454.CMB.1.raw
  modified_base (752)..(752): a, c, t, g, unknown or other
  misc_feature (752)..(752): n is a, c, g, or t
tcagtctacgtagccacgaccggtgctcgatttagtgctatagacttgggtttggggggaggaggagccccagccttgggatccccaagtgttttcattcagtgatcaggactgaacacagaggactcaccatggacgttcgggctgagctgggtttcctgctgctatactaaaggtgtcagtgtgaagtgtctaggttgggtgggagtcgtgggggacgtcccgttaggtaacgtccggtcgggggtcccgttaggacgttcctaccgtggtggtacggtccttcgtggtacttcgtactttcgtaagttaagtggtacgtaggagtaggtacggttcgggtccccgccgtacggtccgttaccggaaggggtacggggtcggtagggtacgggttacggggttacgggttaacggtttaacgtaaaaaggtaaaactcggtaacgtagggtacggtaaaagaaaacgttacggtaacgtacgggtacggtaacccgtaaccgggttaaggtaaacggtaagtacttaccacctaacgtacctaacgtaaaggtaactaagttaaacgtaaccgaaaaacgggtcggtttaattaacgttttaaggaaccttaaagtacgtaaacgtacgtaccgtaaaacggaaaccggtaggaaccacggtaacgtcccgtttaacgtaacgtttaaccacggttaaccgacgtaggttacgttaccggaatcgaactacggtacggaacgggtaaggngtacgttaacgttcgtttaacgttaggtacttcggtaccgggaccggtccggtaaggttaccgtaggttcggg

SEQ ID NO: 114908 - DNA, 898 bp, Homo sapiens
  misc_feature: GYAE6OF02G1HPD.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcgtaggtggtggagtcgtgggggacgtccgttagggtaaacgtccggttcggggggttccccttaaggtacggttccttccgttggttcggtcgggtccccttccgttggtactttccgtaccttttacgaacgttaaagtcggtcgtggtagttcggtacggtttcgggtcccgccggacggtccgtccgggaagggggaacggggtccggtaggggtaacgggttgggggttacgggttaaccggtttaaacgtaaaaaacggtaaaaacgttgggtaagtaggggtaagtaaaaaggtaaaacgttaacggtaaaccgttacggtaccgtaacccgtaaccggtaaaggtaaaacggtaacggtaacgttaaccacctaagtacctaacgaaagtaacgtaaacgttaaactaaacggtaaaaaccggtcggttaattaagtttacgaaacttaaagtaaggaaaccgtaacgtacccgtaaaaggtaaaacccggacgggtaaaccaaccgaacggtaaccccttagttaacccgtttaacggtaaccttaacccgaagtacgttaacgttacggtaacggtcgaccgtaacgtaccggaaacggttaagggaccggttaattaggtttaccggtaacttttagaacgtttaccggtaccggttaaccggggaccggtaacggtactaacgggttccggg

SEQ ID NO: 114909 - DNA, 708 bp, Homo sapiens
  misc_feature: GYAE6OF02HKEW2.15.86.H09.1.454.CMB.1.raw
  modified_base (334)..(334): a, c, t, g, unknown or other
  misc_feature (334)..(334): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagcttgggttttccttgctgctatacttaaaagtgtccagtgtgaagtgcaggtggtggagtcgtgggggagccgttagggtaaagccggtggggggtcccttaggacgtctcctgtgtcggcctctgacttcactttcagtaatggctggatgagttgggtccgccaggctccgagggaggggcgtggnggtgggtggtacgtttacgaaaagtaaaagtgagtaggtagaataaaagtacgacgtacggtgacctacccggtaaggaaaacggaagactttaccaacctacttaccgtaacgaaaggtaacgtacgtttaaaacttaacccgaaaaaacggtccgggtttaagtttaagtttacgaaactaaagtacggaaacctacgaacctaaacgggaaaaccggagaaaccctaacgccgaacgttcttaactacgttaacgtaacccagacgttacgttaccggaagtcgactaggtacggaacggtaagggtcgtattacgtcgtttactttagagtttctcgggtaccgggacccgtagggtacctaaggttcgg

SEQ ID NO: 114910 - DNA, 850 bp, Homo sapiens
  misc_feature: GYAE6OF02HYGLI.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagcgttgggttttcttgctgctatacttaaaaggtgtccagtgtgaagtgcgaggtggtggagtcgtgggggacgtccgttagggtaaaacggtccggttcggggggttcccttaggtacgtccttccgttggtcggtcggtcccttcgtggtatttcctactttactaagttaagtggtcgtggagtggtacggttcgggcccgaccgaggccgtaccggaaggggaacgggtcgtagggtagggttggggttacggtaccgtttaaagaaaaaacgtaaaagtggtagtaggtaagaaagtaaaagtagaacgtacggtacgacctaaccggtaaggaaaggaagtacttacgaacctattacgacgaaagtaagtaacttaaacgttaaaccgaaaaacggtggttaagtttaacgttacgaaactaaaacgtaacgtaacgtaccgtaaaccgtaaaacggtaaaaccccggtaggaaaccgtaaccgaacggttacccgttaacttaacgttaaccgtaaccgttaacccaaggtaacggttaacgtttacgggtaaagtcggtaactaaacgggttaaccggttaaacgggtaagggtaacggtacgtttacgtacgtttcggtttaaacgttacggttaaccggttcggggtaacccgggtaaaccccggtaagggaaccccgtttagggttccccgg

SEQ ID NO: 114911 - DNA, 800 bp, Homo sapiens
  misc_feature: GYAE6OF02HKECC.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtcccttagagtctcctgtgtggcctcgtggattctactttcagttaacgtggactggatgtaggttcgggtccgccgaggcctccgaagggggaacggggcgtggggaggttggggttacggtacgtttaacgaaaaaaggttaaaatgagtagggtagaaagtaaaataggactacggtcaccgaaccggtaaggaaaaggtaacgacttaccgaactacgtctaacgaaaggtaactaagttaaacttaaaccgaaaaacggtcgggttaagtttaacttaggaactaaagttaagaaacctacggtacccgtaaaggtaaaaacccggaggaaaccgaaccgacgttaacccggttactttaacgttaccgtacgtaaaccgacgtaacggtacggtttaacggaaacgtcgtaacgtaaggttaacggggaaaccggttaaaagggacgggttaacttacggtttacgggttaactttttaacgggtaacgttacggtttacccggggtaaccggggtaccccggtaaacgggggttaccgtaaggttttcccggggg

SEQ ID NO: 114912 - DNA, 610 bp, Homo sapiens
  misc_feature: GYAE6OF02IQ1AJ.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttcggtccgccgaggctccgaggggagggcgtgggaggtgggttggacgtttacgaaaagtaaaatgagtggtagaagaaatagacgtacggtgcaccgtagaaaggaagatacaccatctacagagataatacaaaacggagtagttattgataaagtgaacacgacctaaggaaaaccgaggaaccaacgagtccgtatattaactcgtaaccagacgtagttacggaagtcgacaagtaccggacgtaaaggacgtactagttgtctttttagattagtaccggtcggggaccccgaagggacctaggtccggg

SEQ ID NO: 114913 - DNA, 778 bp, Homo sapiens
  misc_feature: GYAE6OF02F9NME.15.86.H09.1.454.CMB.1.raw
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggttttccttgctgctatacttaaaaggtgtccagtgtgaagtgcaggtggtggaggtcgtgggggagccgttagggtaaaacggccgttcggggggttcccctttaaggacgttccgtcccgttggttcggttcgggtcccttcgtgggtactttacctacctttcaagtaagtgggactgggaagtggtaggttcgggtcccgccgaggtccgtaccggaggggaacgggggcgtagggtagggttggggttcggtaacggtttaacgaaaaaaggtaaaaagtggtaagttagggtagtaaagaaaagtacgtaacgtaacggtacgaccgtaaccggtaaggaaaaggaagtaactaccgaaccgtactaccgtagaaagtagaaagttaaacttaaaccgaaaaaacggtacggttaagtaacgtttagaactaaaagtagaaacaaccgtaccgtaaacggaaaaccgaggaaccaacgtaccggtaccgttactaactttaccgacgttaacccaagtacgtagttacgggaagtgaccgtaagaccggtaaggaagggtacgtactagttcgtattttagacttacggtacggtccgggacctacgggacgtagtcggg

SEQ ID NO: 114914 - DNA, 733 bp, Homo sapiens
  misc_feature: GYAE6OF02GJEZN.15.86.H09.1.454.CMB.1.raw
  modified_base (347)..(347): a, c, t, g, unknown or other
  misc_feature (347)..(347): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtgggggagtccgttggtaaagccgtgggggtcccttaggagtctccgtggtgtcggcctcgtggtattctactttcagttaatggcgtggatggtaggttcgggtccgcaggccgtccgaggggaaggggcgtagggnggtgggttggtacgtttacgaaaagtaaagtgagtggtagaagtaaagtagtacgtacggtgaccgaccgtaaggaaaggagtacttacaacctatctacgaagagtaattaacgtaacgaaaaacggtcggttagttactttagacaaagtacgaaacgaacgtacccgtaaacggaaaacccggtaggaaccaacgaacggtacccgtttaacttaaacgtttaccgaacgttaacccgaagtaaccgtaacgttacgggaaagtccgaagtaaccggttacggtaacgggtaaagggtacgtacgttaagttacggttacctttaaggaccttaggttacccgggtacccggggtacccgtaaggggtaccctaggttccggg

SEQ ID NO: 114915 - DNA, 724 bp, Homo sapiens
  misc_feature: GYAE6OF02JF0G6.15.86.H09.1.454.CMB.1.raw
  modified_base (335)..(335): a, c, t, g, unknown or other
  misc_feature (335)..(335): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (433)..(433): a, c, t, g, unknown or other
  misc_feature (433)..(433): n is a, c, g, or t
tcagtctacgtagccacgaccggtgctcgatttagtgctatagacttggtttggggggagaggagccccagccttgggatcccaagtgttttcattcagtgatcaggactgaacacagaggactcaccatggagttcgggctgagctgggttttccttgctgctatcttaaaaggtgtccagtgtgaagtgcgaggtggtggagtcgtggggagtccgttggtaaaagccgttgggggtcccttagagtcctcctgtgtggtcctcgtggacttctacttcagtaatcggctggatgtagttgggtccgccgaggctcgagggaagggtcgtggngtggttggtacgtttacaaaagttaaangagtggtagaanaaagtagatacggtgaccgaaccggtagaaaaggaagtaacttcgaacctatcctaanaaagtagtaagttaacttaacgaaaaaacgtcggttagttaagtttacgaactaaagtacgtaaacgaacgtacccgttaaacgaaaaccggaacgtaaccgaaccgaacggtacccgttaccttaacgttacgttacgttaacccaagtaacggtaacgttaccggtaaaggtcctacgaaccgtaccgggtaacggtaaaggtaccggtacgttaactttcggtaaccgttttgaacgttacgttcccggtaccggggtaaccccggtagggtaccgtagtttccgggg

SEQ ID NO: 114916 - DNA, 840 bp, Homo sapiens
  misc_feature: GYAE6OF02HZ6OW.15.86.H09.1.454.CMB.1.raw
  modified_base (275)..(275): a, c, t, g, unknown or other
  misc_feature (275)..(275): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttttccttgctgctatcttaaaggtgtccagtgtgaagtgcaggtggtggagtcgtggggggagtccgttggtaaacgccgtggggggttcccttagacgtctcctgtgtcggcctctggtnttcactttcagttaagtggactggagttggagttcgggtcccgtccgacggtccgtacccggaagggggaacggggtcgtaggggtacggggttgggggttagggtaaccggttttaaccgtaaaaaaggttaaaaaacgtggttaaaggttagggtaggtaaaacggtaaaaagttacggtaacgtacggtacgacccgtaaccggtaaggaaaacggaagtaacgttaccaacctatccgtaacgaagtactaattaaacgttaaacaaaacgggtacggttagttaagtttagtaacaaagttacgaacgtacgaaccgtaacggaaaaccgacggaaaccaccgtaacgtacccgtacgtttaattaccggttaacgtacccgtaaacgtaacgttaacggttacgggaacgtacgtacggtaaccgttaacgggtaacgggttaaaccggggtcgtaaacggttttacgtttagggttaaccgtttttagaaccgttttacggtccgggttaacccgggggaccccggttaaagggtacccgggtaacggttttccgggg

SEQ ID NO: 114917 - DNA, 779 bp, Homo sapiens
  misc_feature: GYAE6OF02IQSD1.15.86.H09.1.454.CMB.1.raw
  modified_base (735)..(735): a, c, t, g, unknown or other
  misc_feature (735)..(735): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggctgagctgggttttccttgctgctatacgttaaaaggtgtccagtgtgaagtgcgaggtggtggagtcgtggggagtccgttaggtaaagtccggtgggggttcccttaggacgttcctccgtgtggtcggcctcgtggattctactttcgagttaagtggcgtaggatggtacggttgggtcccgccgaaggcctacccggaagggggacggggtacgtggggtacgggtttggggttacgggttacgttttaaacgaaaaaaggttaaaacgttaggtacgttaggtaggtaaaagtaaaagtaacggtacgtaacggtagacccgtaacccggtaaggaaaaggtaacgtaacgttacaacgtactctaacgaagaacgttaacgttaaagttaaccgaaaaacgggttaccgggttaagtttaaacgttttacgaaaaccgttaaaagtaacgtaaacgaaccggtaacccgttaaacggaaaacccggtagaaccctacgaacggtaccccgtattaaacgtccgttaactaaccgacctaggttaacgtacggaagtcgaacgtacgtaaccgaggtaacggagtntaacgtgttatttcgaatcgtacgccggaacgtgagtacgtcgg

SEQ ID NO: 114918 - DNA, 686 bp, Homo sapiens
  misc_feature: GYAE6OF02I67YQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaaacggccgtggggggtcccttagacgttcctcctgtgtggcctctggattctacttcagtaatggtcgtggatggaggttcggtcccgcgagccgtaccgaggggaacggggcgtggtaggtgggttacggtacgtttaacgaaaaagtaaaactgtaagtaggtagaaagaaaagtagaactacggtagaccgaaccgtagaaaaggaagtataacacaatcaacgaagaagtaataactaacgaaaaacggtacgtagtaagttgaataaagtagaaactacgaacgtaacgaaacgacggaacacgaacgtaccctattaacgtacacgtaccagtagtacgtacgaagtacgacgaagtacgacgtaaaggacgtaacttaacgtagttaccgtttagaagtttacggtaccggttacccggggaccggtaaacgggtacgtaacggttacggg

SEQ ID NO: 114919 - DNA, 659 bp, Homo sapiens
  misc_feature: GYAE6OF02INRVV.15.86.H09.1.454.CMB.1.raw
  modified_base (361)..(361): a, c, t, g, unknown or other
  misc_feature (361)..(361): n is a, c, g, or t
tcagtctacgtagccacgaccggtgctcgatttagtgctatagacttgggtttggggggggaggaggagccccagccttgggatccccaagtgttttcattcagtgatcaggactgaacacagaggactcaccatggagttcgggctgagctgggtttccttgctgctatctaaaaggtgtccagtgtgaagtgcaggtggtggagtcgtgggggagtccgttggtaaagccgtgggggtcccttagagtcctccgtgtgtggcctcgtggattcgtactttcgagtaatggctggatgagttggtccgcaggctcgagggagggcgtggtagtgggtgtacgtttacgaaaagtaaaagngtagtggtagaagaaaatagaacgtacggtgacgtaccggtaggaaacggaagtagtacgaactaatactacaagaagtaataacttaacgaaaacggtacggttagtacgtttagagtaaatagaaacagtaccgaacgaaaaccggagaaccacgacgccgtacttaataccgtagtaccaacgagtacgtacgaagtcgacaagttaccgaacggtaaaggtacggattagtacggttacttagtaacgttcgttacgggtaccggtaacccggaaggtaccgtaagttcccggg

SEQ ID NO: 114920 - DNA, 755 bp, Homo sapiens
  misc_feature: GYAE6OF02I88JD.15.86.H09.1.454.CMB.1.raw
tcagtctacgtagccacgaccggtgctcgatttagtgctatagacttgggtttgggggggagaggagccccagccttggatccccaagtgttttcattcagtgatcaggactgaacacagaggactcaccatggagttcgggctgagctgggttttccttgctgtctatacttaaaaggtgtccagtgtgaagtgcaggtggtggagtcgtggggacgtccgttgggtaaacgtccgtcgggggtcccttagagtctccgtgtgtggtccttctgggtacttctactttcgagtaagtggctggatggtaggttcgggtcccgccgtacggtccgtaccgaagggggagggggtctggggtacgggttggggttacggtaacggttttaaacgaaaaaggttaaaacgtaggtagttagggtagaaagtaaaagtaggaacgtacggtcgaccgaaccggtaaggaaacggtaagtacgttaccaaccgtataccgtaaccgtaaaggacgtaaattaacgttaacgtaaaaacggtacggtttaagtaacgtttagaacgttaaaagtacgaaccgtacgtacgtaaacgtaaaacgacggtaacgaaccgcgtacccgtacttaagttaacctacgtaccgaactggtaacgttacgaacgtcgtactaccgtagacgggttaaacggcgtacgttaacgttgttagtttacgagttacgtcggtaccggacgaacggtaccgtaggtaccgg

SEQ ID NO: 114921 - DNA, 651 bp, Homo sapiens
  misc_feature: GYAE6OF02FG487.15.86.H09.1.454.CMB.1.raw
  modified_base (500)..(500): a, c, t, g, unknown or other
  misc_feature (500)..(500): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagagtctcctgtgtggcctctggacttcactttcagtaatggctggatgagttgggtccgccaggcctccaggggaaggggctgggagtggggttgacgtttagaaaagtaaaatgatgggtgaagaaaatagactacggtgcacccgtggaaaacggaagtattaccaccattactacgaagagaataaatttaccgaaaaacgacggtagttaacgtttgacaaaataggaaaccagacccgttaaggaaaacccgnggaaccacgacgtcccgttactaactttacgtagtacccaagtacgtagtttaccggaatcggactactacggaccgtaaaggcggtactagtagttccttttagaagttacgttcggtaccggggtcccaaggggacctaaggttccggg

SEQ ID NO: 114922 - DNA, 904 bp, Homo sapiens
  misc_feature: GYAE6OF02FTTRY.15.86.H09.1.454.CMB.1.raw
  modified_base (270)..(270): a, c, t, g, unknown or other
  misc_feature (270)..(270): n is a, c, g, or t
tcagtctacgtagccacgaccggtgctcgatttagtgctatagacttgggtttgggggggaggaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccttaggtaaagccgtgggggtcccttagagtctcctgtgtggcctgtggnttctactttacagtaagtggctggtatgtaggttcggtcccgccgaggcctaccgaaggggtaacggggcgtgggtacggttggggttaggtaaccggtttaacgtaaaaagttaaaagtggtaagtgggtacggaaagtaaaactaggtaacgtaaccggtcgtaccgaacccggttaaggaaaagggtaaacgtaacgttacctaacccgtaacgtacctaacgaaagtaacgtaaagtttaaacgttaaaccgaaaaaaccgggtcgggttagtttaaacgttttacggaaaccgttaaaacgttcggaaaaaccgtaccggtaacccgttaaacgggaaaaaaccccgggtaggaaaccccgtaaacgtacccggttaaccccggttttaagtaaaccgttttaaccctaccgggtttaaacccgaaaccgtttaaagggtacggttttaaacccggggtaaagtcggtaccgtaaacggttaaccgggtaaaaccgggttaaaggggtaccgggttaacttaagggtttacccggttaacttttttaacgggaacgttttaaccgggttacccggggtaccggggggtacccccttaaaagggggtaccctttaaagggtttcccgggg

SEQ ID NO: 114923 - DNA, 634 bp, Homo sapiens
  misc_feature: GYAE6OF02I6H3D.15.86.H09.1.454.CMB.1.raw
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
  modified_base (382)..(382): a, c, t, g, unknown or other
  misc_feature (382)..(382): n is a, c, g, or t
  modified_base (411)..(411): a, c, t, g, unknown or other
  misc_feature (411)..(411): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctctgtgtcggcctctggnttcactttcagtaatggctggatgaggttggtccgccgaggctccgagggaaggggctggnggtgggtggacgtttacgaaaagtaaaatgatggtagaagaaatagactacggngacaccgtagaaaggagatcaccatctanaagagtaataattacgaaaaacgtaggtagttagtttagactaaagcgaacactaccgtaagaaaaccggagtaaccaaccgacgtacccgtattaacgttactacgtaaccacagtaacgttaggtaacgtgactaacgtacgaacgggtaacggaggtaccttagttcgttattttagattacgtcggttaccgggaccgtaaggtaccgtagttaccggg

SEQ ID NO: 114924 - DNA, 604 bp, Homo sapiens
  misc_feature: GYAE6OF02FVIAQ.15.86.H09.1.454.CMB.1.raw
  modified_base (421)..(421): a, c, t, g, unknown or other
  misc_feature (421)..(421): n is a, c, g, or t
  modified_base (485)..(485): a, c, t, g, unknown or other
  misc_feature (485)..(485): n is a, c, g, or t
  modified_base (535)..(535): a, c, t, g, unknown or other
  misc_feature (535)..(535): n is a, c, g, or t
  modified_base (571)..(571): a, c, t, g, unknown or other
  misc_feature (571)..(571): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttggtaaagccgtgggggtcccttagacgtctcctgtgtcggtcctctggacttcactttcagtatggctggatgagttggccgcgagcgtcgagggaagggcgtggtaggtcgggtggtacgttacgaaaagtaaaatgagtggtagaagaaaagtagactaggtagcgaaccgtagaaagagattacactatactanaagagataactaagaaaacgtggtattaagtagtataaagtagaactacgacgtaagaaaacgngtaacacgtagtccgtatacgtacgtactacctagtagtacgtaggaagnacgaagtcgaagtaaggcgaactagtcgtagtttanaagttacgtcggtacggactagggatagtacgg

SEQ ID NO: 114925 - DNA, 942 bp, Homo sapiens
  misc_feature: GYAE6OF02HT2WF.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatacgttaaaggtgtccagtgtggagtgcgaggtggtggtagtcgtgggggacgtccgttaggtaacgtccggttcgggggtacccttaggacgttccttccgttggtggtcggtcctcgttagggtatttacctacgtttttacctaaggttaacgttcgggtcgtagggtaggttaggtagggtttccgggggtcccggtacccggtacgggcccgttaccgggaacgggggggtaacgggggtccggttagggggtacggggtttacgggggttttacgggttaaaccggtttttaaacggtaaaaaacggtttaaaaaggtacgggtaaggtttaagggtaaggtaaaaggttaaacggtaaacggttaacggttaaccgggtacgaccggttaacccgggtaaaggtaaacggggtaagtaacgttaccctaaccgtactaacgttacgaaacggtaagtaaacttaacgtaaaccgtaaaaaccgggtggtttaagtttaacgtttacggaaacttaaaggtaaccgtacgaccgtaacccgtaaacgggaaaaacccggtacggaaacctaccggaacgttaccccgggtaactttaacgtttaacccgtaagtaaccccgtaaggttaacgtacgggtttaaccggaaggttccacgtaacggttacccggtaaggtaaccggtctaacggttacgttaggttactttaaggtacgttccggttacccggaccggttacccgggtaagggacgtttaccggttacggg

SEQ ID NO: 114926 - DNA, 703 bp, Homo sapiens
  misc_feature: GYAE6OF02F7T0L.15.86.H09.1.454.CMB.1.raw
  modified_base (377)..(377): a, c, t, g, unknown or other
  misc_feature (377)..(377): n is a, c, g, or t
  modified_base (442)..(442): a, c, t, g, unknown or other
  misc_feature (442)..(442): n is a, c, g, or t
  modified_base (478)..(478): a, c, t, g, unknown or other
  misc_feature (478)..(478): n is a, c, g, or t
  modified_base (617)..(617): a, c, t, g, unknown or other
  misc_feature (617)..(617): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgttgctattttagaaggtgtccagtgtgaggtgcaactggtggagtcgtgggggagcctcgtccgacgggtccggggggtcccttaggacgtctccgtgtgtggcctcgtggtactcctactttcagtatggctggatggtagttcgggtccgacgaggcgtccgaggggaagggtcgtggaggttggggttcggtacgtttacgaaaaagttaaangtaagtggtaagaagaaatagacctacggtcacgtaccgtaggaaacggatactacgacagtcanaagatataataacgaaagtcggtagttacttacganaaactgaacgcaaccgtaagaaaccggtgtaaccacgtaccggtacgttacctaagttaccgtacggaaacctacgtaaccgggttaattaaccgggtaaggttcgacgttaacggtaaccggtaaggttaaacggggnggttaccgttaaggttacgtttcggtttataagttacccgttcgggtaacgggaccggaaaggtacccgttaggtggttaacccgg

SEQ ID NO: 114927 - DNA, 649 bp, Homo sapiens
  misc_feature: GYAE6OF02IUAZ8.15.86.H09.1.454.CMB.1.raw
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
tcagtctacgtagccacgaccggtgctcgatttagtgctatagacttgggtttgggggggagaggagacccagccttgggatccccaagtgttttcattcagtgatcaggactgaacacagaggactcaccatggagttcgggctgagcgttgggttttcctgctgctatacttaaaaggtgtccagtgtgaagtgctaggtggtggagtcgtgggggagtccgttaggtaaacgccgtgggggtcccttagagtctcctggtgtcggcctcgtgacttcactttcagtaatggctggatgagtggccgcngcncgagggaggctggnggtggtggacgttacgaaaagtaangatgtagaanaaatgactaggcacgaccgtagaaagagtactacgactagtcaacgaacgagtaactaacgtaacaaaacggtggtagtagttagactaaatagaacacgtaccgtaacgaaaaccgagaaccgaagacgtaccgtactaagtaccgttacgacctaagacgttaacgtacgtaacgtcgacgtacgtacggaacggtaacggtacggacgttacgtaggtttacctttaggtaaccttacggtaccggtaacggggtacccgaaacgggtacgtaacgttacggg

SEQ ID NO: 114928 - DNA, 607 bp, Homo sapiens
  misc_feature: GYAE6OF02IQS3Y.15.86.H09.1.454.CMB.1.raw
  modified_base (146)..(146): a, c, t, g, unknown or other
  misc_feature (146)..(146): n is a, c, g, or t
  modified_base (222)..(222): a, c, t, g, unknown or other
  misc_feature (222)..(222): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (362)..(362): a, c, t, g, unknown or other
  misc_feature (362)..(362): n is a, c, g, or t
  modified_base (471)..(471): a, c, t, g, unknown or other
  misc_feature (471)..(471): n is a, c, g, or t
  modified_base (543)..(543): a, c, t, g, unknown or other
  misc_feature (543)..(543): n is a, c, g, or t
tcagtctacgtagccacgaccggtgctcgattttagtgctatagacttgggtttggggggagaggagccccagccttgggatccccaagtgtttttcattcagtgattcaggactgaacacagaggactcaccatggagttcgggntggagcttgggttttccttgctgactatacttaaaaggtgtaacagtgtagaagtgcaggtgtggagtgtgggganccgttaggtaagcgtggggtccttgagtctcgtgtcgtgcctcncgtattcctnttcgtatatcggctggctgcggtttgccgcagcctacggagggtagggccgtaggtgtcgggttggagtttacgaaaagtacgtancgttaggagagtaactgaaccgtgttacacgacgtacgaagagttcgctaatccgagttcaacgactacttaatacccggaaatttgtagtacgttccggaatacctanagacacgacgagacgactacgacgtcgtacgtactacacgtacgtacgtaacgtagtacgtacgtagacganacgtacgtagtacgtacgtatacgacgttacgtagtacgtacgtgtacgtacgtacgtacgtcg

SEQ ID NO: 114929 - DNA, 715 bp, Homo sapiens
  misc_feature: GYAE6OF02I8V7K.15.86.H09.1.454.CMB.1.raw
  modified_base (394)..(394): a, c, t, g, unknown or other
  misc_feature (394)..(394): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaagccgtggggggtcccttagagtcgtcctgtgtggcctcgtgattctacgtttcagtaatggctggatgaggttgggtcccgccaggcgtccgaggggtaacggggcgtgggtaggtgggttcgggtagtttaacgaaaaagttaaaagtgtaagtaggtaggaanaaaagtacgaacgtacggtagcaacccggtagaaaaggaagataccacgtactctacaacgtagtaaataagttaccaaaaacggtacgttaggtaattttacggaactaaaacgtacgaaacgtacgaccgtaagaaaacccgaggaaccacgtacgaccttactaacttacgtaccgtacaaccgagtaacgttcgggtaaacgtcgacgtaacgtacggtaacggtaaacgggtagaccgttagttacggttctttttaaggaagtttaccggttaccgggttacggggcccgtaaacggggactaacgggttccggg

SEQ ID NO: 114930 - DNA, 871 bp, Homo sapiens
  misc_feature: GYAE6OF02I51Y3.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaaggccgtggggggtcccttaggacgtccttccgtggtggtcggcctcgtggtattcgtactttcagttaagtggctggatggtaggtttcgggtccgtccgaggcctaccggaggggaaggggcgtgggaggttggggttaggtaccggtttaacgaaaaagttaaaagtgaagtggtaagaagaaaataggaacgtacggtagaccgacccggtaggaaaacggaacgtacttaccgaacctagtacctaacgaaaggtaacgtaaacgtttaaacgttaaaccgtaaaaaaaccgggttacgggtttaacgttttaacgtttaacggaaacgttaaaaaagtaccgggtaaaacctaaccggtaacccgtttaaacgggaaaaaacccggaaggtaaaaccccgaacgtaaccggtaacccgttttaaccgttaaacgtttaaccggttacccgttaaacccgaaacgttaacggttaacgggtttaaccgggaacgttacggaacccgtacggttaaccggaaaccgggttaaagggacggttaaccgttaggtttaacggttacgtttttaacggagtttacggtttaccgggtaccggggttaaccccggaggggttaaccgtaggtttacccgggg

SEQ ID NO: 114931 - DNA, 658 bp, Homo sapiens
  misc_feature: GYAE6OF02F31IG.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatggagttgggtccaccgaggctccgagggaaggggcgtggaggtgggttggacgtttacgaaaagtaaatggataggtagtagaaatagactacggtacgacgaccgtagaaaggagacttacacatctacgaagacgtaataactacgaaaaacgtcggtagttacgtttgactaaatcgaacacggacctaagaaaccgagaaccacacgtccgtataattactacgtacccagtagtaacgttacggaagttcgactaacgtaccggtaacgggtaaagggcggtacttaaggtcggttaccttttaggaacttacggttccggttaaccgggggacccccgtaagggtaacctaaggttccggg

SEQ ID NO: 114932 - DNA, 786 bp, Homo sapiens
  misc_feature: GYAE6OF02IVF6Q.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttaggtaaagccgtgggggttccctagagtcctcctgtgtcggcctcgtggatctactttcagtaatggctggattggagttcgggtcccgaccacggcctaccggaaggggtaagggggccgtaggggagggttgggggttggtaacgtttaacgaaaaaggtaaaagtggtaagtgggtagaaagtaaaagtagacgttacggtacgaccgaacccggtaggaaaacggtaacgtacgttaaccaaccgtactacgtacaaaggagtaacttaaagttaaaccgaaaaacggttacgggtagtttaatttacgaacgtaaacttaggaaacctaacggtaccgtaaaacggaaaacccggtacggaaacctaacgaacgtacccgttaacttacgttaaccttacgtaaacccctacggaacgttaacggttaacggtaagtagtaaccaacggttaccggtaaccggttaaaggggacggttaaccgtaattcgttaacgtttttaggaactttacggttcgggtaccggggtaacccggtagggtacccgtaaggttccggg

SEQ ID NO: 114933 - DNA, 747 bp, Homo sapiens
  misc_feature: GYAE6OF02FYIOE.15.86.H09.1.454.CMB.1.raw
  modified_base (204)..(204): a, c, t, g, unknown or other
  misc_feature (204)..(204): n is a, c, g, or t
  modified_base (598)..(598): a, c, t, g, unknown or other
  misc_feature (598)..(598): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaggtgtccagtgtgagtgcaggtggtggngtcgtggggagtccgttaggtaagccgtcgggggtcccgttagacgtcgttcctgtgtcggcctcgtggtattcctactttctaggtaatggtctggatggtaggttcgggtcccgccgtacggccgtacccggaaggggaaggggccgtggggtaggtggggttaggtacgtttaacgtaaaaagttaaatgagttaggtaagaaagtaaaagtagacgttacggtacgaccgtaaccgtagaaaggtaacgtacttaccaacctactactaagtaacggagtaaacttaacgttaaaccgaaaaacggttcgggttaagtttaacgtttgaaacgtaaatacgaaaccgtcgtaaccgtaaccggaaaacgacggacctaacgcgtaccctnttaacttacgtaccgtaccgtacgtaagtacgttaacgggaattaccggtataacggtaaccgtaaggtaacggtacggtcttaagtttcgtacgttttaagacgttaccgttccggtaccgggacggtaacggtacgttacggtcggg

SEQ ID NO: 114934 - DNA, 865 bp, Homo sapiens
  misc_feature: GYAE6OF02GB017.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatactaaaggtgtccagtgtagaagtgcgaggtggtggtagtcggtggggagtccgttaggtaaacggtccgggttcgggggttacccttaggtacgtttccgttggtggtcggtccttcgtggtacttacctacgtttacaagttaagtcggtcgtggagttggtacggtttcgggtccccgaccggtaggtacccgtaccgggaaggggggtaacgggtcggttaggggtagggtttcggggtttaacggttaaaccggttttaaacggaaaaaagttaaaaacgtcggtagtaagggtaagtaaaacgtaaaagtagtaaccggttacggtaccggtaacccggtaaccggtaaggaaaaggtaacgtacttaaccgaacctaacgtacctaaacgtaaagtaaagtaaacttaaacgttaaaccggaaaaacggttccgggttaaattaagtttaacggaaacttaaaacggtaacgaaacgtaaccggtaacccggtaaaacggaaaaccgggtaacaacccgaacgacgtacccgttacttaacgtttaactacgaacctaacgtaagttcgtaacggtatacgaacgttacgaaccggttaaaggtaagacgtacgttaagtacggttttcttaaggtacgttaaccggtcgggaccgggtacccggtaaggaacgttaggttaccggtc

SEQ ID NO: 114935 - DNA, 1026 bp, Homo sapiens
  misc_feature: GYAE6OF02I7ETA.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtggggagccgttggtaaagccgtgggggtcccttagacgtctccgtggtgtcggcctcgtggtattcgtacttacagtaagtcggtctggtataggtacggtttcggggtccccgccggaacgggtcccgtacccggaaggggggtaacgggggtaccggttagggggtaacgggtttgggggttttacggggtaaacccggtttttaaacgtaaaaaaaaacggtttaaaaaaaggtttagggtaaaggtttaagggggttaagggtaaaaaaggtaaaaaacgttaaacgggtaaaccggtttaaacccgggttacggaaccccggttaaaacccccggggttaaagggtaaaaacggggtaaaacggttaaactttaacccccgaaacctaaacgtttaacccgttaaaccgtaaaaacggtaggtttaaaacgtttaaaaaccgttttaaaaccccggaaaaaaacggggtttccgtttaaagggtttaaacgtttaacgtaaacgtaaaaacgtttaacggaaaacgtacccggtaaaccccggttaaacgggtaaaaaacccggggtagaaaccccgtaaacggaccgtttaaccccggtaacttttaaaccggttaaccttaacccggttaaacccacgttaaacgggtttagtaaaccgttaaaggtccgaactaacggttaaccggaacgggtaaaaggttaccgggtaacttttaacgttcggtttaacgttttacgaaagtttttcgggaccgggtttacccgggggaacccgttaacgggggttaaccttagggtttacccggg

SEQ ID NO: 114936 - DNA, 707 bp, Homo sapiens
  misc_feature: GYAE6OF02FX515.15.86.H09.1.454.CMB.1.raw
  modified_base (359)..(359): a, c, t, g, unknown or other
  misc_feature (359)..(359): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctccgtgtgtggcctctggattcgactttcagtaatggctggatgagttcgggtccgccaggctccgagggaaggggctggaggtgggttgacgtttacaaaagtaaaangatggtagaagaaatagacgtacggtgacaaccggtagaaaaggatacttacaccgattctacaagagaataacgttaaccaaaaacggtcggttagttaagttttagaaactaaagttacgaaacgtacgaccgttaaacggaaaaacccggaggtaacccgaacgtaacggtccgttaacttaagtttaaccctacggttaacccgaactaggtaaaccgtttacgggtaaagtcgaacgtaacgtacggtaacgtaaaagggcggttaacgtaacgttcggtaccgtttttaagagttaacgttccggtaacgggggaccctaacggggtactaacggttccggg

SEQ ID NO: 114937 - DNA, 806 bp, Homo sapiens
  misc_feature: GYAE6OF02ICGAF.15.86.H09.1.454.CMB.1.raw
  modified_base (616)..(616): a, c, t, g, unknown or other
  misc_feature (616)..(616): n is a, c, g, or t
tcagtctacgtagccacgaccggtgctcgatttagtgctatagacttgggttggggggagagagccccagccttgggatccccaagtgttttcattcagtgatcaggactgaacacagagactcaccatggattcgggctgagctgggtttcccttgctgctatacgttaaaaggtgtccagtgtgaagtgcgaggtggtggaggtcgtagggggagtccgtttagggtaaacgccgttcggggggttacccttaggacggttccttcccgtggttcggtcggtccctcgtggtaacttccgtaacttttcaggttaaagttggtaccgttggagttggtacggttcgggtcccggacctagggtccttaccggaagggggaacggggtccgttagggagggttggggttacggtacgtttaagaaaaagttaaaaaggtgtaagtacgggtaagtaaacggtaaaaatagtaacggtaacggtcggtaaccgtacccggtaaaggaaagtaacggtacttaacgtaccctaagtaccttaacggaagtaacgtaattaaaacgtaaccggtaaaagaccggttagttaaccttaggaacttaaaagacgtaaacncgtaaccaacggtaaaaccgaggaacaccgaacgtacgtacgttaattaccgacttaacccagttaaacgacgttaaccggagtacgactaacgtacccggtaaagaacgggtacgtaatagttccgtacgttttaaggagtttacggccgttaacggggtcccaagggtaccaacggttttacccgggg

SEQ ID NO: 114938 - DNA, 789 bp, Homo sapiens
  misc_feature: GYAE6OF02JHS3D.15.86.H09.1.454.CMB.1.raw
  modified_base (599)..(599): a, c, t, g, unknown or other
  misc_feature (599)..(599): n is a, c, g, or t
  modified_base (608)..(608): a, c, t, g, unknown or other
  misc_feature (608)..(608): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcgaccatggagttcgggctgagctgggtttcctgctgctatacttaaaggtcgtccagtgtgaagtgcgaggtggtggagtcgtgggggacgccgttagggtaaacgccggttcggggggttaccccttaaggacgttccttccgtggttacggtcggacccttcgtagggactttccgtacgttttccgaaggttaagtcggtcgtagggtagtggtaggtttcggggtcccaccgacggtccgtaccggaagggggaagggtccgtagggtacgggttggggttacggtaaccgttttacgaaaaaaggttaaaacgttggtaacggttaggtaacggtaaaggtaaaagtacgtaaccgtacggtacgaccgtaacccggtaggaaaacggtagtacgttacaaccgtagtacctacgaagtacgtaataaactacgaaaacggtcggtgttaagttacaaacgttaanacggaaacnccgtacgtaaacggaaaaccggtgaaccctacgagtacccgtacttacgtacctacgtaccgtaagacgttagttacggaagtgccaagttaccggagtaaaggtcgtacgtactttaggtacccttaaggacttacggttccggtaaccgggacccggtaaggtaccgtaagttcccggg

SEQ ID NO: 114939 - DNA, 743 bp, Homo sapiens
  misc_feature: GYAE6OF02IZRZG.15.86.H09.1.454.CMB.1.raw
  modified_base (166)..(166): a, c, t, g, unknown or other
  misc_feature (166)..(166): n is a, c, g, or t
tcagtctacgtagccacgaccggtgctcgatttagtgctatagacttgggtttggggggagaggagccccagccttgggatccccaagtgtttttcattcagtgatcaggactgaacacagaggactcaccatggagttcgggctgagctgggttttccttgctgntatacttaaaaggtgtccagtgtgaagtgcaggtggtggaggtcgtgggggacgtccgttaggtaaacggccggtgggggttcccttaggacgttccttccgtggttggtcggcccttcgtggtacttcctactttcaagtaagtggcgtggagtaggtaggttgggtcccgacgaggccgtaccggaggggaagggtcggtgggtaggtgggttggtacgttaacgtaaaagtaaaagtgagtaggtagaaagtaaagtagaacgtacggtacgtaccgaaccggtaaggaaaacgggaagtactaccaactactactaacgaaagtaacgtaattaaacgtaaacgaaaaacggtacggttacgttaatttagaactaaaagacgtaaacgtaccgaaccggtaacgaaaaccgacgaacgaaccgacggtaccctacttaacgttaaccgtacgtaaacccaacgtaagtagttaccgggtaagtcacgtaacgtacgtaacggtaaaggacggtctaatggttaacttgaagttacgtaccgggtacggtaaccggaggtacgtacggttcgg

SEQ ID NO: 114940 - DNA, 607 bp, Homo sapiens
  misc_feature: GYAE6OF02JK5YP.15.86.H09.1.454.CMB.1.raw
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (461)..(461): a, c, t, g, unknown or other
  misc_feature (461)..(461): n is a, c, g, or t
  modified_base (491)..(491): a, c, t, g, unknown or other
  misc_feature (491)..(491): n is a, c, g, or t
  modified_base (524)..(524): a, c, t, g, unknown or other
  misc_feature (524)..(524): n is a, c, g, or t
  modified_base (535)..(535): a, c, t, g, unknown or other
  misc_feature (535)..(535): n is a, c, g, or t
  modified_base (553)..(553): a, c, t, g, unknown or other
  misc_feature (553)..(553): n is a, c, g, or t
tcagtctacgtagccacgaccggtgctcgatttagtgctatagacttgggtttggggggaggagggagccccagccttgggatccccaagtgtttttcattcagtgatcaggactgaacacagaggactcaccatggagttcgggctgagctgggttttccttgctgctatcttaaaggtgtccagtgtgaagtgcaggtggtggagtcgtgggggagccgttagggtaaagccgttggggggtacccttagacgtctctgtgtggcctctggattcgtactttcagtaagtggctggattgagtttcgggccgtccaggtctcccgaggggaacggggctgggaggtgggttggtacgtttacgaaaaagtaaaatgagtggtgaagaaaatgaacaggtgcaccgagaaggantcgacanctanaaganaataactanaaaacgnggtntatttacganaaagtgaaacacgtacgtaacgaaaaccgngaccaccgagccgtattaatccgtagacccaanagtctacggangacagtcgaacgtaaggngacttagttgactttagagttaactcgggtcggacctagggacgtaattccggg

SEQ ID NO: 114941 - DNA, 776 bp, Homo sapiens
  misc_feature: GYAE6OF02H8LXE.15.86.H09.1.454.CMB.1.raw
  modified_base (142)..(142): a, c, t, g, unknown or other
  misc_feature (142)..(142): n is a, c, g, or t
  modified_base (551)..(551): a, c, t, g, unknown or other
  misc_feature (551)..(551): n is a, c, g, or t
tcagtctacgtagccacgaccggtgctcgatttagtgctatagacttgggtttgggggagaggagccccagccttgggatccccaagtgttttcattcagtgaatcaggactgaacacagaggactcaccatggagttcggntgagctgggttttccttgctgctatacgttaaaaggtgtccagtgtgaagtgcgaggtggtggagtcgtgggggagtccgttaggtaaagccggttcgggggtcccttaggacgttcctccgtggttggtcggccttgttggtattctacttttcgagttaagtggtcgtggagtgtaggttcgggtccgcgacggccgttcccggaaggggacggggtcgtgggtaggttgggttaggtaaccgttttaacgaaaaagttaaaagtggtaagtggtaagaaagtaaagtacgacgtacggtcgacgaccggtagaaacggaagacttaccaccatacacgaagagtaattaacgttaacgaaaaacggtacggttagtttaagtttagaacgtaaaatcggaaaccgngtaaccgtaaacggaaaaacccggacgaaccgaaccgtacgtacccgttaacttaacgtttaaccgtacgttaacccaacgtaagttaacgttaacgggtaaacgtcgtactaacggttaccgaaacgggttaaacggacggtccttaagttggtttaaccgtttttagacgtttacgttccgggaccggggtaacccgtaagggtacccgtaaggtttcccggg

SEQ ID NO: 114942 - DNA, 578 bp, Homo sapiens
  misc_feature: GYAE6OF02GPJ87.15.86.H09.1.454.CMB.1.raw
  modified_base (495)..(495): a, c, t, g, unknown or other
  misc_feature (495)..(495): n is a, c, g, or t
  modified_base (518)..(518): a, c, t, g, unknown or other
  misc_feature (518)..(518): n is a, c, g, or t
tcagtctacgtagccacgaccggtgctcgatttagtgctatagacttgggtttgggggggagaggagccccagccttgggatccccaagtgtttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgagttgggtccgccaggctccgagggaggggctggagtgggttggacgtttcaaaagtaaaatgatggtagagaaatagactacggtgcacccgtgaaaggagactacacatctacaagagataaattacaaaaacgtacggttagtatttacggactaaatagaacagacctagaaaaccgagaacacagccgtatattaacngtaccacagattacgaagtcganatcgagtaaggacggctatgtgttttgattacgtcgtgggaccgtacggacgagttcggg

SEQ ID NO: 114943 - DNA, 719 bp, Homo sapiens
  misc_feature: GYAE6OF02FLCW0.15.86.H09.1.454.CMB.1.raw
  modified_base (671)..(671): a, c, t, g, unknown or other
  misc_feature (671)..(671): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttaggtaaagccgtgggggtcccttagacgtctcctgtgtggcctctggtacttctactttcagtaatggctggatgtaggttcgggtcccgccgacggccgtccggaaggggaacggggcgtgggaggttggggttacggtaacgtttaacgaaaaaggtaaaataggtaagtgggtaagaaagtaaaagtaggaacgtacggtcgaccgaccggtaaggaaaacggaagtacttaccgaacctaagtacctaacgaaagtaagtaattaaacgtaaacgaaaaaccggtggttaagttatttacgaaactaaagtacgaaacgacgtacccgtaaaggaaaaacccgtggaaccaacgacgtccgttaacttacttaccgtacgtaaccacgtagttacgtacggaagtcgactagtaccggtaacgtaagggcgtacgttagtcggttntttaggattcggtcggtaccgggacccgtagggtacctaggttcccgg

SEQ ID NO: 114944 - DNA, 595 bp, Homo sapiens
  misc_feature: GYAE6OF02I9WMJ.15.86.H09.1.454.CMB.1.raw
  modified_base (381)..(381): a, c, t, g, unknown or other
  misc_feature (381)..(381): n is a, c, g, or t
  modified_base (415)..(415): a, c, t, g, unknown or other
  misc_feature (415)..(415): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgaggttggtccgccaggctccgaggggagggctggaggtgggttggacgtttacgaaaagtaaaatgatggtagaagaaatagacgtaggngacaccgtagaaaggagtactcacatcacaaganatatacaaaacgcgtagtattaganaagtanaacagaccagaaaaccgagacacgcgacctactaataccgtagtaacccataagacgttacgggaagtgacagttacgacgttaaggaggtctagttgtaacttttgaatttacgtcggtaccgggtaccgacgggtactagttacggg

SEQ ID NO: 114945 - DNA, 767 bp, Homo sapiens
  misc_feature: GYAE6OF02IYKAJ.15.86.H09.1.454.CMB.1.raw
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgcccccgtntcgnatctgtccttgcgtgggancctcgatacaagctccactgaccacctaagtgtgtacgactacgtaccgaacctaccacctactacgtagtacggtatacaacgttttaacggaacgtaccgaacggtaaccgtaccccctagttaacgtattaaagtaacgtaaaacgttaagaacgtacgtagtacggtaccgtacgaccaacgtaaccggaacgggggaacggtaaccgtacccgtacggtaccgtaccgttaacgtacgttacggggtaccgttaccgtaacggttcggtacgggtacgtacgaacccgttaccgtaccctaaccgtacctacctaacccgtaaccctaaccgtccgtaacgtaccgtacggtaacgtaacgtacggtaacggccgttaggtaacggttaccgtacgtacggttacggtaggtaacggacgtaacgtaacgtaacctaaaccggttagtacggtaactaccggtacgtaacggttacgggttcggtaacggtttacgggaaccgggacggtacgtacggtacgtacggaaccgttacgtacggtacccgtacgg

SEQ ID NO: 114946 - DNA, 811 bp, Homo sapiens
  misc_feature: GYAE6OF02F71UO.15.86.H09.1.454.CMB.1.raw
tcagtctacgtagccacgaccggtgctcgatttagtgctatagacttgggtttggggggagaggagccccagcctttgggatccccaagtgttttcattcacgtgatcaggactgaacacagaggactcaccatggagttacgggctgagctgggttttccttgctgctatcttaaaaggtgtccagtgtgaagtgcacggtggtggagtcgtgggggagccttggtaaagccgtggggggtcccttagagtctcctgtgtggcctctggattcactttcagtaagtggctggatcgaggttcgggtccgtccaggtccgtacccgagggggtaacggggtcgtagggaggttcgggggttacggaacggttttaccgaaaaaacggttaaaaagtcgtaagttgggtaggaaaggtaaaagtacggtaaccgtacggtacgtaccgtaaccccggtaggaaaacgggtaacgtacgtttaccgaaccctaagtacctaacgaaacggtaaggtaacttaaagttaaacccgtaaaaaacggtaccggttagttaacgtttaggtaacaaaagttacggaaacgtacgacccgttaacggaaaacccggtaggaaaccacgaacggtacccgttacgttaacttaacctacggtaaccctaacgtaacggtaacgtttaccgggaaagttcgactaacgttaccgggaaccgttaaacgggacggtaacgttaacgtacggttaccgttttaacgaagtttacggttacggttaccgggggacccctaaggggtaacctaaggttcccggg

SEQ ID NO: 114947 - DNA, 778 bp, Homo sapiens
  misc_feature: GYAE6OF02GHPZH.15.86.H09.1.454.CMB.1.raw
  modified_base (241)..(241): a, c, t, g, unknown or other
  misc_feature (241)..(241): n is a, c, g, or t
  modified_base (691)..(691): a, c, t, g, unknown or other
  misc_feature (691)..(691): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggtttcctgctgctatcttaaaggtgtcagtgtgaagtgcaggtggtggagtcgtggggagccttaggtaagccgtgggggtcccttagngtctcctgtcgtggcctcgtggacttctacttcagttaatggcttggatggtagttgggtccgccgaaggtcctaccggaggggtaaaggggtccgtgggaacggttggggttacggtaacggttttaacgaaaaaaggttaaaagtggtagttagggttaggaacgtaaaaagtggtaaaccgttacgggtagacccgtaaccggttaagggaaaaggtaacgtaacgtttaccgaaccgtaacgttacccgtaacgaaggtaaccgtaagttaaaactttaaaccggaaaaaaaccggtcccgggtttaagttaacggttttacgaacgttaaaaacgtacggtaaacgaaacgtacccgttaaacggaaaaaccggagggtaaccctacgaaacggtaccgttactagttaacgtaccgtaacacgtagtacgtacgaagtccgtanacgttggaacgtaggtacgtcgtaagttcgttacgtttgaacgttcggtacggtaccgggaccgtaacggtacggttacgttacggg

SEQ ID NO: 114948 - DNA, 740 bp, Homo sapiens
  misc_feature: GYAE6OF02FYCY8.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaagcctgggggtcccttagagtctcctgtgtggcctctggattcacttttcagtaatggctggatgagttgggtccgccgaggcctccgaggggaaggggcgtgggtaggttggggttggtacgtttacaaaaaggttaaaatgaatggtagaagaaaatagaacgtacggtgacacccgtagaaaggaagtattaccaactatctacaagagtaataattacgaaaaacgtacggtagtaagtttagactaaaagtcgaaaactacgacccgtaaaggaaaaccccggaaggtaaccgaacaacggtacccgtacttaacgtttaaccgtacgtaaccctaacgaaggttaactttaccgggaaacgtttacggaccttaaacgttacccgggtaaacggttaaaacgggacgggtaaccttaaggttacggtttaaccgttttttaggaaacgttttacgtaccgggttaccgggggtaccccgtaacgggggtaacctaaggtttacccgggg

SEQ ID NO: 114949 - DNA, 836 bp, Homo sapiens
  misc_feature: GYAE6OF02I0EOX.15.86.H09.1.454.CMB.1.raw
  modified_base (166)..(166): a, c, t, g, unknown or other
  misc_feature (166)..(166): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttcctgctgntatacgttaaaggtcgtcctagtgtagtaagtgcgaggtggtggagtcggtggggacgtccgttagggtaaacggtccggttcgggggttacccttaggtacgttccttccgttggtcggtcggtccttcgtcggtactttccgtactttacgaaggtagtcggtcgtggtagttggtacggttcgggtccgaccgtacggcgtccgggaaggggtacggggtcgtaggggtacgggttgggttacggttaaccgtttaaacgtaaaaagttaaaagtggaaggttggtaacgaaaaggtaaagtaaggtaaccgtacggtacggaacccgtaaccgggtaagaaaaacggtaacgtaacgttaccgaacttaacgtactaacgaaagtacgtaaagttaaacgttaaacggtaaaaccgtagggtttattaacgtttaaacgaactaaacgttaacgaaacccgtaacgtaaccggtaaaacggaaaccggtaaacgaaccgaaccggtaccgttaccgtacggttaactaccggttaaccctaacaacgttagtaacgttggaaacctgaaccagttaacggaacggtaggtacctggttaacgtcgtttaagtccgttaaagccggttaccggtacgggtaacccggtaagtaccgtaggttcccgg

SEQ ID NO: 114950 - DNA, 738 bp, Homo sapiens
  misc_feature: GYAE6OF02I5SA3.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagagactcaccatggagttcgggctgagcttgggttttccttgctgctagtacttaaaaggtgttccagtgtgaagtgcgaggtggtggagtcgtgggggactccgttaggtaaacgccggtcgggggttcccttaggacgtcctccgtgtggtcggcctcgtggtacttctactttcagtaagtggctggatgaggttcggcccgcgaggtctaccggaggggaacggggtcgtgggtaggttggggttacggttaaccggtttaaactaaaaaggttaaaagtggtagttagggtagaaagtaaaagtagtaccgtaaggtcgaccgtaacccggtaggaaaacggaagtacttaccaaccgatacctacgaaagaacgtaattaaacgttaaccgaaaaacggtacggtagtttacttagaactaaagtacgaaacgtacaccgttaacggaaaacgacgacaactaccgccttattaacttaccgtactaccaagtacgtaacgtttacgaagtacgacgtacgttaaggaccgggaaaggtaccgtcttagttcgttacgtttagaagttaccggttcgggacccggggacctaagggtacccgtagttcggg

SEQ ID NO: 114951 - DNA, 776 bp, Homo sapiens
  misc_feature: GYAE6OF02H1YGP.15.86.H09.1.454.CMB.1.raw
  modified_base (596)..(596): a, c, t, g, unknown or other
  misc_feature (596)..(596): n is a, c, g, or t
  modified_base (698)..(698): a, c, t, g, unknown or other
  misc_feature (698)..(698): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttccttgctgctatacttaaaaggtgtccagtgtgaagtgcaggtggtggagtcgtgggggagccgttaggtaaaggccgtcggggggttcccttaggacgttcttccgtggtgtcggtcctgtggattctactttcgagttaagtggtctggattggtaggtttcgggtcccgaccgtacggccgttaccggaagggggaacggggtcgtaggggtacgggttaggggtttcggtaacgttttaacgaaaaaagttaaaaagtgtaagtagggtaagaagtaaaagtagaacgtacggtgaccgtaacgtaaggaaaggtaagtacttaccgacaattactaacgaaaggagtaagttaaactaaacggaaaaaccggtggttaagtttaagtttagaactaaaagtacgaaaccgtacgtaaccgaaacggaaaaaccggnggaaccaacggtacgtaccgttaacttagttaaccctacggtaacccaaacggtacggttacgtttacggaaagttacgctaagttacggtaacgtaagggngttacgttaacgtgtttaacgtttgaaacgtttcggtaaccggttccggggaacccgtacggtacgtaccggttcggg

SEQ ID NO: 114952 - DNA, 697 bp, Homo sapiens
  misc_feature: GYAE6OF02JLPPI.15.86.H09.1.454.CMB.1.raw
  modified_base (179)..(179): a, c, t, g, unknown or other
  misc_feature (179)..(179): n is a, c, g, or t
  modified_base (458)..(458): a, c, t, g, unknown or other
  misc_feature (458)..(458): n is a, c, g, or t
  modified_base (640)..(640): a, c, t, g, unknown or other
  misc_feature (640)..(640): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaggtntccagtgtgaagtgcgaggtggtggagtcgtggggagccgttggtaagccgtcgggggtccttagacgtctccgtgtgtggcctctggtattctactttcagtaagtggactggattgtaggttcggtccgccgacggaccgtccgaggggaagggtcgtaggtaggttgggttcggtacgttaacgaaaagtaaagtcgtagtaggtagaagtaaagtacgacgtacggtcgacgtaccggtagaaacggtatacgtacaccgtatcctacgaagtanaacgttaacttaaccgaaaacggttcgtagtttagtttacaacgttaaaacgtagtaaacccgtagaacccgtaaggttaaaaacccggcggaaacctaacgacgttaccgtacttaacgttacctacggtaccgaacgtaacgtaacgttcggaaagttcgagtacgtaccggagtaaggngtactagtgttactttacgattacggtcggtaggtccgtaagggtactacggtacgg

SEQ ID NO: 114953 - DNA, 909 bp, Homo sapiens
  misc_feature: GYAE6OF02JNAEG.15.86.H09.1.454.CMB.1.raw
tcagtctacgtagccacgaccggtgctcgatttagtgctatagacttgggtttggggggggaggagggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtccctagaggtcctctgtgtggcctcgtggattctactttcagttaatggcgtggagtgtaggttcgggtacccgtccgtagggccgtcccgtagggggaaggggtccgtgggtacgggttcggggttgggtaaccggttttacgaaaaaaggttaaaaaacgttgggtaacgttagggttaggtaaaagtaaaaacggttaacgacggttaaacgggtaccgggtaaccgtaaccccgggtaagggtaaaaaacggggtaaggtaacggtttaccgaaaccgtaacgttaccgtaaacggtaaaaggaacggtaaacgtttaaaacgttaaccggtaaaaaaaccgggtacggggttaacgggtttaattttaacgggtaaaccttaaaaagtacggttaaaaccgaacggttacccgtaaaacgggtaaaaaccggtaacgggtaaccgtaaccgaacgtaccggttccttaacgtttaacccgttacggtaaccctacgtaagttaaccgggttacgtaaacggttacgtaaccgtaacgttaccggtaaacgggttaaaaccgggcggttaaaccggttacgttaacgtttcggtttaacgttaaggttaccgttacgggggtacccggtaccgggtaacgggtaccggtaaggtttcccgggg

SEQ ID NO: 114954 - DNA, 767 bp, Homo sapiens
  misc_feature: GYAE6OF02IQM10.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatacttaaagtgtccagtgtgagtgcgagggtggtggtagtcgtaggggacgtccgttaggtaaacgccggttgggggtcccttagtacgttctccgtgtgtcggccgttcgtggtacttctacgttttacgagttaagtggcgtcggtattggaaggttccgggacccgtccggtcggcgttacccgggtagggaacgggggtacgtaggggtagggttacggggttggttaaccgtttaacgaaaaaaggttaaaagtaggtacgttaggtaacgtaagtaaaagtacgtaacgtacggtccgaaccgtacccgtaaggaaacgtaagtaccttaacgacctaatcccgtagtaagaagtaagtaacgttaaaccgtaaaacggtaccgtttagttacttacgaactaagtaagaaccgtaacgaccggtaacgtaaacggagaaccgacggtacgtaccgtagttaaccttacgtacgttaccgacgtagtacgtaacggttagactacgtaccgaacggtacgaaggtacgtcgttacttagttcgtttagaagttcggttaccgtacgggaccgtagggttaacgaggttccgg

SEQ ID NO: 114955 - DNA, 656 bp, Homo sapiens
  misc_feature: GYAE6OF02GWKVZ.15.86.H09.1.454.CMB.1.raw
  modified_base (267)..(267): a, c, t, g, unknown or other
  misc_feature (267)..(267): n is a, c, g, or t
  modified_base (418)..(418): a, c, t, g, unknown or other
  misc_feature (418)..(418): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtgcctcgtgnttctacttcagttaatggctggatgaggttgggtccgcgaggctcgaggggaggggcgtggagtgggtggtacgttagaaaagtaaaatgagtgtagaagtaaatagacgtacggtgacaaccgtagaaaggagatacacatacacaaganataatacgaaaacggtgtagttattacgaactaaatagaactacggacctaaaggaaaccgagaaccacgacgtccctaatacttacgtacggtaaccaacgagtacgttacggaaagttcgaactacgtacggtaacggtaaacgggagtaacgttaatcggttaacttttaggtaacgtttaccggttaacgggtccgggggtaaccccgtaaggggtacccgtaagggttccggg

SEQ ID NO: 114956 - DNA, 688 bp, Homo sapiens
  misc_feature: GYAE6OF02I5STT.15.86.H09.1.454.CMB.1.raw
  modified_base (219)..(219): a, c, t, g, unknown or other
  misc_feature (219)..(219): n is a, c, g, or t
  modified_base (349)..(349): a, c, t, g, unknown or other
  misc_feature (349)..(349): n is a, c, g, or t
  modified_base (421)..(421): a, c, t, g, unknown or other
  misc_feature (421)..(421): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggganccgttggtaaagccgtgggggtcccttagagtctcctgtgtggcctcgtggattcactttcagtaatggctggatggagttcgggccgcgaggctacgaggggaagggctggaggtggtggacgtttaanaaaaagtaaaatgatggtagaagaaaatgactacggtgacaccgtagaaagatactacaacatacacaaagngtaataattaacaaaaaacggtcggtagttaatttacgaactaaagtacgaaacacgaccttaacggaaaaaccggtacggaaacaaccgaacggtacccttacgttaacgttaaccgttacgtaaccctaaacgagtaacgttacggaaagttcgactaaccgtaacggaaccggtaaacgggtaggtaaccgttaagtcggttaacgttttaggaatttacgtaccggttacggggaccccgtaagggtaccgtaacggttcggg

SEQ ID NO: 114957 - DNA, 863 bp, Homo sapiens
  misc_feature: GYAE6OF02HMX0E.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtcagtgtgagtgcgaggtggtggagtcgtgggggagccgttagggtaaacgccggttcgggggttacccttaaggtagttccgttccgttggtggttcgggtcccttcgttggtacttccgtaccttttacgaaggttaagtcggtaccgtgggtagttaggtaggtttcgggtccccggccgacgggccgtacccggaaagggggaacggggcgtgggtaacgggttcggggttacggtaacgttttaaacgaaaaaaggttaaaaagtgaagttggtaagaaacgtaaaagtacgtaacgttacggtacgacctaaccggtagaaaacgggtaacgtacgttaccaacccgtaagtacctaacgaaacgtaacgtaaacgttaaaacttaaaccggaaaaaaccggttcggttaatttaaacggtttacgaaacgtaaaacgtacgtaaaccgaacgtaacccgaaacggtaaaaaccgacggaacccaacgtaccggttacccgtaaccttaacgttaccgtaaccgtaaccctaagaggttaacgttacggaacgtgtaaccagttaacccggaacgggttaaagggtacggtacttaacgttcggttaattttacggaaacgtttccggttaacggggcccgggttaacccggaaagggttaacgtacggttaccgg

SEQ ID NO: 114958 - DNA, 592 bp, Homo sapiens
  misc_feature: GYAE6OF02IPXAX.15.86.H09.1.454.CMB.1.raw
  modified_base (416)..(416): a, c, t, g, unknown or other
  misc_feature (416)..(416): n is a, c, g, or t
  modified_base (444)..(444): a, c, t, g, unknown or other
  misc_feature (444)..(444): n is a, c, g, or t
  modified_base (471)..(471): a, c, t, g, unknown or other
  misc_feature (471)..(471): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtgggtggagtcgtgggggagccgttggtaaagccgtgggggtcccttagagtctcctgtgtggcctctggattcactttcagtaatggctggatggagttggtccgcaggctcgagggaaggggcgtgggaggtggggttggtacgtttacgaaaagtaaaatagatggtagaagaaaagtagatacggtgcaccgtagaaggaagatcacatcanagagataatacaaaacgagtgtattganaaatgaacagcctaagaaacgagacanacgcctatatactagaccanagtatcggaagtgnacgtacgacgttaagggacggtacttagtcggtacttttagaacgttacgtcggttaccggggccctaagggtaactagttacgggg

SEQ ID NO: 114959 - DNA, 694 bp, Homo sapiens
  misc_feature: GYAE6OF02GKHHF.15.86.H09.1.454.CMB.1.raw
  modified_base (592)..(592): a, c, t, g, unknown or other
  misc_feature (592)..(592): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
tcagtctacgtagccacgaccggtgctcgatttagtgctatagacttgggtttgggggggggagaggagcccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttaggtaaagccgttcggggggttcccctttaggtacggttcccttcccttggttcggtcggtccgttcgtggtacttctacttttcagttaagtggtcgtggatggttaggttcgggtcccgccgtaggccgtacccggaagggggaacgggggtcggtaggggtaggttggggttgggtaacggtttaacgaaaaaggttaaaatagaagttgggtagaagtaaaagtaggtaacgtacggtcgaccgtaaccggtaaggaaaaggtaacgtactaccaactactactacgaagtagtaataactaacgaaaacggtagttagttaacttagaacaaagtacgaacaacgtacgaagaaaccganacgacacgtcctatactacacgtacagtagtacgtacgagtgactcgtacgagaagngtntatgttgttagtatacgtcggtacggactaggtacgtagtcg

SEQ ID NO: 114960 - DNA, 784 bp, Homo sapiens
  misc_feature: GYAE6OF02JR3DG.15.86.H09.1.454.CMB.1.raw
  modified_base (436)..(436): a, c, t, g, unknown or other
  misc_feature (436)..(436): n is a, c, g, or t
  modified_base (578)..(578): a, c, t, g, unknown or other
  misc_feature (578)..(578): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcgaggtggtggagtcgtagggggacgtccgttaggtaaaggccggtcgggggttcccttaaggacgttcctccgtgtggtcgtccgtcgtggtacttcgtactttcgacgtaagtcggcgttaggactggtacggttcgggtcccgccgtaggtccgtacccgaggggtacgggtcggtggtaggttgggttcggtaacgttaactaaaaaggtaaaagttggaagttgggaagaacgtaaaanacggtaacgtacggacgtccgtaaccggtaggaaagtaacgtacgttaacaaccgtcgtaaccgtacgaagtaacgtacgttaaacgtaaacccgtaaaaggcggtttaagttaactttacggaaacctaaagtcgaaaacncggttaaccaaacggtaaaaccgagacccgaataccggtaccgttaactacgtttaacgacgttaaccccgaattaacgggtacttacgggaaagtcgaaacggctttaaaccggagggttaaacggcgttaagtacgtttagtaccggtttaagactacgggttccgacccgggggtactaaacgggtaccttagggttacccgg

SEQ ID NO: 114961 - DNA, 1198 bp, Homo sapiens
  misc_feature: GYAE6OF02FRQSC.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggagccgtttagggtaaaacgtccggttacgggggggttcccctttaaggacggttccgttccccgttggttcggttcgggtccccgttcgttacggggtaactttccgttaaccgtttttccgaaaggtttaaaagttggggtccgttaggggtaagtttacgggttaacgggttttcggggggtacccccggttacccggaaacgggggtcccgttaccccgggtaaaggggggggtaaacgggggggtccggtttaggggggttaaacgggggttttgggggggttttaaacgggggttaaaccggggttttttaaacccgtaaaaaaaaaaaagggttttaaaaaaacgtacgggttaaaacgggtttaggggttaaagggtaaaaaggggttaaaaaaaaaccgttaaaggggttaaaacccggtttaacggggttacggtaaaccccggttaaaccccccggggttaaaggggtaaaaaaagggggttaaaaaccggtaaaccggttttttaacccgaaaacccggttaaactttaacccgtttaaaaccggaaaacgggttaaacgttaaaaacgtttaaaacccggttttaaaaccctaaaaaaaaaccggggtttaaccgggtttaaacggtttaaagttttttaacggaaaaccgttaaaaaataccgggtaaaaacccgtaaggtaaccccgttaaaagggaaaaaaccccggtaacggtaaacccaaaccggaacggtttaccccgtaacgttaaactttaccggtacccggttaaacccgtaaccggaaggttaaccggttttaacgggaaaaccgggttctaaccggttaaccgggtaacccggtaaaagggttaaaaccggggagtttaaccggtaaggtttaccgttaccggtttttaagaaacgtttccggtttaacccggggtcggggggtaacccctaagggggtaacccgttaaacgggtttccc

SEQ ID NO: 114962 - DNA, 812 bp, Homo sapiens
  misc_feature: GYAE6OF02H3YMO.15.86.H09.1.454.CMB.1.raw
  modified_base (183)..(183): a, c, t, g, unknown or other
  misc_feature (183)..(183): n is a, c, g, or t
  modified_base (638)..(638): a, c, t, g, unknown or other
  misc_feature (638)..(638): n is a, c, g, or t
  modified_base (757)..(757): a, c, t, g, unknown or other
  misc_feature (757)..(757): n is a, c, g, or t
tcagtctacgtagccacgaccggtgctcgatttagtgctatagacttgggttggggggagaggagccccagccttgggatccccaagtgtttcattcagtgatcaggactgaacacgagaggtactcaccagtggagttcgggctgagcgttgggttttcctgctgctatacgttaaaaggtntacctagtgtgaagtgacgtaggtggtggagtcgtggggacgtccgttagggtaaacggtccggtagggggttaccccttagtacggtccgttccgtggtaggtccggtccgttagtcgggtaacttccgtaaccgttttcgaaggttaacgtcggtaccgtggagttaggaccggttcgggcccaccggagggtccctaccggtaggggaaccgggtctaggggtacgggttggtaccggtaaccgttttaaacgaaaaaacggttttaaagcggttaagtagggttaagaaaaggtaaaacgtcgtaaaccgttggacccgtaaccgtaccgggttaaagaacggtaacgacttaccgaaccgtactagaacgaaacgtagtaacttaaacgtaaaccgaaaacgggttgttaagtttaaacgttcggaaaacgttaaataccgggtaaaccnccgttaaacccggtaagaaacccggacggtaccaaggtaccgtaccctaagtttaccgtaacgtaccgtaccaacgtagttacgtaaccgtgatacccgagtaccgtagtaagcgttanacttcggtaattccggattacggaccgggtgaacccggttagccgttaagttcgg

SEQ ID NO: 114963 - DNA, 769 bp, Homo sapiens
  misc_feature: GYAE6OF02H2WVM.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggagtcgtggggagccgttggtaaagccgtcgggggtcccttagagttctcctggtgtcggcctcgtggattctactttcagttaaagtgctggagtgaggttgggtccgccaggctaccgaggggaacggggctgggaggttgggttcggtacgttttaacgaaaagttaaaaactagtaagtggtagaagaaaagtaacgaacgtacggtagaccgtaacccggtaagaaaacggtaaacgtaagttaccaacctaacgttacgtaacgtaaaggtaaacgtaaacgtttaaaaccgtttaaacgaaaaaaaaccggttacgggtttaaacgtttaacggttttaaggaaaccgttaaaaagttacggaaaacgtaacgtaacccgtaaacgaaaaacccggaaggtaaaccgaaccgtaacgtaacccgttaccgtaactttaaccgtacgtaacccacgtaagtacgttacgaacgtagacaagtacgaacgtaaaggacgtaagtagtcgtagtttacgattacgttacggaccgggacccgtaagggtacctaggttacgg

SEQ ID NO: 114964 - DNA, 980 bp, Homo sapiens
  misc_feature: GYAE6OF02HOE9Q.15.86.H09.1.454.CMB.1.raw
  modified_base (176)..(176): a, c, t, g, unknown or other
  misc_feature (176)..(176): n is a, c, g, or t
  modified_base (745)..(745): a, c, t, g, unknown or other
  misc_feature (745)..(745): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcggctgagctggttttcctgctgctatacttaaaggtntccagtgtgaagtgcgaggtggtaggtagtcggtgggggacgtccgttaggtaaacggtccgggttcgggggttaccccttaggtacgtccgttccgtggttcggtcggtcccttacgtacgggtactttccgtaccgttttaccgaaaggttaacgttcgggaccgttaggggtaattagggtacgggtttaccgggtcccggacccgtacgggtcccgtaccgggaaggggggtaacgggggtccgttagggggtacggggtttacgggggtttacgggttaaaccggttttaaaaccgaaaaaaaaggttaaaaacggttggaagttagggtaaggtaaaaccgtaaaagttaaacggtaacgttaaaccgggtcggtaaccgtaacccgggtaaaagggtaaaagtaaacggtaactttaaccgaacctaagttaccctaaaggtaaacgtaagtaaactttaaaacgtaaccggtaaaaaaccgggtcggtttaagtttaacgttaacgaaactaaacgtaaacggtaacgtaacccgtaaaccgtaaacggaaaaacccgggngaaacccgtaaacgaccgttaccggttaactttaaacgttactaaacccgggttaccaaaggtacgttaacggttacgggtaacgtactaaccgtaaacggttaacggaaacggttacggggtaaacgttcctttaacgggttaactttgttttaaccggaagttttaaccggtaccgggggtaacccccgggtaacccgggttaaaacgggttaacgtccgttttacccggggg

SEQ ID NO: 114965 - DNA, 812 bp, Homo sapiens
  misc_feature: GYAE6OF02IQEB8.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttcctgctgctatcttaaaaggtgtccagtgtgaagtgcaggtggtggagtcgtggggagccgttggtaaagccgtgggggtcctaggagtctcgtgtgtggcctcgtggtatctacgtttcagttaatggctgggtatggaggttagggccccgcggtaggtcgtcccggaaggggtaacggggcgtgggtacggttgggttacggtaacggttttaacgaaaaaaggttaaaaagttggaaagttagggaaggtaaacggtaaaaaagtaaggtaaccgtaagggtcggacccgtaaaccggttacggaaaaaggggtaaagaacgtttaccgaaaccgtaattaaccgttacgaaaggtaacgtaagttaaactaccgtaaaaacggtacggtaagttaatttaggactaaagtaggtaacgaacgtaccgtaaggaaaaacccggtaggtaaacgaacctaacggacccgttaaccgtaagtttaacgtaccggttaaacccacgtaaacgtaccgtttaacgggaaacgtaggtacctaaagggtaccccgaaagggttaaaccggacgggtaaccgttaagttacgttaacgttttagtaacgttaacggttacgttccgggggaccgtaacggtaaccgttaacgttcgggg

SEQ ID NO: 114966 - DNA, 722 bp, Homo sapiens
  misc_feature: GYAE6OF02I045S.15.86.H09.1.454.CMB.1.raw
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggagtcgtggggagccgttggtaaagcgtgggggtcccttagagtctctgtgtcggcctntggtattctactttcagtaatggctggatgtagttgggtacccgccgaggctccgaggggaaggggctagggnggttagggttgggtacgtttaacgaaaaggttaaaatagagtggtagaagaaaagtagaacgtacggtgaccgtacccggtaaggaaaggaagtattccgaacctatacgacaagaagtaattaaactaacgtaaaaacggacggttagtttaagtttacgtagtaaataacggtaaacgtaacggtaccgtaacggtaaaaacccggaacggaaccaacgaccggtaccgttacgttaaacttacgttaacgtaacccgtaacgaacggtagttaacggtaacggttacgagtacgtacggtaacgggtaacggaggtacttagttacgtcgttttacgtagttacgtacggtaccggggacccggtaagggttaccgaggttcgggg

SEQ ID NO: 114967 - DNA, 831 bp, Homo sapiens
  misc_feature: GYAE6OF02F14EN.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttcctgctgctatacttaaaagtgtccagtgtgaagtgcaggtggtggagtcgtggggagccgttaggtaaaagccgttgggggtaccctttaggacgtccgtcctggtgtggtccctcgtaggtacttctaccttttacaaggttaagtcggctgggtactggtacggtttcgggtcccgccgtaggtccgtaccggaaggggtaacggggcgtaggggtagggttacggggtttcggtaaccggtttaacgtaaaaaaaggtaaaaagtggtaaacgttagggtaaggaaaaggtaaaaacgtacggtaaacgttaaccggtaacgtacccgtaaacccgggtaaaggaaaacggtaagtaacttaaccaaccgtaataccgtaacgaaaagtagtaaacgttaacgttaaaaccgaaaaaacggttccggtaagttaaacgtttacgaaacgttaaaagtactaaacgaaccggtaaacccgtaaggaaaaaccggtacgaaccggtaactaacgtacccgttacttaaacgttacgtaaccgggtaacaaacgtacgttaaacgtcgtaaagtcgactaacggaccggtaacgggtaagggagtactaacgttcggttaactttagtaaccttaggtcgggacccggttaacggaacggtaccgtaaggttccg

SEQ ID NO: 114968 - DNA, 850 bp, Homo sapiens
  misc_feature: GYAE6OF02HEALY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttcctgctgctatacttaaaaggtgtccagtgtgaagtgcgaggtggtggagtcgtggggagtccgttaggtaaacgccggtcggggggttacccttaaggtacgttccgttccgtggtgtcggtcccttcgtggtacttccgtacttttacgaagttaacgtggtccgttaggtagttggtacgggtttcgggtacccggaccgtacgggtccgttaccgggaagggggtaacggggtccgttaggggtacggggttcgggggtttacggtaaccggtttttaaaaccggaaaaaagtttaaaaacggtgggtaacggtttaggggtaaacggtaaaaggtaaaaagttacgggtaaacggttaccgggtacgtacccggtaacccgggtaaaggaaaccgggtaagtaacttaccgtaacctaactaaccgttaacgaaaggtaacgtaacttaaacgttaaaccggaaaaggtccggtttaagttaagtttaccgaaagtaaacgttacgaaacgttaacgaaccgtaaacggaaaacggaccgtaacaacgtaccgtaccgtacttaacgttaacgtaccgtaacctagaactacggttaacgagtacacgtaacgtacgaaggtaggtaccgtaactgttactgtttaagacgttcgtccgggtaaccggaccggtaggtacgtgtcgg

SEQ ID NO: 114969 - DNA, 759 bp, Homo sapiens
  misc_feature: GYAE6OF02IVUJA.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttagggtaaacggccgtggggggtcccttaggacgttctccgttggtggtcgggcctcgtgggtattctaacttttcgaagttaagtggcttgggattaggaggttcgggtccgaccgtagggcctaccggagggggaaggggtcgtgggtaaggtggggttggtaaccggtttagaaaaacggttaaaaagtggtaaagttgggtaaggaagtaaaaagtaggaacgtaacggtcgacgtaacccggtaggaaaaggtaagattacactaatctaacgaagtagaataactaacgaaaaacgtcggtattagtagactaaagtagaacaggacctaaggaaaacgacggaacaacgtacgtacgtacttaacgttaacgtcgtaacccgaaagtacggtacgtttaacgggaagtcgtaacgaagtacccggtaaaggtaaacgggtacggtaacgttaacgttcggttaacgttttacggtaagttaccgtacgggttccggggaacccggtaagggtaacgtaccggtttacgggg

SEQ ID NO: 114970 - DNA, 685 bp, Homo sapiens
  misc_feature: GYAE6OF02J2LJ6.15.86.H09.1.454.CMB.1.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (642)..(642): a, c, t, g, unknown or other
  misc_feature (642)..(642): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatctaaaggtgtccagtgtgaagtgcgaggtggtggagttctggggganccgttggtaaacgccgtagggggtcccttagngtctccgtgtgngctctgntcattcagtanggcngatgtacggtggtcgccagctcgagggtaggctgggacgtggttggtaacgtttacaaaagtaaaagtcgagtggtagtaagtaaaagtggaacgtacggttgaccgtaccggtagaaacggagtacgttaccgacctaagttccaacgaagtagaacttaacgttaaacgaaaaccggtcggttagtttaagttacgataaaacggtccgaaacacggtaccctaacgaaaaccggtacggaacaccaaggtcccgtacttaagtacctacgggttaacccactaacggttacgttacggaaacgtggacctacggtacgaaccggtaaggtccgaacttgttacgttacccggtttanacgtttagtcccgggtacggtacccgaaggtactacgttcggg

SEQ ID NO: 114971 - DNA, 608 bp, Homo sapiens
  misc_feature: GYAE6OF02IIL1X.15.86.H09.1.454.CMB.1.raw
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
  modified_base (370)..(370): a, c, t, g, unknown or other
  misc_feature (370)..(370): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
tcagtctacgtagccacgaccggtgctcgatttagtgctatagacttgggtttgggggggggagaggagcccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccgttaggtaaagccgtgggggtcctagagtctctgtgtgcctntgatcacttcagtatgctggatgagtggtcncgagcncgagggagggcgtggnggtgggtgtacgttanaaagtaaatgagtggtagaagaaatagaactacggtancgaccgtagaaagagatacacatcacaagagtataacttaacgaaagtacggttattattagaactaaanacgaaacncgaaccgtaaggaaaaccgngaacctaacgacaccgtacttaagtaccttgaacccacgtagtagttacggaagtcgactaagtcggaacgtaaggtacgacttagtcggttctttagagttacgtcgggtaccgggacccgtaggaccgtagttccggg

SEQ ID NO: 114972 - DNA, 875 bp, Homo sapiens
  misc_feature: GYAE6OF02H18X7.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacgccgtcggggggtcccttaggacgttcctccgtggttgtcggtccctcgtggtattctactttcaagttaatggctggatgagttcgggtccgccgtaggccgtccgaagggaacggggtcgtgggtaggttggggttggtaacggttttaacgaaaaaggtaaaaacgtggtaaggtaggtagtaaagtaaaaagtaggtaaccgtacggtacgaccgtaacccggtaaggaaaacggtaacgtacgttaacccaaccgttaactaccgttaaccgaaaagtaacgtaaacgttaaaacgtttaaacccggaaaaaaacccggtacgggttttaagttaaacgttttaacggaaaaccgttaaaaacgtaaccgggtaaaccaacccgggttaacccgtaaaacgggtaaaaaacccgggtaacgggaaccccgtaaaaccgtccggttaaccccggtttaactttaaaccgttaaccgttaaccgtaaccccgtaagtaaagggttacggtttaaccgggtaaacgtggtaacccaagttaccggaacgggttaaaacggcggtaaccttagtaccggtttagtttacgtaagttcggttaccgggccgggtaacccggtaaacgggtactaaggttcggg

SEQ ID NO: 114973 - DNA, 712 bp, Homo sapiens
  misc_feature: GYAE6OF02GCVEO.15.86.H09.1.454.CMB.1.raw
  modified_base (577)..(577): a, c, t, g, unknown or other
  misc_feature (577)..(577): n is a, c, g, or t
  modified_base (610)..(610): a, c, t, g, unknown or other
  misc_feature (610)..(610): n is a, c, g, or t
  modified_base (674)..(674): a, c, t, g, unknown or other
  misc_feature (674)..(674): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaaggtgtccagtgtgaagtgctaggtggtggagtcgtggggagtccgttaggtaaagccgtgggggtacccttaggagtctcctggtgtcggtcctcgtggtacttctactttcagtaatggctggatggtaggttcgggtccgtccgaggcctccggaaggggaaggggtcgtagggtaggttggggttacggtaacggttttaacgaaaaaagttaaaagtggtaagtaggtagaaagtaaaagtagaacgtacggtacgaaccgtacccggtaagtaaaaggtaacgaactttacgaacctacttactacgaaagaagtaataaacgtaaccgaaaaacggtacggttaagttattaagaactaaaagtacgaaaccgagtaaccctaacggaaaaccgnggaacacgactaccgtactattacgacgtacanaagtacgttacggaactgaacgtagtacggaacgttaaggcggttatacgttagttacgtttanaattcgtacgggtcggaaccggtaggacgttagtacgg

SEQ ID NO: 114974 - DNA, 712 bp, Homo sapiens
  misc_feature: GYAE6OF02GVL8O.15.86.H09.1.454.CMB.1.raw
  modified_base (216)..(216): a, c, t, g, unknown or other
  misc_feature (216)..(216): n is a, c, g, or t
  modified_base (362)..(362): a, c, t, g, unknown or other
  misc_feature (362)..(362): n is a, c, g, or t
  modified_base (449)..(449): a, c, t, g, unknown or other
  misc_feature (449)..(449): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggganccgttggtaaagccgtgggggtccttagacgtctcctgtgtggcctcgtggattcgactttcagttaatggctggatgtaggttcggtcccgcgaggcctaccgaaggggagggcgtggtgtgggttgacgttacaaaagtaaaangtagtggtagaagaaagtagacgtacggtagaccgtaaccggtagaaaaggtaagtacgttacaaccgtattacctacgaaaggtanaaattaacgtaacgaaaaaacggtcgggttaagttaatttacggaaactaaaagttgaaaacctacggtacctaaacgggaaaaacgtacgaacctaccgaacgtacccgtaattaactttaaccgtacgtaaacccgacgttaaggtaccgttacgggaaagttcgaactaacgttacggaacgttaaagggacgtacttaagtggttactttaaggacgttattcccgggaggggtacccaaggggtacctaaggttccgg

SEQ ID NO: 114975 - DNA, 703 bp, Homo sapiens
  misc_feature: GYAE6OF02FRGBP.15.86.H09.1.454.CMB.1.raw
  modified_base (623)..(623): a, c, t, g, unknown or other
  misc_feature (623)..(623): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtcccttagagtctcctgtgtggcctcgtggattcactttcagtaatggctggatggagttgggtccgcgaggcctccgaggggaaggggcgtggagtgggttggacgttttacaaaaagtaaaatgtagtggtagaagaaaatagaactacggtgacacccggtagaaaaggaagtacttaccgaaccaagtcacgtaagaagtacttaaattaaccgaaaaacgtcgggttagttaagttttagactaaaagttaggaaacgacgtacccgtaaggaaaacccggaggaactaacaagtcccgtacttaacgttaccgtacgtaacccaacgaaggtaacgtttaccgggaaagtcgacgaagttaccgggtaacgtaaaacggngggtaacttaggttacgttcgttttaagacgtttaacgtccggttaccggggaccctaaggggacctaaggtttcccggg

SEQ ID NO: 114976 - DNA, 684 bp, Homo sapiens
  misc_feature: GYAE6OF02G2XLU.15.86.H09.1.454.CMB.1.raw
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
  modified_base (635)..(635): a, c, t, g, unknown or other
  misc_feature (635)..(635): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttaggtaagccgtgggggtcccttagagtctctgtgtgcctntggattcnctttcagtatggctggatgaggttcgggccgcgnggcctcgaggggagggtcgtggtaggttggggttggtaacgtttaacgtaaaaaaggtaaaaatgtaagttacgggtaaggaaagtaaaagtgtaacgtaacggcgaccaccggtaaggaaaagtagacttacactatacgtacaaagtactaataaacgtaaccgaaaaacggtacggttaagttatttacggacgtaaaataggaaactaacgacccgtaaaggaaacccggtaagaaccgaacacgtccttacttaacttaccgacttaccgaactagtacgttagaagacgactaggtacgaacggtaagcggtgttaacgtggttnttaagtacgtcgtacggggtacggtacccggaaggtaccgaggtttcgg

SEQ ID NO: 114977 - DNA, 692 bp, Homo sapiens
  misc_feature: GYAE6OF02GFF7K.15.86.H09.1.454.CMB.1.raw
tcagtctacgtagccacgaccggtgctcgatttagtgctatagacttgggtttggggggagaggagccccagccttgggatcccccaagtgttttcattcagtgatcaggactgaacacagaggactcaccatggagttcgggctgagctgggttttcctgctgctatcttaaaaggtgtccagtgtgaagtgcaggtggtggagtcgtgggggagtccgttaggtaaagccgtgggggtcccttagagtctcctgtgtggcctcgtggacttctactttcagtaatggctggtatgtaggttgggtccgccgaggcctccggagggaaggggcgtgggaggtgggtggtacgtttacgaaaagtaaaatgaagtggtagaagaaagtagacgtacggtgacgacgtacggtagaaaggaagtattacaccgtactactacaagaagtaataaacgttaaaccgaaaaacggtacggtaggtttaacttagtaactaaagtaacgaaccgtacgaaccgttaaacggaaaccggaagaaccgaaccacggtacccgttaagttacttaaccgtacgtaaccgaacgtacgtacgttaacggtaagtacgacgtaacgtacggtaacggtaaacgggtggtaacgtagttagtcgttttaggagttcgtacggtccgggacggtacgagtacg

SEQ ID NO: 114978 - DNA, 864 bp, Homo sapiens
  misc_feature: GYAE6OF02IC7D1.15.86.H09.1.454.CMB.1.raw
tcagtctacgtagccacgaccggtgctcgatttagtgctatagacttagggtttggggggggagaggagccccagccttgggatccccaagtgttttcattcagtgatcaggactgaacacagaggactcaccatggattcgggctgagctgggttttcctgctgctatacttaaaggtgtccagtgtgaagtgcgaggtggtggagtcgtggggcgtccgttaggtaaagccgtcgggggtccttagacgtcttcctgtagtggacctcgtggacttcacttttacgagttaagtggacgtgggtaatggtaggttcgggtacccgacgacggccgttacggaggggaacgggtccgtgggtaggtttggggttacggtaacggtttaacgaaaaagttaaaacgtgaggttaggtaagaacgtaaaagtagtaacgtaccggtgaccctaacgggaaggtaaaacggaagttacgtaccgtaacctaacgtacctacgtaaaggtaagtaaacttaaacgtttaaacgaaaaaccgggtttcggggtattttaacgttacgtaaacgaaagtacgaaacgtaacgttcccggaaaacggttaaaacccgaggaacctaacgccggtacctttacgttaacttacccgtaacgtaacccctaagtaacgtaaccggtttaacgggtagtacgggtaaccctaacgtaaccgggttaaaaagggtaaccggggtagttaaacccgtttaagggtttccccggtttaaacgggtttttaaacccgtagttacccggggttaaccccgggggtacgggttaccccccgggtaaaagggtaccccggtttaaggtttacccgggggg

SEQ ID NO: 114979 - DNA, 590 bp, Homo sapiens
  misc_feature: GYAE6OF02IJR51.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaggcctgggggtcccttagagtctcctgtgtggcctctggattcactttcagtaatggctggatgagttgggtccgccaggctccagggaagggggctggagtggggttggacgtttcaaaagtaaaatgatggtgagaaaatagactacggtgcacccgtgaaaggaagattcaccatctcaagagataattacaaaaacgacggtagtaatttagacaaaatgaaacagcctagaaaaccgaggaacaacagccgtactacttaacgtacgtaccaacagtacttacggaagtgacatacgacgtaaaggaggacttatgtcttttgattagtcgtgggggaccccaggggaccaagtcggg

SEQ ID NO: 114980 - DNA, 696 bp, Homo sapiens
  misc_feature: GYAE6OF02IWUR8.15.86.H09.1.454.CMB.1.raw
tcagtctacgtagccacgaccggtgctcgatttagtgctatagacttgggtttgggggggagaggagccccagcctttgggatccccaagtgtttttcattcagtgatcaggactgaacacagaggactcaccatggagttcgggctgagctgggttttccttgctgctatacttaaaaggtcgtccagtgtgaagtgcgaggtggtggagtcgtgggggagccgttggtaaagccgtgggggtccttagagtctctgtgtggctctggattcactttcagtaatggctggattgaggttcgggtccgccgaggctccgaggggaaggggcgtggaggtgggttggtacgtttacaaaagtaaaagtgagtaggtagaagaaaatagaacgttaacggtcgacgacccggtaagaaaaggaagagtttacaaccaataccgtacgaaagagtaattaattaacgaaaaggtaaccccccggtagttagtttagactaaatagaacacgacgtaaggtaaacgaacgaacgaacaacgtaccgtacgttaacttaacgttacgtaacctaacgtaagtacgttacggtaaggtacgtacgtacgacggtaacgtaaacggtaaggtaacgttaagttacgtcgtttacgttaagtacgttaccggtcgggtacccggaacgggacgtaagttacggg

SEQ ID NO: 114981 - DNA, 693 bp, Homo sapiens
  misc_feature: GYAE6OF02HOVA2.15.86.H09.1.454.CMB.1.raw
  modified_base (269)..(269): a, c, t, g, unknown or other
  misc_feature (269)..(269): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (652)..(652): a, c, t, g, unknown or other
  misc_feature (652)..(652): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttccttgctgctatacttaaaaggtgtccagtgtgaagtgcaggtggtggagtcgtgggggagccttggtaaagcgtgggggtcctagagtctcctgtagtgctctggatcacttnagtaagtggtcgtaggatgtaggttcggtccgacgnggtactccggagggaacgggngtggaggtgggttaggtacgtttaacgaaaaggtaaaacgtgacgtaggtagaacgaaaatagtaacgtacggtcgaccgaaccggtagaaacggaacgtactaccacgtaactactaacgaagaagtaactaaactaacgaaaaacggtcggttaacttagttagaactaaagtacgaaacgacgtaccgaaaggaaaacccagggtaaccaacgtacgtaccgtacttaactaccgttaacaacccagtaacggtacttaacggacgttagaacgtaacgttaggaaccgttaaggtacggtaactagttgttaacgtttacgngttaacgtcggaccgggtacccgaaggtactagttaacggg

SEQ ID NO: 114982 - DNA, 768 bp, Homo sapiens
  misc_feature: GYAE6OF02GUNJ1.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagagactcaccatggagttcgggctgagcgtgggttttccttgctgctatacttaaaaggtgtccagtgtgaagtgcgtaggtggtggagtcgtggggagtccgttaggtaaagccgtgggggtcccttagtacgtcctccgtggtgtcggcctcgtggtattcctactttacagttaatggtctggagtggtaggttcgggtcccgcgacggccgtaccggaggggaagggcgtagggtaggttggggttacggtaacgtttaacgaaaaaggttaaaaagtgtaagttagggtaaggaaagtaaaagtacggtaacgttacggtacgaccgtaaccggtaaggaaaacgggtaagtacttaccgaacctaagttacctacgaaagtaagtaaacgttaaacttaaaccggaaaaacggttcggttaagttaaacgtttacgaaacgtaaagttaacggaaacgtaacgtaacccgtaaaggtaaaacccggtaacggaacaacgtaccgggtacctacgtttaactaacgtaccgtaaccaagtaacgtacgttaggactacgtacgagtacgtaacggtaagtacggtaacttagttgtgttttacgagttaccgtcggtaaccgggacctaagggtactaggtccgg

SEQ ID NO: 114983 - DNA, 778 bp, Homo sapiens
  misc_feature: GYAE6OF02HOMHW.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaggtgtccagtgtgagtgcaggtggtggagtcgtgggggagccgttaggtaaaggccgttcggggggtccttagtaggtcctccgtgtgtggccctctggtattctacctttcagtaatggcgtggagtgtaggttcgggtccgccgaggtccgtccggaggggaggggccgtagggtaggttcgggttaggtacgtttaacgaaaaaggtaaaactggtagtaggtacgaaggtaaaatagtaacgtacggtgaccgtaccggtaaggaaaacggtaagtaacttaccaaccgtaacttcccgtaagtaaacggaagttaacgttaaacgttaaaccggaaaaaaaccggttcgggtttaagttaaacgttttagaaaaccgtaaagttacgggaaactaacgggacccgttaaaacggaaaaccggtacgggactaaaccgtcggtaacccgtttactaacgtaacgttactaacccgaacgtagtaacccgtttagggaaggttcaacgtaaccgtacggtaacggtaaagggcgtaacgttatccggttagttaccggtatacggttcggacccggtacggacggtaccgtaggttcccgg

SEQ ID NO: 114984 - DNA, 678 bp, Homo sapiens
  misc_feature: GYAE6OF02FJUG8.15.86.H09.1.454.CMB.1.raw
  modified_base (387)..(387): a, c, t, g, unknown or other
  misc_feature (387)..(387): n is a, c, g, or t
  modified_base (407)..(407): a, c, t, g, unknown or other
  misc_feature (407)..(407): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttagggtaaagccgtggggggtcccttagagtctcctgtgtggcctctggattcactttcagtaatggctggatggagttgggtccgccaggctccgagggaaggggctggagtgggttggacgtttacaaaaggtaaaatgagtggtagaagaaagtagactacggngacgacccgtagaaaagganagttaccaactatctacgaaggaagtaattaaacttacgaaaaacggtcggttacgttaagttttcgaactaaagttacggaaacctacggaccctaacgggaaaaacccgacggaaccaacgacgtaccgtacgttaacttaccgtacgtaacccacgtaacgtagttaaccgggaagtccgtaacacgttacggaacggtaaagggacggtaactagtggttactttaggattacgtccggtcggggacccaggggtactaggttcggg

SEQ ID NO: 114985 - DNA, 699 bp, Homo sapiens
  misc_feature: GYAE6OF02GI173.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaagccgtgggggtcccttagagtctcctgtgtggcctctggattcactttcagttaatggctggatggtagttgggtccgcgaggcctaccgaggggaaggggcgtagggaggtggggttcggtacgtttacgaaaaagtaaaaagtggaatgggtagaaggaaaatagaactacggtacgacgtacccgtaggaaaaggaagacttacaaccatacacgaagaagtaataagttaacaaaaacggtacggttattaagtttagataaagtagaaacgagacctaaggaaaaccgagaaccaacgacgaccgttactaactttaccgtacgttaacccagtacgtaacttcgggaaatcgactaacgtaccgaacgggttaaacggaaggtaccttaagtaccggttacttttacggaagtttacgttccgggttaccgggggaccccggtaaggggtacctacgggttaccggg

SEQ ID NO: 114986 - DNA, 998 bp, Homo sapiens
  misc_feature: GYAE6OF02FJJVQ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggtagccgttaggtaaacgccgtgggggtcccttagagtcctcctgtgtcggccttcgtcggtactttcaccttttcgaacgttaagtcgggtccttgggacttcggtaggtttaccgggggttccccgacccgtacgggtcccgtacccgtaggggggtaacggggtccgttagggttaacgggttggggggttttacggtaaaccggtttttaaccgaaaaaaaacggggtttaaaaaccttcggggtaaagtttacggggttaacggtaaacggtaaaaaacttacgggtaacccgtaccggggtttaccgacccgtaaaccccgggttaaggaaaaacggggtaaacgttaccgtttacccgaaacccgtaacgttacccgttaaccggaaaacggtaacggtttaacttaaaaccgttttaaacccggaaaaaacccggtcgggtttacgtttaaaccgtttttacggaaccgttaaaaacgttcgggaaaaacccttacgggtaaccccgttaaaacggaaaaacccccggaggtaaaccccgaccttaaccggggttacccttaccgttaaaagttttaccccgaggttaaacccccgtacgtaaaggttaaccgtttaaccggggtaaacttcgggaaccttacgtaaccggtaaccgggtttaaaaggggccctaacggtttacgtaccggttttaagtttttacggaaacctttacggggttaccccgtaccggggggtacccccgtaagggggtacctttaacggttccggggg

SEQ ID NO: 114987 - DNA, 804 bp, Homo sapiens
  misc_feature: GYAE6OF02FJ8KL.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttggtaaacgccgtggggggtccccttagacgtctcctggtgtggcctcgtggattcactttcagtaagtggctggtatggtaggttcgggtcccgccgaggcctaccgagggggaaggggtccgtgggacggttggggttacggtaacgtttaacgaaaaaggttaaaaacgtggtaagttagggtagaaaggtaaaaagtacggaacgttacggtagacccgtaaccccggtaaggaaaacgggaagtaactttaccgaaccctaagttacccgtacgaaaggaacgtaaacttaaacgtttaaaccgaaaaaaccggtcggtttaagtttaaactttacggaacctaaaagtacggaaacccaggtaacccgtaaaggaaaacccgtgggaaaccaacgacgtacccgttacttaacgttaacccgtacgttaacccaacgtaaggtaacgttaccgggaaagtccgtacgtaagtaccggtaacggtaaagggcgtaacgttagttaccgttcgtttttaagaacgtttacgttaccgggtaccggggtaccctaaggggtaaccctagggtttaccggg

SEQ ID NO: 114988 - DNA, 774 bp, Homo sapiens
  misc_feature: GYAE6OF02HT107.15.86.H09.1.454.CMB.1.raw
tcagtctacgtagccacgaccggtgctcgatttagtgctatagacttgggtttggggggagaggagccccagccttgggatccccaagtgttttccattcagtgatcaggactgaacacagaggactcaccatggagttcggctgagctgggttttccttgctgctatacgttaaaaggtgtccagtgtgaagtgctaggtggtggagtcgtggggatccgttaggtaacgtccggttgggggttccctagacgttcctcctgtgtcggccttcgtggtacttttacttcaagttactggctggatggtagttcggtcccgacgaggtcctaccggaagggaacgggtcgtagggtaggtttggggtaggttaaccgtttaacgaaaaagttaaaagtcgagttagggtagaaagtaaaaacgtggaaccgtacggtacgaccgtaacccggtaagaaacggaagtaactccaaccgtataccgtaacgaaagaacgtaaacgttaacgttaaaccgaaaaacgggttccggtttaattaagtttaacgaacgtaaaagtacgaaaccgacgtaaccgaaacggaaaaaccggacgaacctaaacggcctaaccggttacttaacggtttaacaccggtaacccaacgtaggtaccgttagggtaaagtcggaacgaagttacggaaacggttaaggcgacttaggttacgtacgttttagaattacggtcccggtaccggggaacccgtaaggtacgttaggttcggttaccg

SEQ ID NO: 114989 - DNA, 845 bp, Homo sapiens
  misc_feature: GYAE6OF02IPHDY.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaaacgccggtacggggggtcccttaaggacgttcctcccgttggtggtcgggtcccttcgtggtattcactttcaagttaatcggctaggatcggtaggtttcgggtacccgaccgaggtccgtacccggaagggggaacgggggtccgttaggggtagggttcgggggttacgggtaaaccgttttaaaccgaaaaaaggttaaaaagtggtaaagttgggttaagaaaggtaaaaacgtaagtacgtaacgggtagaccgtaacccggtaaggaaaagggtaactacttaccgaacctaagttacctaacgaaaggaactaagttaaacgttaaaccgaaaaaacgggtacggttagttaaacgtttagaactaaaagttacggaaaacctacggtaacccgtaaaggaaaaaccggtaggaaacccgaaccgaacggtacccgtaattaacttaaccgtactaaccgaacgtaaggtaacgttaaccggaaaggtgtaacacgttacgaacgggtaacgggtacggtaactttaacgtcgtttaccgttttaaggaactttaccggtaccgggttacgggaccccggtaaggttacccggttaaggttccggg

SEQ ID NO: 114990 - DNA, 671 bp, Homo sapiens
  misc_feature: GYAE6OF02GDTGL.15.86.H09.1.454.CMB.1.raw
  modified_base (351)..(351): a, c, t, g, unknown or other
  misc_feature (351)..(351): n is a, c, g, or t
  modified_base (565)..(565): a, c, t, g, unknown or other
  misc_feature (565)..(565): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtgggggtcccttagagtctcctgtgtggcctctggattcgactttcgagtaatggctggatgagttgggtccgctaggctccgagggaaggggctagggagtgggttggacgttttanaaaagttaaatgaagtcggtagaagtaaaagtggtaacgtaacggtgacctaaccggtaggaaaacgggaagtacgttaccgaacctaagtcctaacgaaaggtagtaacttaacttaaccgaaaaacgtcggttattaagtttacgactaaagtcgaaacgagacccgtaaggaaaaccgagtacaacacgtccgtatattaccgagtaccanagtagttacggaagtcgacgtacgtacggacgtaagggtcgtaattagtcgttacgttttagagttacgtccggtaccggggaccaagggtacctaggttaccggg

SEQ ID NO: 114991 - DNA, 652 bp, Homo sapiens
  misc_feature: GYAE6OF02HMBZA.15.86.H09.1.454.CMB.1.raw
  modified_base (366)..(366): a, c, t, g, unknown or other
  misc_feature (366)..(366): n is a, c, g, or t
  modified_base (441)..(441): a, c, t, g, unknown or other
  misc_feature (441)..(441): n is a, c, g, or t
  modified_base (498)..(498): a, c, t, g, unknown or other
  misc_feature (498)..(498): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggaggtcgtggggggagccgttgggtaaacgccgtaggggggtcccttaggacgttctcctgtggtcggccttctggattctactttcagtaatggctggatggaggttgggtccgcgaggcctaccggaggggagggcgtgggaggtgggttggtacgtttanaaaaggttaaatggatggagaagtaaaatacgtaacgtacggcaccgaccggtagaaacggaatagtcacatcanagtatataatacaaagtcgtattatagacaaatgaacacgacctaaaggaaaccggnggaacacgacgtccgtactattcggtaactacccagaacggttgtacggtaagttcgacaacgtacggtaacgtaaagggcgttaacgtatcggtttaacttttaggactttcggtacggtccggggaacccgtagggtaacctagggttccgg

SEQ ID NO: 114992 - DNA, 726 bp, Homo sapiens
  misc_feature: GYAE6OF02IKNFK.15.86.H09.1.454.CMB.1.raw
  modified_base (306)..(306): a, c, t, g, unknown or other
  misc_feature (306)..(306): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaacgccgtgggggtcccttagagtctcctgtgtggcctctggattcactttcagtaatggctggatgagttcgggtaccncacggctccgagggaggggctgggaggtgggtggtacgtttacgaaaagtaaatgatggtagaagaaatagactacggtgacaccggtagaaaggaagattacaacctatactacgaagtagaattaaagttaaccgaaaacggtacggttagttaagtttaggaacctaaaagtagaaaccgacggaccgtaaagaaaaccggtaggacctaacgaccggtacccgttaacttaacttaccgtacgttaaccccgaataaccggttaagtaccggtaaaggtcggtaacctacgttaccgggaacggttaaaagggaccggtcctttaagttacggtttagttttttaaccggaattttaaccggtaccgggtttaccgggggaacccccaagggggttaccctaagggtttcccgggg

SEQ ID NO: 114993 - DNA, 755 bp, Homo sapiens
  misc_feature: GYAE6OF02IU03K.15.86.H09.1.454.CMB.1.raw
  modified_base (181)..(181): a, c, t, g, unknown or other
  misc_feature (181)..(181): n is a, c, g, or t
  modified_base (568)..(568): a, c, t, g, unknown or other
  misc_feature (568)..(568): n is a, c, g, or t
  modified_base (618)..(618): a, c, t, g, unknown or other
  misc_feature (618)..(618): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatcttaaaaggtntccagtgtgaagtgcaggtggtggagtcgtgggggagtccgttaggtaaagccgttggggggtacccttaggagtccgtccgttggtggtggtcctcgtggtacttctacgtttcagttaaactggctggtatggtaggttcggggtacccgccagggctcccggaagggggtaacgggggcctggggaggttcggggttagggtacggttttaacgaaaaagttaaaaagtggtaagttgggtagaaggtaaaaatacggaacttacgggagaccgtaacccggtaggaaaagggtaaagactttaccgaaccctaatccgtacaaaggacgtaaataactttaacgaaaaaacggtacggtagttaacgtttagactaaacgtanaaaacggtacgaaccgttaggaaaaaccgcgggaacacgaaccgccttanaacgttacctacgtacccaacgtaaggtacttcgggaagtcgacacgtaccgaggttaaacgacgggacttaacttcggttacctttagaacgttacgtcggttccggggaaccctaggggaacctaagttccgggg

SEQ ID NO: 114994 - DNA, 795 bp, Homo sapiens
  misc_feature: GYAE6OF02IJMD1.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctcgagcgttgggttttccttgctgctatacgttaaaaggtgtccagtgtagaagtgcgaggtggtggagtcgtggggagtccgttaggtaaacgtccgtgggggtccttagacgtctcgtgtgtcggtcctcgtggtattcgtactttcgaagtaatggtctggagtgtaggttcggtccgccgacgtcctccggaagggacggggtcgtagggtacggttgggttacggtaacgttaacgaaaaagtaaagtgtagtaggtagaaagtaaaagtacgtacgtacggtacgaccgtaaccggtagaaaaggtacgtactaaccgacctaactactaacgaaagtacgtaaattaaacgttaaaccggaaaacggtaggttagttaagtttacgaaccgtaaagtaacgaaaccgtaacggtaacccgtaaacggaaaaccggacgaaaccaacggtaacgtaccctaaattaacgtttaccgaaccgttaacccaagtaacggttaccgttaaacgggttagacgtaaacctacggttaacggaaaccggtaagggtaacggtcttaaacggttacgtttacgttttacgaagttttacggtacccggggttacccgggaacccgtaagggttacccagggtttaccggg

SEQ ID NO: 114995 - DNA, 759 bp, Homo sapiens
  misc_feature: GYAE6OF02IFQXD.15.86.H09.1.454.CMB.1.raw
  modified_base (219)..(219): a, c, t, g, unknown or other
  misc_feature (219)..(219): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtcgtggggganccttggtaaagccgtgggggtccttagagtctcctgtgtggcctctggattctactttcagtaatggcgtggatggagttcgggtcccgccgaggcctaccgaagggggaacgggggctgggtacggttggggttaggtaacggttttaacaaaaaaggttaaaaaagtgaagtggtaagaaagtaaaaagtacgaacttaacgggtagtaccgaacccgtaggaaaacggaaagtacttacaaccgtatactacaaaggaagtaataaacttaacgaaaaaaccggtcggttaagttacgtttacgaactaaaattacggaaaacacggaacctaaacggaaaaacccgagggaaaccacgtaacggtaccgttaacttaacttaacgttaccgtaaccacgtaagttaacgttaccgggaaagtcgactaacgttacgaaccgggttaaaaggcggaactttagaggtttcctttttaaggaactttacggttacccgggtacggggtacccccgaaaggggtacctaaggttccggg

SEQ ID NO: 114996 - DNA, 928 bp, Homo sapiens
  misc_feature: GYAE6OF02I30BS.15.86.H09.1.454.CMB.1.raw
tcagtctacgtagccacgaccggtgctcgatttagtgctatagacttgggtttgggggggggaggaggagccccagccttgggatccccaagtgttttcattcagtgatcaggactgaacacagaggactcaccatggagttcggggctgagcttgggtttccttgctgctatactaaaaggtgtcagtgtgaagtgcaggtggtggaggttcgtaggggggagccgttagggtaaaacggtccggtcggggggggtacccttaaggacggttacctccgttggtggttcggccgttcgtggagttcgtactttacaagttaagtggacgtaggtagtggtaacggttggggtcccaccggtaacgggccttaccggaacggggtaaagggggccgtagggggtgggtacggggtttacggggtaaccgttttaacggaaaaaaagttaaaaaaggtcggtaaaggttgggtaagggaaacgtaaaaaagtaaacggtaaccggttaaacggtcgggaaccgtaaccccgggttaaggaaaaacgggtaaagtaacggtttaccaaaccggaacttacgttaaacgaaaggtaacggaaatttaaaacgttaaaaccggtaaaaaaaccggtacgggttagttaaatttacgggaaccttaaaaagtacgaaaacggtaacgaaccgttaaaggaaaaacccgtaaccgggaaaacgacccctaaagggtaccccgttaacttaaccgttaaaccgttaacggtaaaccctaaacccgtaggtaaacggggttacgtaaaaggttcccggaactaacgggttaacgaaaccgggttaaaagggggaaccgtaaattaggacctttacgggttaactaggttaaacggtcgtaccgggaccggttaaccgggaaggttaccgtacgggg

SEQ ID NO: 114997 - DNA, 646 bp, Homo sapiens
  misc_feature: GYAE6OF02INNAG.15.86.H09.1.454.CMB.1.raw
  modified_base (306)..(306): a, c, t, g, unknown or other
  misc_feature (306)..(306): n is a, c, g, or t
  modified_base (483)..(483): a, c, t, g, unknown or other
  misc_feature (483)..(483): n is a, c, g, or t
  modified_base (505)..(505): a, c, t, g, unknown or other
  misc_feature (505)..(505): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaacgccgtgggggtcccttagagtctcctgtgtcggcctctggattcacttcagtaatggctaggatgagttgggtcccncgaggctccgaaggggaaggggctgggtagttgggttcggtaacgtttaacaaaaagtaaaaagtgataggtagaagaaaaatgacgtacggtgaccgaccggtagaaaaggagtatcaacatcacaagactataaagtacaaaaacggtcggtataattagactaaatgaactacnccgtaagaaaaccgagaacaanaccgtacctataacttacgactaaccctaagacgtaacttacggaagtcgaactaagtaccgtaacggtaaaggacgtcttaactgttaacctttagtaattacgtccggtaccgggtaacccaagggtactaacggtcgg

SEQ ID NO: 114998 - DNA, 703 bp, Homo sapiens
  misc_feature: GYAE6OF02JFUJL.15.86.H09.1.454.CMB.1.raw
  modified_base (317)..(317): a, c, t, g, unknown or other
  misc_feature (317)..(317): n is a, c, g, or t
  modified_base (452)..(452): a, c, t, g, unknown or other
  misc_feature (452)..(452): n is a, c, g, or t
  modified_base (497)..(497): a, c, t, g, unknown or other
  misc_feature (497)..(497): n is a, c, g, or t
  modified_base (532)..(532): a, c, t, g, unknown or other
  misc_feature (532)..(532): n is a, c, g, or t
  modified_base (561)..(561): a, c, t, g, unknown or other
  misc_feature (561)..(561): n is a, c, g, or t
  modified_base (587)..(587): a, c, t, g, unknown or other
  misc_feature (587)..(587): n is a, c, g, or t
  modified_base (621)..(621): a, c, t, g, unknown or other
  misc_feature (621)..(621): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
  modified_base (650)..(650): a, c, t, g, unknown or other
  misc_feature (650)..(650): n is a, c, g, or t
tcagtctacgtagccacgaccggtgctcgatttagtgctatagacttgggtttgggggggagaggagccccagccttgggatccccaagtgttttcatcagtgatcaggactgaacacagaggctcaccatggagttcggctggagctggtttccttgctgctatctaaaggtgccagtgtgaagtgacaggtcgtggacgtcgtagggggactccgttagggtaacgccgtacggggggtcccttaggagttcctaccgtggtggtacggtccgtagtggttacgttctacgtttacgagttaagtggtctacggngtacgtggtttacgggtcccacgacggtccgtaccgtaggggaacgggtctggtacggttcggtaggttaccggttttaacgaaaaacggtaagttggaacgtacgggagaacgtaaaattcgtaacgtcggtanacccgggttaacgtagggaaaaccgtaggtacttacgaccgtaancccggaatacggataacgtaataacgaaaaccggnggtttaactattagacctaagtaccgacngaacctaacggaacgacgacgaccgngtacctaatttgtaaccgtcgaacgagtatacgngtaacgngtacnggttaacagaacgggtnaacgttagtcgttaagcgtatccggagggtacccaggtaacacggtgttcggg

SEQ ID NO: 114999 - DNA, 668 bp, Homo sapiens
  misc_feature: GYAE6OF02F8JFE.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccgttaggtaaagccgtggggggtcccttagagtctcctgtgtggcctctggattctactttcagtaagtggctggatgtagttgggtccgcgaggctaccgaggggagggcgtggaggtgggtggtacgttacgaaaagtaaaatgaatggtagaagaaaagtgaacgtacggtgacgtaccgtagaaaggagacttacactatactacaagagtaataactaacgaaaaacggtggtacgttaatttagactaaagtagaacagaccgtaagaaaaccggtaggaaccacgacgtccgtaacttacgttactacgtaccaagtaagtacgtttacggaagttcgacgtaacgtacgggtacgtaaaggtacggtaactaaggtcgttacttttaggaaacgtttcggttacgggtaccgggaacccggaggggttaacaaggtttcggg

SEQ ID NO: 115000 - DNA, 693 bp, Homo sapiens
  misc_feature: GYAE6OF02JUMBV.15.86.H09.1.454.CMB.1.raw
  modified_base (636)..(636): a, c, t, g, unknown or other
  misc_feature (636)..(636): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatactaaaggtgtccagtgtgaagtgcaggtggtggagtcgtggggagcttggtaagcgtgggggtcctagagtctctgtgtggcctctggattcactttcagtaatggcgtggatggagttcgggcccgcgaggctccgaggggaagggcgtggaggtgggtggtacgttacgaaaagtaaaatgagtaggtagaagtaaagtagacgtacggtacgacgtaccggtagaaaggtagaacgttacaacgtactacgtaacgaagtagtaagttaacttaaacgaaaaacgtacggttagttagttacgaagtaaaagtagaaactacggaacctaaggaaaaccggagtaacaacgtcgtaccgtacttaacgtaacgtactaacccgataacggttacgtaagggaactacgacgtacgtaaccgagggtaaaaggacggtacttaggttaagttccggttttaanaacggttagttacccgggtacgggtaacccccggaagggtaccgttaacggttcggg

SEQ ID NO: 115001 - DNA, 665 bp, Homo sapiens
  misc_feature: GYAE6OF02I78E2.15.86.H09.1.454.CMB.1.raw
  modified_base (216)..(216): a, c, t, g, unknown or other
  misc_feature (216)..(216): n is a, c, g, or t
  modified_base (257)..(257): a, c, t, g, unknown or other
  misc_feature (257)..(257): n is a, c, g, or t
  modified_base (479)..(479): a, c, t, g, unknown or other
  misc_feature (479)..(479): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
  modified_base (545)..(545): a, c, t, g, unknown or other
  misc_feature (545)..(545): n is a, c, g, or t
  modified_base (590)..(590): a, c, t, g, unknown or other
  misc_feature (590)..(590): n is a, c, g, or t
  modified_base (651)..(651): a, c, t, g, unknown or other
  misc_feature (651)..(651): n is a, c, g, or t
tcagtctacgtagccacgaccggtgctcgatttagtgctatagacttgggtttggggggggggtaggagggaggccccacgccttcggggatccccaagtgttttccattcagtgatcaggactgaacgacagaggactcaccatggagttcgggctgagctgggttttccttgctgctatcttaaaggtgtccagtgtgaagtgcaggtggtggngtctgggggagccgttggtaagccgtagggggtcccttagngttctcgtgtgcggcctctggtattcactttcagtatggctgggatgtaggttcgggtccgaccacgggtctccgaagggggaacgggccggttagggaggttcggggttacggtaacggtttacgaaaaaggttaaaacgtgtaacgtggtagtaacgaaaagtgtacgttaacgtgacctaccggtaggaaagggctaagtcaactatcgtacaaggtanaactaagtaacaaacgtcggtattacgtttanacgtaatanaaccgacgtaaccaaaggcggtaanaccgacacgtctatacttagaccacgtaatcgtacggaattcggntaacgagtaacctaggggctacgtggtactgttctaagtacgtcgttcgggaggttaacgngaacgtcggtaccg

SEQ ID NO: 115002 - DNA, 656 bp, Homo sapiens
  misc_feature: GYAE6OF02IVTDE.15.86.H09.1.454.CMB.1.raw
  modified_base (443)..(443): a, c, t, g, unknown or other
  misc_feature (443)..(443): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaaggccgtgggggtcccttagagtctcctgtgtcggcctctggattcactttcagtaatggctggatggaggttcgggtccgccgaggcctaccggaggggaacgggggcgtgggaggttggggttggtacggtttaacgaaaaagtaaaagtgagtggtagaagaaaatagactagtagtagacaccgtagaaaggaagtacttacaacatactanaagataataacgtaacgaaaaacggtaggttattaagtttagactaaagtagaaaccgagaccgtaaaggaaaaccgaggaaccaacgaccgtaccgtatacttacgtacaaccgactagtacgttacgggattacgactagtacgtaaggtaaagggcgtatacgtgttacgttttagattacgtcggtacgggacccgtagggactaacgg

SEQ ID NO: 115003 - DNA, 791 bp, Homo sapiens
  misc_feature: GYAE6OF02I8XTD.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttggtaaagccgtggggggtcccttaggtagtcctcctggtgtcggccttcgtggacttcctactttcagttaatggctggatggacggttgggtcccgacgaggcctaccggaaggggaaggggctgggtacggttggggttacgggtacgtttaaacgaaaaaggtaaaaagttggtaacgttaggggtagaaacgggtaaaaaagtaggtaaacctacgggtagtaacccgtaacccgggttaggaaaaacgggaagtaacttacccgaacttaagtccctaagaaacgtaagttaaactaaacgtttaaaccgaaaaacgggtacggtttagtttaaaccgtttgaaaccgtaaaagtacggaaacttcgaacccgtaaagaaaaacccgtgaaacccgtagaccgtaccgtacgttaaattccggtaataaccctaagatacggtttagaaacgttcgtaaccattacccgggaaggtaaggtacggactttacggtacgtttaagtttacggtaatcgggttacggttacccggggacctaagggaacctttaagttcccggg

SEQ ID NO: 115004 - DNA, 966 bp, Homo sapiens
  misc_feature: GYAE6OF02JBVC1.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgaggcttgggttttccttgctgctatacttaaaaggtgtccagtgtgaagtgcgaggtgggtgggaggtcgtggggggagtccgttagggtaaaaggtccggttcggggggttccccgtttaggacggttcttccccgttggttggtcgggcccttcgttggtattcctactttctaagttaatgggtctgggattggtacggtttcgggggtccccgcccgagggcctaccggaggggtaagggggcgtggggacggttgggggttagggtaccgttttaacgaaaaaggttaaaaagtggtaagtagggtagaagtaaaaagtagtaaacgtacggtacggaccgtaacccggtaaggaaaaacggtaaggtaaacgtttaccaaacccgtaactttaccgtaaccgaaaaggtaacggtaaattaaacctttaaaccgaaaaaaacgggttaccgggttaagttttaaagttttacggtaaacgtaaaaacgttaacggtaaaacgtaaccgtaacccgttaaacgggaaaaaaacccggaaaccgggtaaaccgaaaacccggaaccggttaaccccggtttaacctttaaaccgttttaaccgttaaccggttaacccctaaaccggtaaacggttaacgtttaacggggtaaacggttacgtaacgtaaaccggtacccggtaaacggggttaaaaacgggtacgggttaaccgttaaaggttcggtttaacgttttttacggtaattttaccgggttacggggttacccgggggtaccccggaagggggttaacccgtaggttttaccggggg

SEQ ID NO: 115005 - DNA, 784 bp, Homo sapiens
  misc_feature: GYAE6OF02JB3H0.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttcctgctgctatacttaaaggtgtccagtgtgaagtgcgaggtggtggagtcgtggggagtccgttaggtaaacgccgtacgggggtcccttagacgttctcctggtggtcggtcctcgtggagttcactttcagtaagtggcgtggtagtggtacggttcgggtcccgccgaggtcctaccggtaggggaacggggtcgtagggtagggttggggttacggtaacggttttaaacgaaaaaggttaaaaagtcggtaagtagggtaggtaaagtaaaagtacggtaacgtaacggtcgtaacccgtaacccggtaagggtaaaacggaacggtaactaccgtaaccgtaacgttaccgtaacgaaacgtaagtaacttaaacggttaaacgaaaaaaccggttcgggttaacgtttaagtttaccggaaagtaaacgtaacgaacgaaccgtaccgtaaacggaaaaaccgtaacggacgaaccgtacggtaccctacgttaacgttacgtccgttaaaccgacgtagtacgttacggagtgaacctagtaggaaccgtaagacggtactcgttagtcttaaggtactacggttaccggccggtaaccgtaggtacctacgggttacg

SEQ ID NO: 115006 - DNA, 823 bp, Homo sapiens
  misc_feature: GYAE6OF02JRS0K.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggttttccttgctgctatcttaaaaggtgtccagtgtgaagtgcgagggtggtggaggtcgtgggggagtccgttagggtaaaggtcccggtacggggggttacccttaggtacgttcgtccttggtgtcggccttcgtggtacttcgtactttacgagttaacgtggtcgtaggtagtggtaggttcgggtcccgccgtaggtccgtaccggaaggggtaacggggcgtgggtagggttcgggttaggtacgttaacgaaaagtaaaagtgtaaggtaggtaacgaagtaaaagtacgtaacgtacggtcggtaaccgtaccgaaggaaaacggtaaacgtacgttaccgaacctacgtactaacgaaagtagtaacgttaaagtaaaccgaaaacggtacggttaagtttaacgttaaggtactaaaagtcgtaaaacgtaccggaaccgttaaacgaaaaccggacggtaacgaaccgtaacgtaccgtacgttaaacgttaccctaggtaaccctaaggtaaagtacccgttagggaaacggtcaccgtaacgtaaccgtaaccggttaagggtaccggttggttaaaccttcgggttaaacgttttcggaaacgttccgttaaccgggtggggaaacccccggtaaggtacccggtacggttccggg

SEQ ID NO: 115007 - DNA, 776 bp, Homo sapiens
  misc_feature: GYAE6OF02IEFCK.15.86.H09.1.454.CMB.1.raw
  modified_base (710)..(710): a, c, t, g, unknown or other
  misc_feature (710)..(710): n is a, c, g, or t
  modified_base (735)..(735): a, c, t, g, unknown or other
  misc_feature (735)..(735): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagttgggttttccttgctgctatcttaaaggtgtccagtgtgaagtgcaggtggtggagtcgtggggagccttaggtaaagccgtgggggtcccttaggacgtctccgttgtgtcggtcctcgtggtacttctactttacagttaagtcggtcgtggtatggtaggttcgggtcccgtccgacggcctaccggaaggggtaaggggtcgtaggggacggttggggttgggtaacgttttacgaaaaaaggttaaaagtgtaagttgggtagtaaacggtaaaagtaggtaaccgtacgggtacgacccgtaaccggtaaggaaaaggaacgtaacgttaccaaccgtacgtcctaacgtaaagaacgtaaatttaaacgttaaacccgaaaaaacgggtacgggtttaagtttacttttaaggaacttaaaagttacgaaaccgtacgtaaccgttaaacggaaaaacccggtcggaaaccaccggacgttacccgttataacgttaccacgtaaccacgtaggtacgtaccggtattacgcaagtacgtaaggtaacgacggtntaacgtgttactttgactttccggnggttacccgggaaccgtacgggtacttacgggtggttcccg

SEQ ID NO: 115008 - DNA, 746 bp, Homo sapiens
  misc_feature: GYAE6OF02GEH31.15.86.H09.1.454.CMB.1.raw
  modified_base (248)..(248): a, c, t, g, unknown or other
  misc_feature (248)..(248): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggttttccttgctgctatacttaaaaggtgtccagtgtgaagtgcaggtggtggagtcgtgggggagtccttggtaaagccgtgggggtcccttagngtctcctgtgtggcctctggtattcactttcagttaatggctggagtggtaggttgggtcccgcgaggtccgtaccgaaggggaacgggcgtgggtaggtggggttggacgtttaacaaaagtaaaatgtagtgggtagaagtaaaagtagactaacggtcgtacgacccgtaaggaaaaggaagtacttacgactaactactaacaacgtaataacttaaaataacgaaaaacggtacggtaagttagttttagaactaaaagtacgaaagtacggacgttaacggaaaaccgtaggaacaacggacgtaccgttacttaacgttactaacgtacccgagtacgtaacgttaccggagttaccgaacgtaacgacggtaaacggtaaacggtcggtaacgttacggtttacgttaccgtttttaaggtaacgtttacgtttacccggggttacccgggaaccccgttacggggtaaccgttaacggtttacccgggg

SEQ ID NO: 115009 - DNA, 759 bp, Homo sapiens
  misc_feature: GYAE6OF02H1NO0.15.86.H09.1.454.CMB.1.raw
  modified_base (558)..(558): a, c, t, g, unknown or other
  misc_feature (558)..(558): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcttgggtttccttgctgctatacttaaaaggtgtccagtgtgaagtgcgaggtggtggagtcgtgggggagccttaggtaaagcgtcgggggtcctagagtcctcgtgtagtcgcctcgtacggtattacgtacctttacgtagtaagtggtcttaggagttagtaggttcgggtacccgaccgaacggtcgtacccgaagggggaacgggtctaggggtacggttggggttacggtaccgtttaactaaaaggtaaaaaagtagtagtagggttaggaaacgtaaaagtaagaacgtaacgtcgtacgaaccggtaacggtaaaggaaacgtacgtaactaccgaacttaccgaacgtaagaagtaagtaactttaagaaacgtaaacggtagttactagtaagaaanagtaacagtaactaacgaaaacggacgtaacgaacgccgaagtaccttacgtaacgtaagtaccgaacgtaggtaattaaccggggaacgttagaccgtataacccgggtaataacgggttaggaaccgttacttaggtaccgtttttaagaccgtagttacccgggaccgggttacccggaacggtaggtaacgtacggg

SEQ ID NO: 115010 - DNA, 709 bp, Homo sapiens
  misc_feature: GYAE6OF02J21QT.15.86.H09.1.454.CMB.1.raw
  modified_base (208)..(208): a, c, t, g, unknown or other
  misc_feature (208)..(208): n is a, c, g, or t
  modified_base (422)..(422): a, c, t, g, unknown or other
  misc_feature (422)..(422): n is a, c, g, or t
  modified_base (579)..(579): a, c, t, g, unknown or other
  misc_feature (579)..(579): n is a, c, g, or t
  modified_base (669)..(669): a, c, t, g, unknown or other
  misc_feature (669)..(669): n is a, c, g, or t
tcagtctacgtagccacgaccggtgctcgatttagtgctatagacttgggtttggggggagaggagccccagccttgggatcccaagtgttttcattcagtgatcaggactgaacacagaggactcaccatggagttcggctgagctggttttcctgctgctatcgttaaaggtgtaccagtgtgaacgtgcaggttggaggagtcgnggggagccgttaggaagcgttcgggggccttagcgtctcctgtcggtgcttcgtaggtacttctactttcgaagtacttggccttagggtctggtaacggttcgggtcccgcgtaacggtcccgtacggacggggtaacgggacgtcgggtaacggtggttacgggtaaccgtttaacgtaaaagtaaaacgtgtacgtaggtagaaaggtaanaaccggtcgtaaggtcacggaacgtacggaacggacggtaacttccaaccgtactactagaaggaatacgtaaactaaacgtaaacggcgttaagtaacgttacggaataacgtaccgttaaagccgtaacgttaacgaaaccggagttacgaaacngggaccctattaacgaccggtattaaccgaacgtagttagaaccgggcgttaacgtcgaacgtttacgacggtaaggtccgtaacggttntacgttacgttgacgtacgtcgacgcgtacggacttgtcg

SEQ ID NO: 115011 - DNA, 803 bp, Homo sapiens
  misc_feature: GYAE6OF02IUN40.15.86.H09.1.454.CMB.1.raw
  modified_base (162)..(162): a, c, t, g, unknown or other
  misc_feature (162)..(162): n is a, c, g, or t
tcagtctacgtagccacgaccggtgctcgatttagtgctatagacttgggtttgggggggagaggagccccagccttgggatcccaagtgttttcattcagtgatcaggactgaacacagaggactcaccatggagttcgggctgagctgggttttccttgntgctatacttaaaaggtgtccagtgtgaagtgcaggtggtggagtcgtggggagccttggtaaagccgtgggggtccttagagtctcctgtgtgctctggtatcgtacttcaagttaatggtctggatgaggttcggtcccacaggctacgagggaagggctggtagttgggtacggtacgtttacgaaaaagttaaaaacgtggtagttagggtacggaaagtaaaaacgttagaaaccgtttaacggtagaccgtaaacccggtacggaaaaagggaagtaacgttacaaccgtaattactaaccaaaggtaacgtaaagtttaaacgtaacgaaaaaaacccggtcgggttaacgttaacttttaaacgaacgtaaaagttaacggaaaccgttaaacggaccctaaacggtaaaaaccgaggtaaacctaaccgacgtaccgtaaccgttagttaaacgtaacgttaacccgaacgtaaggtaacgttaacggtaacggttacgtaacgtaacgttaccggaaacgggttaaacggtacgggtaacttaacggttagttaaccgttttacggtaagttaacggttttcggtaacccggggtacccggtaaacggggttaaccgtaaggtttaccggg

SEQ ID NO: 115012 - DNA, 984 bp, Homo sapiens
  misc_feature: GYAE6OF02HSLX3.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtaccagtgtgaagtgcgaggtggtggagtcgtggggggacgtccgttagggtaaacgtcccggttacgggggggttacccctttaggacgttccgttcccgttggttggttcgggtcccttcgttagggtactttaccgtactttttaccgtaaggtttaaagttgggtccgttagggtagttaggtacgggtttccgggggtccccgtacccggtcggtaccgttacccgggaagggggtaaccgggggtccgttagggggtacggggtttagggggttacgggttaaccgttttaaacggtaaaaaaaggttaaaaacgtagggttaaggttagggttaagaaaggtaaaagtaacggtaacggttaccggtacgtaaccgtaacccgggttaaaggtaaaaccgggaagttaacgttaaccgaacctaacgtttaaccctaacgtaaacggtaaacgttaactttaaaacgttaaaccgaaaaaccgggtttacggttaaggttttaacgtttaacggaaacttaaagttaacggaaaccgtaacggtaaacccgtaaacgggaaaaaccggacggtaaactaaacccgtcggtaaccccgtttaacttaagtttaacccttaaccggtaaacccctaacgtaacggttaacgtttaacggaacggttacgaccgttaaacggtacccggtaaaggtaaacggggttacgtaccggtttaaacgttcgggttacttttaacggtagtttaccggtacggggttaccgggacccggtaaggtacccgttaaggttacccgggg

SEQ ID NO: 115013 - DNA, 701 bp, Homo sapiens
  misc_feature: GYAE6OF02GKW5S.15.86.H09.1.454.CMB.1.raw
  modified_base (187)..(187): a, c, t, g, unknown or other
  misc_feature (187)..(187): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcacgccccccgtntgcatctgccttgctgggacgcctcgatacaagcctcacctgaccaaccctaagtagtgagcatccgaacctacaccatcgaatggtatacaacagagacgaggaaccgtacccccagtactataatagtaaacgttaagagtgagtggacagccaacgaccggaagggggaacgacgtccccgaatcgcttacgacgtggtcctcgtagttacgtgggacgtccggacccgtccttacccaccgtaccaccgttcctaccccgaacctcctacgttacgtacgtaccgtagtcgtacggtcgtgtaagtacctacgtaccgttagggtaggacggtaacgaccggtaccgaaccctaacgtaaacgtttacggacgttaccgggaaccgtaaacgggttacggggtttacggggtttacggggtttacggggaaccggggtaaaccgggaccgtaaccgggtaccgttacccgggtaacccggtttccggttaccgggtacgtaacccccggg

SEQ ID NO: 115014 - DNA, 1065 bp, Homo sapiens
  misc_feature: GYAE6OF02HFEL4.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttcctgctgctatcttaaaaggtgtccagtgtgaagtgcaggtggtggagtcgtgggggacgtccgttaggtaaacgccggtcggggggttccccttaaggacgttccgttcccgttggttacggtcgggtaccccttcgttagggactttccgtaccgtttttaccgaacggtttaaagttcgggtccgtttaggggtaacgttacggggttaaccggtttccggggggtccccgtacccccggtaacggggtccccgtttaacccggggaaacgggggggtaaacggggggtcccgttaccggggggtaacggggttttggggggtttaaccggggtttaaaccggttttaaaccggtaaaaaaaaaggttaaaaaacggtttgggtaaacggtttaggggtaaaggtaaaaaccggtaaaaaaggttaaccggtaaaccgggtttaaacggggttaaccgaaccccgttaaacccggggtaaaggtaaaaaaccggggtaacggttaaaccgtttaacccgaaaccccgtaacgttaaccggtaaacccgtaaaaggtaaccgtttaaaaccgtttaaaacgtttaaacccggtaaaaaaaaccggggtttcgggtttaaaggtttaaaccgttttaaccggtaaaacttaaacggttaaacggtaaacgtaaccggtaacccggtaaaaaccgggaaaaccggtaaacgggtaacccgaagttaccgaaccccggtttattaacgttaacccggttactaacccgtaacgtaacgtacgttacggtaaacggtacaccgttaaggaccgtaacgggtaaagggaccggttactaagttcggttacttttaaggaacgtttcggaccggttaccggggtaacccgaggggttaaccctagggttccgg

SEQ ID NO: 115015 - DNA, 626 bp, Homo sapiens
  misc_feature: GYAE6OF02GLOZ6.15.86.H09.1.454.CMB.1.raw
  modified_base (344)..(344): a, c, t, g, unknown or other
  misc_feature (344)..(344): n is a, c, g, or t
  modified_base (381)..(381): a, c, t, g, unknown or other
  misc_feature (381)..(381): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtggggggtcccttagagtctcctgtgtgcctctggattcactttcagtaatggctggatgagttgggtcccgcaggctccgagggaaggggctggagtgggtggacgtttanaaaagtaaaaatgatggtgaagaaaatagactacggngcaaccgtgaaaggaagattacaccatctacaaagagaataattacaaaaacgtcggtagtaagtttgactaaatgaaacacgacctaaggaaaaccgaggaaccaacagtcccgtagtaacttacgtagtaaccaacgagtacttacgggaagtgacgaatacggaacggtaaaggaggaccttagtacgttactttttagaattacgtaccggtcggggacccgaagggtaccaggttacggg

SEQ ID NO: 115016 - DNA, 657 bp, Homo sapiens
  misc_feature: GYAE6OF02JETDE.15.86.H09.1.454.CMB.1.raw
  modified_base (299)..(299): a, c, t, g, unknown or other
  misc_feature (299)..(299): n is a, c, g, or t
  modified_base (643)..(657): a, c, t, g, unknown or other
  misc_feature (643)..(657): n is a, c, g, or t
tcagtctacgtagccacgaccggtgctcgatttagtgctatagacttgggtttggggggggagaggagccccagccttgggatccccaagtgtttcattcagtgatcaggactgaacacagaggactcaccatggagttcggggctgagctgggttttccttgctgctatacttaaaaggtgtccagtgtgaagtgcaggtggtggagtcgtggggagccgttaggaaacgcgtggggtcctagagtctctgtgtgcctgtgatctacttcagtagtggctggatgaggttcgggtccncgaggcctccggagggagggctgggaggtggttggaacgtttacgaaaaagtaaaagtgagtggtacgaagaaaatgactaaggtcgactaccggtaaggaaacggtaacgtagttaaccactagtaccgaacgtaaaggagtaaacttaagtaacgaaaaaccggtacggttaagttaacgttagtaacgtaaagtagaacgtaacgaaccgtaaagtaaaaccggaacgaaccgaacgacgtaccgtaaccgtttaacgtaaccgtaacgtaacccgtaacgtaaacggtacgttacggtaaacgtacgtacgtaacgttaaccgggaacggttaaaacggnnnnnnnnnnnnnnn

SEQ ID NO: 115017 - DNA, 870 bp, Homo sapiens
  misc_feature: GYAE6OF02G4RGU.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaagtgtccagtgtgaagtgcaggtggtggagtcgtggggagtccgttggtaaagccgtgggggttcccttagagtcttcctggtgtggcctcgtggattcgtactttcaagttaagtggacttggatggtagttcgggtccccgtccgaggtccgtacccggaaggggtaagggggtcctaggggtacggttaggggggttacggttaaccggttttaaacgaaaaaaagggtttaaaaacttggtaaagttggggtaacgaaaacggtaaaaagttagaaaccgttaacgggtcgaaccggtaacccggttaagggaaaaacggtaacgtaactttacccgtaacccaactttaccgaacggaaacgtaagtaaacgtttaaaactaaccggaaaaaaacggttccggttaaggtttaactttacgaaacgtaaacgtacgtaaacctaaccggtaaccgtaacggaaaaacccggacgtaaaccgaaccgacccgtaacccgttaacttaccgtttaccgtaaccgttaacccgaacgttaaccggttaacgtttaacggaacgggtttacaccggtaacgttacgggtaaccggtaaaggtacgggttaacgttagttacggttcgttttaacggtagttacgggttccgtaaccgggggtacccggtaaacggtaccggttaaggttacccggg

SEQ ID NO: 115018 - DNA, 801 bp, Homo sapiens
  misc_feature: GYAE6OF02F5I8Z.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttcctgctgctatcttaaaaggtgtccagtgtgaagtgcgaggtggtggagtcgtgggggagccgttaggtaaagccgtgggggtcccttagagtctcctgtgtggcctcgtgtacttcactttcagttatggctggatgtaggttcgggtccgccgaggcctaccggaggggaaggggtcgtgggtaggtggggttaggtaccggtttaacgaaaaaggttaaaaagtgtaagtgggtagtaaagtaaaagtagacgtaacgggtgaccgtaaccggtaggtaaaaggaacgtaacgttaccaaccgtaactacgtaacaaaggtagaaactttaaagttaacccgaaaaaacggtacgggtttagttaacgtttttaggaaaccttaaaagtacgggtaaactaaccggtacccttaaacggggaaaaaacccgtgggtaaacccaaccggtacggtacccgttacgtttaaactttaaccgtaccggttaacccaacggtaacgtaagttaacggtaacggtacgtacgtaacgtaacccggtaaaggtaacgggtacgtaacgttaagttcgggttaattttaccggaagttttctacggggtaccggggtaccccgtaaagggtacccgaaggtttcggg

SEQ ID NO: 115019 - DNA, 847 bp, Homo sapiens
  misc_feature: GYAE6OF02FLCEX.15.86.H09.1.454.CMB.1.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtggggagccttggtaagccgtgggggtccctagngtctcctgtgtggcctntggtatctactttnagtaatcggctaggatggtacggttcgggtccccgccgtagggtcccgtacccggtagggggaacgggggtcggttaggggacgggtttgggggtttacgggtaaccggttttaaccggtaaaaaaggttaaaaacgtagggtaagtttaggggtaacggtaaaaggtaaaaacgttaaggtaaccggttaaccgggttacggtacccggtaaacccggttaaaggggtaaaacgggtaaacgtaaccgtttaccaacccgttaactaccggtaacgtaaacggtaagtaaacttaaacgtttaaaccgaaaaaaccggttcgggtttaaggttaaagttttcggaaaccttaaagttacggaaacgtagtaaccccgtaaggaaaacccggtaggaacctaaccgacgtacccgttaacttaacgttaaccgtaccgttaacccgtagtaaacgtacgttaacgggatcggaccgtagtaccggtaacgaacggtacggtataccgttggtaccgttttgaacgtttacggttccgggtacccgggtaccggtacgtaccgttaggtccgggg

SEQ ID NO: 115020 - DNA, 666 bp, Homo sapiens
  misc_feature: GYAE6OF02JKBI5.15.86.H09.1.454.CMB.1.raw
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (344)..(344): a, c, t, g, unknown or other
  misc_feature (344)..(344): n is a, c, g, or t
  modified_base (578)..(578): a, c, t, g, unknown or other
  misc_feature (578)..(578): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaggtgtccagtgtgagtgcaggtggtggagtcgtgggggagccttggtaagccgtgggggtcccttagcggtctccgtgtgtggcctgtggattctacttnagtagtggctaggntgaggttgggtcgccgaggctccgagggaggcgtaggagtgggtggtacgttanaaagtaatgtataggtgaagtaagtacgacgtacggtcggaccgtaccggaggaaaaggtaacgattaccgactactacgtaccgaagaagtaactaacttaacgaaaaccggtacggttagttaattacggaactaaagtacgacgaagaccgttaacggaaaaccgtaagaccgacgtaaccgactcgttaataccgtacgtaccacgttaagtacgtagtaacgtcgaacncgtaccgtaaggagtacggtaatacgtacgtacttagtaacggttcgttacgggtaccggaccggtaagggtacctaaggttaccggg

SEQ ID NO: 115021 - DNA, 644 bp, Homo sapiens
  misc_feature: GYAE6OF02GV7NZ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcgaggtggtggagtcgtgggggagccgttggtaaagccgtgggggtcccttagagtctcctgtgtcggtcctctggattctactttcagtaatggctggtatggtaggttcgggtcccgccagggcctccgaggggaacgggcgtgggtaggtgggttggtacgtttacgaaaagtaaaagtgagtaggtagaagaaaagtagacgtacggtgaccgtaaccggtagaaaaggaagtaacttcactatctacaagagtaataactaacgaaaacgtggtagttaagtttagactaaagacgaacaacgccgtaagaaaaccgagaacgaaccacgtccgtactacttactacgtaacccagaatacgtacgagtagctaagtcgaacggtaaggacggtactagtacgttcttagtacgtagtccgtgggacccgtagggtactaggttcgg

SEQ ID NO: 115022 - DNA, 707 bp, Homo sapiens
  misc_feature: GYAE6OF02HKGII.15.86.H09.1.454.CMB.1.raw
  modified_base (436)..(436): a, c, t, g, unknown or other
  misc_feature (436)..(436): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagtccgttagggtaaaggccggttggggggttccccttaggtacgtcctccgtggtggtcggtcctcgtggacttctacttttcagtaatggctggatggaggttcgggtccgccgaggcctaccggaggggaacggggctgggaggttggggttaggtaacgtttaacgaaaaaggtaaaaagtggtaagtggtaagaaagaaaagtgaacgtacggngaccgaaccgtaaggaaaaggaagtacttacaaccgaatctaacgaaagtagtaactaaataaccgaaaaacggtcggttaacgttaatttacgaataaagtagaaacaggtaccgtaagaaaaccgagaaccacgacgtaccgtacttaactaccgtacgtaaccacgtagtagttacggaagtcgacgagtacgaacggtaaagggacgtactagttacgtcgttttaagacttacggtcggtccgggaaccggacggtataggttcgg

SEQ ID NO: 115023 - DNA, 752 bp, Homo sapiens
  misc_feature: GYAE6OF02HPHDE.15.86.H09.1.454.CMB.1.raw
  modified_base (585)..(585): a, c, t, g, unknown or other
  misc_feature (585)..(585): n is a, c, g, or t
  modified_base (623)..(623): a, c, t, g, unknown or other
  misc_feature (623)..(623): n is a, c, g, or t
  modified_base (672)..(672): a, c, t, g, unknown or other
  misc_feature (672)..(672): n is a, c, g, or t
tcagtctacgtagccacgaccggtgctcgatttagtgctatagacttgggtttgggggagaggagccccagccttgggatccccaagtgttttcattcagtgatcaggactgaacacaagaggactcaccatggagttcgggctgagctgggttttccttgctgctatacttaaaaggtgtaccagtgtgaagtgctagggtggtggaggtcgtagggggtagtccgttagggtaaacggtccggttgggggtaccccttaggacgtccttccgtggtgtcggccttcgtggattactactttactaggtaagtggtctggtagtggtaggttcgggtccgtccgaggtcctaccggagggggaaggggccgtggtacgggtgggttaggtaccgtttaagaaaaaggtaaagtgtagtaggtagaaacgtaaagtacgacgtaacggtcgaccgtaaccggtaaggaaaggtaacgtactaccactattaccgactaagataaattaacgtaaacgaaaaacggttggtttattaatttacgaaactaaagtacgaaactacgaaccgtaaacggaaaacccgngaactaccgtaggtacctacgttataacgtaccgaacncgtaagtacttacgggaaatcgaacgtacgtacggtaaacggtaacggngtacgttacgttacgttagttttaacgagtttaccggtcggggaccggtaacccgtaaggggtacccagggtttcccggg

SEQ ID NO: 115024 - DNA, 841 bp, Homo sapiens
  misc_feature: GYAE6OF02FHAQ7.15.86.H09.1.454.CMB.1.raw
  modified_base (216)..(216): a, c, t, g, unknown or other
  misc_feature (216)..(216): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtcagtgtgaagtgcaggtggtggagtcgtgggggganccgttgggtaaacgccgtggggggtcccttaggagtctcctgtgtggcctctggattcactttcaagtatggctggatgtaggttcgggtccgccgaggtccgtacgaggggaaggggcgtgggaggttggggttaggtacgtttacgaaaaagttaaaaagtggtaatagggtagaaaggtaaaataggaactaacggtgacccgtaacccggtaaggaaaacggaaggtaaattccgaaacctattaccgtaacgaaacggtaagtaaacttaaacgttaaacgaaaaaaaccggtcggggttttaactttaaacgttttacggaaaacttaaaagtacggtaaaacccgtaacgggtaaacccttaaaggggaaaaacccggtaacgggaaaccctaacccggtaacggtacccccggttttaactaaaccgttttaaccgaccggttaaaccccacgtaaaaggttaccgtttaaccgggaaaaggtcgtaactaagttaacccgggaacgttaaaacggggaggttaacgttactttacggttaccttttttaggaacgtttacgtcccggggtttaagggggacccccggtaaagggttaccgtaacggtttccggggg

SEQ ID NO: 115025 - DNA, 670 bp, Homo sapiens
  misc_feature: GYAE6OF02GGSNS.15.86.H09.1.454.CMB.1.raw
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaagccgtgggggtccttagagtctctgtgtggcctcgtgattctactttcagtaatggctggatgtagttgggtccnccgaggctccgagggaacggggcgtgggnggtgggttacggtacggtttaacgaaaaggttaaaanggtagtaggtagaagtaaagtaagacgtaacggtgaccgaacccggtaggaaaaggataactacaactatacgtacaagagtaattaaactaacgaaaaacggtacggttagttaatttggaactaaagtacgaacgtaccgaccttaaagggaaaacgacggaacacgtaacgccttactaacttactacgttaacccataagttacgttacggaagttacgataagttacgaacgggtaagacggtacttagtcgttcgtttatacgtagttaccggcgggtacccggaggtactagttcgg

SEQ ID NO: 115026 - DNA, 813 bp, Homo sapiens
  misc_feature: GYAE6OF02HCWI8.15.86.H09.1.454.CMB.1.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (720)..(720): a, c, t, g, unknown or other
  misc_feature (720)..(720): n is a, c, g, or t
tcagtctacgtagccacgaccggtgctcgatttagtgctatagacttgggtttggggggaagaggaagactgacggtcccccaggagttcgggctgagctgggtttccttgctgctatcttaaaaggtgtccagtgtgaagtgcaggtggtggagtcgtgggggagccttggtaaagccgtggggggtcccttagagtctcctgtgtggcctcgtggattcactttcagtaatggctggatggagttgggtccgccaggctccgagggagggctggagtgggtgacgttanaaaagtaaaatgagtggtanaagtaaaatacgacgtaagggtcgaccgtaacccggtaggaaaacggaagtaacttaccgaaccctatacctacgaaagtaacgaattaaacgttaaaccgaaaaaacggtcggttaggttaactttaggaacctaaaagtacggaaactacggacccttaaagggaaaaaacccggagggaaaccctacgaaccggtacccgtttacgttaaacgtttaccgttaaggtaacccctaaacgacgggtttaacgttaccggggtaaagttacgggaacctacggttaaccggggaaaccgttaaaagggggacgggttacctaagtttaacgttcgttttagaatttacggttccggtacggggaccctaaggggactaaggttcgggttaccgtcgtacttcgttacncgtccctaccgaaccgtaccggtacccgagttttcccccggtaccgtttccccccggacgggtccccacccgttacccgacggtactacccgg

SEQ ID NO: 115027 - DNA, 786 bp, Homo sapiens
  misc_feature: GYAE6OF02GEFAF.15.86.H09.1.454.CMB.1.raw
  modified_base (596)..(596): a, c, t, g, unknown or other
  misc_feature (596)..(596): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgttgggttttccttgctgctatacttaaaaggtgtcagtgtgaagtgcaggtggtggagtcgtggggagccgttaggtaaagccgtgggggtcccttagagtctcctgtgtcggcctgtggattctactttcagtaatggcgtggatggtaggttcgggtcccgccgaggcctaccggaagggggaacggggtcgtaggggtaggttcgggggttacggtaaccggttttaaacgaaaaaaaggttaaaaaagttggtaaaggtagggtaagaaaacggtaaaaaattaggaaccgttaacgggtacgaccgaacccggtaaggaaaaacggaagtaacgttaccaacgtactacaacgaaagaagaattaaacgttaacgaaaaaacggtcggttaagttaagtttagaactaaaatacggaaacacgtaccgtaaggaaaaaccgnggtaaaccaacgacgtacccgtacttaacttaacgtacgtaaccaacgaagttaacgttaaccgggaaaagttcgaaaccgtaagttaccgggtaaacggtaaagggtaccggttacgttaacgtttcggttacgtttttagaactttacggtaccggtccggggaacccgagggtaacctagttacggg

SEQ ID NO: 115028 - DNA, 640 bp, Homo sapiens
  misc_feature: GYAE6OF02GJZMB.15.86.H09.1.454.CMB.1.raw
  modified_base (399)..(399): a, c, t, g, unknown or other
  misc_feature (399)..(399): n is a, c, g, or t
  modified_base (475)..(475): a, c, t, g, unknown or other
  misc_feature (475)..(475): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagcctttgggtaaaagtccgtgggggtcccttagagtctcctgtgtggcctctggattcactttcagtaatggctggatgagttggtccgctaggcctcgagggaagggcgtggagtgggttggacgtttcgaaaagtaaaatgatggtagagaaaatgacgtaggtgacaccgtagaaagganattcacatctacagatataatacaaaagtcggtattattgacaaatacggaacacggacctaacggaaaacccggnggaaaccacgtaagccggtacttaagttacgtaggtacccaatagtaactttacgggaaacttcggaacaagttccggaaagttaagggtacgcgttaagttaggtacctttttaggaatttaacgtccgggtacgggggtcccaacgggtacaaggtttccggg

SEQ ID NO: 115029 - DNA, 708 bp, Homo sapiens
  misc_feature: GYAE6OF02GOUII.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtggggggttcccttaggacgtctccgtgtcggtcggtcctctggtattcgtacctttcgaagtaatggctggatggtagttgggtacccaccgaggtctccggaaggggaacggggcgtagggaggttggggttagtaacgtttacgaaaaaaggtaaaatgaagtaggtagaaagtaaaatagaacgtaggtagcgaaccggtagaaaagggaatacgttacaacctagtactacgaaagagtaaataaagtaacgaaaaaacgtcgggttaagtagtttagaactaaagtagaaacacgtactaacggaaaaccgacgtaacacacgaccttataacttacgactaaccagtaatacggttacgtaacgtacacgtaagtacggtaacggaaagtacggtataacggtgttacgttttagaacgttacggtcggtaccggggtaacccgtaagggtaaccgtaggttaccggg

SEQ ID NO: 115030 - DNA, 623 bp, Homo sapiens
  misc_feature: GYAE6OF02HN4L2.15.86.H09.1.454.CMB.1.raw
  modified_base (168)..(168): a, c, t, g, unknown or other
  misc_feature (168)..(168): n is a, c, g, or t
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
  modified_base (338)..(338): a, c, t, g, unknown or other
  misc_feature (338)..(338): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (518)..(518): a, c, t, g, unknown or other
  misc_feature (518)..(518): n is a, c, g, or t
tcagtctacgtagccacgaccggtgctcgatttagtgctatagacttgggtttgggggagaggagcccagcttggatcccagtgtttcattcagtgatcaggactgaacacagaggactcaccatggagttcgggctgagctggtttcctgctgctatactaaaggtntcagtgtagaagtgcgaggtggtggngtcgtgggggancttaggaagccgtgggggtccttaggctctctgngtggcctagtgattcatttcagtatgctgatgagttggccgtancgtacgcgaagggacggtctggacggtggttaggtactttacgaaaaggtaaanggagtcggtagaataaaacgtgtacgttacggngtacctaaccggagaaacgggttanaagttaccaaccgtaatctaacgaagatataacgttaacaaaacgtggattattagaacgtatacggacacgtacaacgtaaagganaacacgttancggtattagttaaacgcgttaaccngtaagaacggtacgtacggcacgtaattcggaacggtaagtggaacgttgtacctacggttttacagtttacgtcggaaccgggccgtaaggccggtaataccgg

SEQ ID NO: 115031 - DNA, 814 bp, Homo sapiens
  misc_feature: GYAE6OF02IONZZ.15.86.H09.1.454.CMB.1.raw
  modified_base (703)..(703): a, c, t, g, unknown or other
  misc_feature (703)..(703): n is a, c, g, or t
tcagtctacgtagccacgaccggtgctcgatttagtgctatagacttggggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtgggtggaggtcgtgggggagtccgttaggtaaagccgtgggggttccttagagtctctgtgtggcctgtggtattctacttcaagtaagtggctggagtggtaggttcgggtccgccgacggccgtacggaaggggacgggtacgtggggtagggttggggttaacggttaaccgtttaaacggtaaaaaaacggttaaaaagtggtaaggttagggtaaggtaaaaggtaaaaacgtaacggtaacggttaacggtcgtaaccggtaacccgggtaaaggaaaacgggtaaactacgttaaccaaaccttaagtaccgtaaacgaaacggtaaataacgttaaacttaaacgtaaaaaacggtacggttagtttaagttacgtaaacgtaaaagtacgaaacgtaacgtaaccgtaaacggaaaaccggacgaaaccgaacgtaacgtaccgtaacttacgttaacgtacgtaacctaacgtaagtagtacgtaacgtnacgtaacgtaacggaacggttaacgggacgttagtaacggttcgttacgtttaagtaaccgttacggtaccgggtaccgggaaccggtaacgggtacgtacggttaccggg

SEQ ID NO: 115032 - DNA, 687 bp, Homo sapiens
  misc_feature: GYAE6OF02JAUSD.15.86.H09.1.454.CMB.1.raw
  modified_base (189)..(189): a, c, t, g, unknown or other
  misc_feature (189)..(189): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
  modified_base (532)..(532): a, c, t, g, unknown or other
  misc_feature (532)..(532): n is a, c, g, or t
  modified_base (614)..(614): a, c, t, g, unknown or other
  misc_feature (614)..(614): n is a, c, g, or t
  modified_base (651)..(651): a, c, t, g, unknown or other
  misc_feature (651)..(651): n is a, c, g, or t
  modified_base (659)..(659): a, c, t, g, unknown or other
  misc_feature (659)..(659): n is a, c, g, or t
tcagtctacgtagccacgaccggtgctcgatttagtgctatagacttgggtttggggggagaggagccccagccttgggatcccaagtgttttcattcagtgatcaggactgaacacagaggactcaccatggagttcgggctgagctggttttcctgctgctatcttaaaggtctcagtgtgaagtgnaggtggtggagtcgtggggagcttggtaagcgtgggggtcctagcgtctcgtgtgtgctctaggtattcattcagtatggctgntagnggttcggccncgtacggcgtaccggagggaaggggtcgtagggtaggttcgggttaggtaacgtttaacgtaaaaaagttaaaagttggtaagttagggtagtaaaacgtaaaagtaggtaacgtacggtacgacgtaacccggtaaggaaaaacgggtaactacgttaccaaccgttaanaacccggttaanaagtaaataacgtaaattaacccggaaaacggtagtttacgtaatttacggaaactaagtanaaccgagtacgaaaggaaaaccggtgaaactacgcgtaacgtacctaagttaccctagaacctaagacgttagtaacggtancgtacagaccgtaagaagagttcaagttctaagtttnaagttacngggtaccgaccggaagtagtacgtcggg

SEQ ID NO: 115033 - DNA, 874 bp, Homo sapiens
  misc_feature: GYAE6OF02FO27R.15.86.H09.1.454.CMB.1.raw
  modified_base (248)..(248): a, c, t, g, unknown or other
  misc_feature (248)..(248): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgcgtgcttatacttaaaaggtgtccagtgtgaagtgcaggtggtggagtcgtggggagcttggtaagccgtgggggtcccttagngtctcctgtgtggctntggtattcacttcagtaagtggtcgtggntgaggttcgggtccgccgaggccgtccgaggggaagggggtctgggtaggttggggttacggtaacggttttaaacgtaaaaaaaggttaaaaaattgggtaaggttagggtaaggtaaaagtaaaaaacgttaacgggtaaaccggttaccgggtacggtacccggtaaaccccgggtaaagggaaaaagggtaaacggtaaacgtttaaccgaacccgtaagtaccgttaacgaaaggtaacggtaaacttaaaacttaaaccgtaaaaaaccgggtaccgggtttaaggttttaaacgtttaaggaaacgtaaaaacgttaacggaaaccgtaacggtaaacccgttaaaccgggtaaaaacccggaccggtaaacccgtaaccgaaccgtacccggtttaaccttaacgtttaaccgtaaccgttaacccgtaacgtaacggttaacgttaacgggtaaacgtccgtaacgtaaccgtaaccggtaaccggtaaaggtaccggtacttaacgttagttaccgttttagaacgtttacgtccgggtaccgggtacccgacgggtaccgtagttccggg

SEQ ID NO: 115034 - DNA, 1004 bp, Homo sapiens
  misc_feature: GYAE6OF02IK3BO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaaggtgtccagtgtgagtgcgagggtggtggagtcgtgggggacgtccgtttaggtaaacgtccggttggggggtacccttaggagttcctccgttggtggtcggtcccttcgtggtacttcctacgtttacgtaaggtaacgtcggctagggagtgggtacggtttcggggcccgtcgacgggcctaccgggtaacggggagggggtccgtaggggtggttgggggttacggtaaccgtttaaagaaaaaaggttaaaaagtcggtaaaggttgggtaaacggaaagtaaaaacggttacggtaaaccggttaaccgggtacggtaccccgtaaacccgggttaaagggaaaaacgggtaaacgttcgtttaaaccctaaaccggtaacttaaaccggtaacgtaaaaacgggacgtttaaaacgtttaaaaccggtttaaaacccgggtaaaaaaacgggttaccggggtttaagttttaacggtttaaagggtaaccgttaaaaaaccgtaggtaaaaaccggtaacccgtaaacccggttaaaacggaaaaaccccgggtaggaaaacccgtacccgaaccgggtttcccgtaactttaaagtttacccgttaacgtaaccccgtaaagtacgggtaacgtttaaccgggggaacgtacggttaacgtaaaccgttaacgggggttaaaccgtaaaaggggtaccggttaacgtttaagttaccggtttttaacggtttcggtaaaccgtttttcccggggacggggtttaaacccggggcccccgggttaaaaggggttaacccgtaaggggtttccccgggg

SEQ ID NO: 115035 - DNA, 693 bp, Homo sapiens
  misc_feature: GYAE6OF02FJY1I.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatctaaaaggtgtccagtgtgaagtgacaggtggtggagtcgtggggggagcctttgggtaaacgccgtgggggggtccccttaggagtcttacctggtgtggcctcgtggtattcacttttcagttaatgggctggatggtaggttgggtccgccaggcctccgagggaacgggctggagttgggttgacgtttacaaaaaggtaaaactgagtggtagtagtaaaactagtacgtacgggtacgcgaacccggttggaaaacggaacggtattaccgaacctaatccttacgaaagaggtaattaaacttacgaaaaacggtcggtttaagttattttaggaccaaaagtcgaaactacgactacggaaaaccgaggaacacagtcgtacttagttacctacgtaccactagtaacgtttacggaattcgtacagtaccggacgttaaaggcggtactaggttaccgtcgttttaagagtacggttccggtaggggaccccgtaagggtacgtaagtttccgggg

SEQ ID NO: 115036 - DNA, 627 bp, Homo sapiens
  misc_feature: GYAE6OF02HPN6A.15.86.H09.1.454.CMB.1.raw
  modified_base (485)..(485): a, c, t, g, unknown or other
  misc_feature (485)..(485): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgaggttgggtccgccaggctccgagggaggggcgtggaggtggggttggacgtttacgaaaagtaaaagtgagtggtgaagaaagtagacgtacggtgcaccgtagaaaggaagtatacacctatctacaagagataaatacgaaaaacgtcggtatagtttgacaaatgaaacagacctaacggaaaaccgngggaaccaacgacgcctactacgttactaggtaacccacgagtacgttacggaagttcacacgtacgaaggtaaacggaggacttagtcgttacgtttgaattagtccggtacggggacccgtagggtaacctagttccggg

SEQ ID NO: 115037 - DNA, 898 bp, Homo sapiens
  misc_feature: GYAE6OF02IU8FY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatacgttaaaaggtgtccagtgtagtaagtcgagaggtggtggacgtcgtgggggacgtcgttagggtaaacgccgtcgggggtccttaggtacgtcctccgtgtggtcggccgttcgtggtatttctacttcgaaggttaacgtggacgtggtagttcggtacgggttcgggtacccggccgtaacggtccgtcccgggaaaggggtaacgggggtcggtggggtaagggttacggggttcggtaaccggtttaaacggaaaaaacggttaaaaagtcggtaagttacgggtaaggaaacgtaaaagtacggtaaacgttaaacggtccggtaaccggaacccggttaaagggaaaaacggtaacgtaacgttaccgtaacctaactaccgtacggaaagtaagtaactaaagtttaaaccgaaaacgttacggtaagttaacgtacgtaacgtaaaagtacaaacgtaccggaacttaacggaaaaccgacgggtaaacccgaacggtacgttaaccggttaccgtaaagtttaccgacggttaaaaccccgtagtaacccgggttaagttaaccgggttaaaccggagttaacccgtaaacggggttaaccgggaaacgttaaaacggggccgttaaccggttaaccgttcgtttaacggtttaacgatttacgggtaaccggttcgggggtaaaccccctagggtaaacccggtgttttaaccggggg

SEQ ID NO: 115038 - DNA, 726 bp, Homo sapiens
  misc_feature: GYAE6OF02J19QE.15.86.H09.1.454.CMB.1.raw
  modified_base (550)..(550): a, c, t, g, unknown or other
  misc_feature (550)..(550): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtcggagtctgggggagccgttgggtaaagccgtgggggtcccttaggagtctcctgtgtggcctactggattcactttcagtaatggctaggatggagttgggtccgccaggcctcgagggaaggggtcgtggagtgggtggtacggtttaccaaaaggtaaaatgaagtggtagaagtaaaagtagacgtaacggtgacacccggttagaaaggagtagtacaacccgtataccgtaacaacggagtaagtaatttaaccgaaaaacggtacggttagtaacgtttaggactaaagttacggaacacggtaccgtaaggaaaaccgagggtaaccacgacgtacccggtnttaacgttaccgtaggtaccccaagtaacgggaacgttacgggaaccgttaggaccttagtaccggaacggttaaacgggacgggttaccttaaggtcggttaaccgtttttagaacgttttacggtacccgggtaccggggtacccctaaacggggtacctaggtttacccgggg

SEQ ID NO: 115039 - DNA, 900 bp, Homo sapiens
  misc_feature: GYAE6OF02GH23S.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttaggtaaacgtccgtcggggggtacccttaggagtcctccgttggtggtcggccttcgtggtactttctactttcaagttaagtggcgtggatggtaggttcgggtccgccgaggcctccggaaggggaacggggcgtgggaggttggggttaggtaaccgtttaacgaaaaaagttaaaaatggtaagttagggtaagaaaggtaaaaagtaggtaaaccgtaacgggttacgaacccgaaacccggtaagggaaaaacgggtaaacgtaaacgtttaacccgaaaccgtaacgttaaccgtaacgaaaacggtaaagtaaaacttaaaaacgtttaaaccgaaaaaaaaccggggttcggtttaaggtttaaactttacgggaaaactaaaaagttaacgggaaaactaaccggtacccttaaaacggggaaaaaacccgaacgggaaacctaacccgaaccggttacccggttaattaaaccttttaacccgtaacggttaacccctaaacgtaggttaaaccggtttaacgggaaaacgttccggtaaccgtaacgttaaccggggtaaaacggtaaagggaacggtaccgttaagttcggtttaacgttttagaacgtttacgtcccgggtaaccggggtacccgaaaggggttaacctaggttacccggg

SEQ ID NO: 115040 - DNA, 789 bp, Homo sapiens
  misc_feature: GYAE6OF02F11SQ.15.86.H09.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (582)..(582): a, c, t, g, unknown or other
  misc_feature (582)..(582): n is a, c, g, or t
  modified_base (653)..(653): a, c, t, g, unknown or other
  misc_feature (653)..(653): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttgggctgagctgggttttccttgctgctatcttaaaaggtgtccagtgtgaagtgacgtggtggnggtagtggngggtcgtcgtaggtaacgtcgggtcgggttccgtagctctcgtggtgtcgtcctgtgtctacttctntagtagngtgaggtgtggttacggtcggtcccgacgtcggtaccgacggtaggggtacgggtcggtagggttagggttggggttacggttaacgttaaaacggttaaaaagtaagtaggtagttaggtaagtaaaagtaagtacgtacgtacggtcgtaccggaacggtaaaggaaagtaacgttacgtaaccgtaactacgtaccgtaagaaacggtagtaaacttaaagtaaaacccgaaaggttcggttagttagtacaacgtaaataacgaacgaccgtacgaaacgaacgggtaanaaccggcttaaaccggtcccttaaagttacccgtttaagacccgtacgaacgtaagttcgggttaaaacgnggtaacctacgtaaccgtaacgggtaaacgggtaacgggtcgttaacggtttcggttctttaagtttacggtccgttaacgggttcccgggggtaccgggtaccggtaaacgggtaccgttagggttaccccgggg

SEQ ID NO: 115041 - DNA, 886 bp, Homo sapiens
  misc_feature: GYAE6OF02FYW9V.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcggctgagctgggtttttccttgctgctatacttaaaaggtgtccagtgtgaagtgcaggtggtggagtcgtgggggacgtccgttggtaaacgccggtgggggttccccgttagacgtcctccgtgtcgtcggcctcgtggtacttctactttactagtaacgtggtctgggtagtggtaggttccgggtccccggaccggacggccgtccggaagggggtaaggggtcgtagggtaggttggggttaggtaaccgtttaacgaaaaacgttaaaagtagtaagtagggtaagaaagtaaaacgtaacggtaaccgtacggtacgtacccgtaacccgggtaaggaaaacggtaaacgttaacgtacccgtaaccgtaacttacgtaactaaagtaacgtaacttaaacgttaaccgtaaaaaccggtacggtttagttaaacgtttacgaaaccgtaaagtacgtaaacccgtaacgtaacccgtaaacgggtaaaaacccgggacggtaaaccaaccggtaaccgtacccgtttaacgttaaacgtttaaccggtaacgttaaacccgtaacgtaacgtttaacggttaaccgggtaaaggttcgtaaccgtaacggttaacccggtaaacgggttaaacgggtaccggtaacgtttaacgttccgtttaaccgtttaagtaaccgttaaccggttcgggttacccggggtacccgtaaacgggtacgtaacggtttcccggg

SEQ ID NO: 115042 - DNA, 708 bp, Homo sapiens
  misc_feature: GYAE6OF02IPIZB.15.86.H09.1.454.CMB.1.raw
  modified_base (680)..(680): a, c, t, g, unknown or other
  misc_feature (680)..(680): n is a, c, g, or t
tcagtctacgtagccacgaccggtgctcgatttagtgctatagacttgggtttggggggagaggagtcccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaaacgtccggtcggggggttacccttaggacgttcgtccgtggttcggtggccctgttggacttcgtacttcagtatggtctggatggaggttcggtccgcgaggctcggaggggaggcgtggagtgggttagtacgtttaacgaaaagtaaagtgagtggaagaagaaatgtactaggtcgacaaccggtagaaaggtaacgtactacaaccgtaataccgtaacgaaagtaggtaaacttaagtaaaccgaaaaaccggtacggtttacgttaaagtttaggtaaacctaaaagtcgtaaaacgaccggtacgttaaaacggaaaacggtacggtaaacaaccgtaacggtacctacgtttaactaactaccggttaacccaagtaaggtcttaacggaaacgttgactagttaccgagaacggtacgacttgtagtctttacgaattcgngggtcccggacgtaacggactaggtcgg

SEQ ID NO: 115043 - DNA, 745 bp, Homo sapiens
  misc_feature: GYAE6OF02H2KTQ.15.86.H09.1.454.CMB.1.raw
  modified_base (414)..(414): a, c, t, g, unknown or other
  misc_feature (414)..(414): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtgggagtcgtgggggagccttgggtaaacgcccgtggggggtcccttaggacggttccttccgtggtggtcggcccttcgtggattcactttcagtaatggctggatggagttcgggtccgcgaggctcgagggaagggctggaggtgggttggacgttacaaaagtaaaatgatggtagagaaatagacgtacggtgcaccgtagaaaggaanattacacatcacaaagagtaataacttaacgaaaaaaccggcggttagttaacgtttagaactaaagtacgtaacacggtaccttaaaggaaaaacccgaggtaaccaacgtacggacctacgttaactttaaccgtacggtaacccaacgtaacgttacgtttaaccggggaaacgttcggtaccgtaagtaacccggtaacgggttaaacggggaacgggtaaccgttttaacgtacgggttttacgtttttacggtaagtttacggtttacccgggttaccggggggtacccccgtaaaggggtaaccgttaacgggtttacccgggg

SEQ ID NO: 115044 - DNA, 716 bp, Homo sapiens
  misc_feature: GYAE6OF02GVVP2.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttaggtaaagccgtgggggtcccttagagtctcctgtgtcgcctctggattctactttcagttaatggtctggatgtaggttgggtccgccgaggcctccggagggggaaggggcgtgggaggtgggttggtacgtttaacgaaaagtaaaagtgagtaggtagaagaaaagtacgacgtacggtcgaccgtaaccgtaggaaaaggaacgtattaccgaacctagttacctaacgaaagagtaacttaaacgttaacgaaaaaccggtacggttaagttaagtttacgaactaaagtacgaaactaacggaccgtaaggaaaaccggagaacacgacgtaccgtacttacttacgtacgtaaccactaaggtacgttacggaagtgaacgtacgtacggtacgtaagggaacggtacggtacttacggttagttaccgttttaggaactttacggttacccgggtaccgggggtaccgtacggggtaactaacggg

SEQ ID NO: 115045 - DNA, 744 bp, Homo sapiens
  misc_feature: GYAE6OF02I2DKZ.15.86.H09.1.454.CMB.1.raw
  modified_base (201)..(201): a, c, t, g, unknown or other
  misc_feature (201)..(201): n is a, c, g, or t
  modified_base (318)..(318): a, c, t, g, unknown or other
  misc_feature (318)..(318): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgtctattacttaaaaggtgtccgagttgtgaaagtgnacggttgggtggagtgtgggggtagtccgttaggtaaaacgccgtacggggggttcccttaggagttcctccgttgtgtcggacctcgtgattcactttctaagtaagtggactggnttaggagtttcgggtccgtccacggtctaccgagggagggccgtggagggttgggtggttaacgtttaagaaaacgttaaaagtgtaagtggtagtaaaggtaaagtaacgtacgtaacggtcgaccgacccgttaagggaaacggtaagacttccgtaaacacgtccctaaacgtaggtaaactagttaaactaaaccgtaaaaacggtcggttaacgttaacgtttcgtaaactaacgtaagaaacgtacgaaacccttacggaaaaacggtcgaaaccgtaacgaccgccgttaccttaacgtaccgtaccgttaaccaacgtaccgtaaggttacgaagtcgactagacggtacgtaaggacgtatagttacgttagtttagtaccgtagttccgtacgggtccgaacggactaggttccgg

SEQ ID NO: 115046 - DNA, 835 bp, Homo sapiens
  misc_feature: GYAE6OF02FHO9O.15.86.H09.1.454.CMB.1.raw
  modified_base (301)..(301): a, c, t, g, unknown or other
  misc_feature (301)..(301): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggttttcctgctgctatcttaaaaggtgtcctagtgtgaacgtgcaggtggtggagtcgtggggagtccttagggtaaacgtccgtcgggggttccccttaggtacgtccttccgtgttgtcgggcctactggacttctacttcgagtaacncggtctggatggtacggttcgggtccgccgaggcctaccagggggtaagggtcgtcggaaggttcgggttacggtacggtttaacgtaaaaagttaaaacgtgtaacgttagggtagtaaacgtaaaacgttacggaaccgttaccgggttacgtacccgtaaccgggttaacgggaaaaagggtaacgttaaacttacccgtaaaccgtaacttacccgtaacggtaaacggtaaacgtaaacttaaacgtttaaacccggaaaaaccggttaccgggtttaacgtttaaaccgttttacgaaacccgtaaaaacctacgggtaaaacccaccggtacccgttaaaccggaaaacccgtacgaaacgacccgacgttacccgtaccttaacgttacctaccgttaacgaacccgtaagttaaccgtttacggaacttcgactacgtaccgtaacggtaacggacggtacacgtttctacgtttagagttaaccgtcggtacccgggggacctaagggaccgtagttacccggg

SEQ ID NO: 115047 - DNA, 1062 bp, Homo sapiens
  misc_feature: GYAE6OF02HP6R7.15.86.H09.1.454.CMB.1.raw
  modified_base (743)..(743): a, c, t, g, unknown or other
  misc_feature (743)..(743): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtagaagtgcgaggtggtggagtcgtgggggagtccgttagggtaaacggccggttcggggggttcccttaggagttccttcccgttggtggtcggcccttcgttggtacttcctactttcgagttaagtggctgggattggtagtttcgggggtcccgccggtacgggtccttaccccggaaggggggaagggggtccgtggggtaacgggttgggggtttacgggtaaccggtttttaaccgaaaaaaaggtttaaaaagtggtaaggttagggttaacggaaaaggtaaaaattaggaaaccgtttaaacggggtcggtacccggtaaccccgggttaagggaaaaacggtaaacggtaacttacccggtaaccctaaacgttaccttaaccgaaaaggtaaacgtaaagttaaacggtttaaacctaaaaaaacccggggtcgggttttaaagggtttaattttaaaccggaccttaaaaaagtttacggaaacctaaagggttaccccgtaaaagggaaaaaaaccccggacggtaaccccgtaaaaccggnggttaaacccccggtttaaactttaaaccgttttaaaaccgttacccggggttaaaaccccctaaacgggtaaacggtttaccgggtttaaacccggggggaaagttaccggaacccggtttaaacgttaacccgggggttaaaaaacccgggtttaaaaacggggtccgggggttaaaacccttttagtttaacccggggttttcggttttttaaacgggtaaccgttttaaccggtttccgggggggttaacccgggggggtaacccccctttaaaacgggggggttaacccggtaaggtttttaccccgggggggg

SEQ ID NO: 115048 - DNA, 958 bp, Homo sapiens
  misc_feature: GYAE6OF02F0GXW.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctggttttccttgctgctatcttaaaaggtgtccagtgtgaagtgcaggtggtggagtcgtgggggagccgttggtaaacgccgtcgggggtccctttaggagtccttccgtgtggtggtccttcgtggtacttctacttttcgagttaagtggctggtatggtaggttcgggtcccgccgacgggtccgtcccggaagggggaagggggtcgtggggtacggttcggggttaggtaaccggtttaaacgaaaaaagggttaaaaatggtaagtgggtaacgaaagtaaaagtagaacgttacggtacgtaccgaaacccgggttaggaaaaagggtaacgtaacgtttaccgaaccctaagttacccgtaacgtaaaacggtaagtaaaagtttaaaccgtttaaaaccggaaaaaaaccgggtccggtttaaggttttaaacgttttaacggaaaaccgttaaaaaggttaaccggaaaaccgtaacggtaaccccgttaaaaaggggaaaaaacccccggtacggggaaaccccttaaaccgggaaccggttaaccccgtttaacgtttaaaccgttaaccggttaaccggtaaacccctaaacggttaacggttaaaccgggttttaccggaaaaccggttcggtaccttaaaccgggttaacccgggtaaaggggtttaaaacgggacgggttaaccttaaggtttaccggtttccgttttttaaaggaccgttttaccggtaaccggggttaccgggggaacccccggttaaaggggtaacccgttacggggttttacccggg

SEQ ID NO: 115049 - DNA, 874 bp, Homo sapiens
  misc_feature: GYAE6OF02HZWY8.15.86.H09.1.454.CMB.1.raw
tcagtctacgtagccacgaccggtgctcgatttagtgctatagacttgggtttggggggggagaggagcccccagccttgggatccccaagtgttttcattcagtgatcaggactgaacacagaggactcaccatggagttcgggctgagcttgggttttccttgctgctatacttaaaaggtgtccagtgtgaagtgcgtaggtggtggagtcggtgggggacgtaccgtttgggtaaacgtcccggttcggggggttaccctttaggtacggttccttccgttggtggttcggtccctcgtggtattcctactttacgaagttaacgttcggcgtggagttggtaggttcgggtcccgtaccgtacggtaccgttaccgggaagggggtaacggggtcgttacggggtacgggttaggggtttacggtaaccggtttttaaccgaaaaaaggtttaaaaacgtgggtaagttagggtaagtaaaggtaaaagttacggtaacggttaacggtccgtaacccgtaacccggtaaaggaaaacgggtaacgtaacgttaccgaaaccgttaacgtacccgttaagtaaacggtaacgtaaacgttaaaacgttttaaaaccgggaaaaaacggttacgggttagtttaacgtttaacgaaacgttaaacgtaacgaaaccgtaacgtaaccgtaaaccggaaaaacggaccgtaactaaccgaaccggtacccgtaacttacgttaacccgtacgttaacccaggtaacgtacgttaccggaagttccgataaccgtaacgtaggaaggacgtaagttccgttagttacctttagacttacggtccggtacggtacccgaggtacctaaggtcg

SEQ ID NO: 115050 - DNA, 790 bp, Homo sapiens
  misc_feature: GYAE6OF02GWWJC.15.86.H09.1.454.CMB.1.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (516)..(516): a, c, t, g, unknown or other
  misc_feature (516)..(516): n is a, c, g, or t
  modified_base (734)..(734): a, c, t, g, unknown or other
  misc_feature (734)..(734): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggggctggagctgggttttccttgctgctatacttaaaaggtgtccagtgtgaagtgcgagggtggtggagtcgtgggggagccgttaggtaaagccgtgggggtcccttaggngtctcctgtgtggctcgtggattcgactttcgagtactggctgggattaggnggttcgggtccgccgacggcctccggaaggggaacggggcgtagggaggttggggttaggtaaccgtttagaaaaaagtaaaagttggtacgttgggtaagaaacggtaaaagtaggtaaccgttacgggtacgtaccggtaaccgtaagggaaaagggtaaacgtaacgtttacgaaaccccgtagttaccttaaccggaaaggtaanaaagtttaaaccggtaaaccgtaaaaaacgggtaccggttggtttaaatttaccgggaaactaaagtttacgggaaaaccttacggacccgttaaagaaaaccggaggaaccgttaaccacggtaccgtaccgttaatttaaaccgtcgttaaacccaagaggttaacggttacgaacggttaggcaacggtacgtaacggtaaaggtccgtaagttnttcggttaatttacgacttacggttcgggaccggtacccgaggtaattcggtacgg

SEQ ID NO: 115051 - DNA, 749 bp, Homo sapiens
  misc_feature: GYAE6OF02GNKD4.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaacgccgtgggggtcccttaggagtctccgtgtgtggcctctggattcactttcagtaatggctggatgagttggtccgcgaggctcgagggagggcgtggaggtgggtggtacgttacgaaaagtaaacgtgacgtaggtagaagaaagtacgacgtacggtgaccgtaccggtaggaaaacggtaagtacttacaccgtatacgtactaagtacgtaataacttaacgaaaaacggtcggttacgttaaagtttcgaaactaaagttaacgaaaccgtacgtaaccgtaagggtaaaaacccgagggtaaccgaactacggtacccggttaacttaaccgtttaacggtaccggtaaccctaacggtaaaggttacgttaacggggtaaacgtcggtaaccgtacgttaccggaacggttaaacgggtacggtaaccttaaggttaccgggttacgttttacggaacgtttaacggtccggttaccggggacccgtaagggtaccctaagggtttccccggg

SEQ ID NO: 115052 - DNA, 883 bp, Homo sapiens
  misc_feature: GYAE6OF02JD366.15.86.H09.1.454.CMB.1.raw
tcagtctacgtagccacgaccggtgctcgatttagtgctatagacttgggtttgggggggaggaggagccccagccttgggatccccaagtgttttcattcagtgatcaggactgaacacagaggactcaccatggagttcgggctgagctgggttttccttgctgctatacttaaaggtgtccagtgtgaagtgcgaggtggtggagtcgtgggggagtccgtttagggtaaaacggtccggtacggggggtccccgtttaaggacggttccgttccccgttggttggttcgggcccttacccgttgggtaatttcctaaccgttttccgtaaggttaaagttgggtccgtaggtagtaggtaggtttcgggggtccccgccgtagggccctcccgggaagggggaagggggtccgtaggggagggtttgggggttacgggttaaccggttttaacgtaaaaaaggttaaaaagtaggtaagttagggtaggtaaacggtaaaagtaacggtaaccgttaacggtacgaccggtaacccgggtaaggtaaaacgggaagtaacgttaccgtaacccgtaagttaccgtaccgaaaaggtacgtaacttaaacgttaaaccgaaaaaacccggtagggttaacgtttaagtttacggtaaacttaaaacgaaggtaaaccacggtaacccgttaaacggaaaaccggaccggtaaaccgaacgacccgtaccgttaacttaaccttaaaccgttaccggtaaccctacgaaaccgtaggtttaaccggaaggttacgaagtaccgtacgtaacgggtaaagggtacggtacttagttcgttacttagttatacgttcggaccggtcggaacggagtagtcggg

SEQ ID NO: 115053 - DNA, 967 bp, Homo sapiens
  misc_feature: GYAE6OF02HBO5U.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggaggtcgtggggggagtccgttagggtaaaacggtcccggttacgggggggttcccctttaaggtacggttccttccccgttggtcggttcggtcccttcgttgggtaactttccgtaccttttacgaggttaaatgggcctaggtactggtaggttcggggtcccgccgtacggccgtacccggagggggaaacgggggtccgtgggtaaggttgggggttacgggtacggttttaaccgaaaaaggttaaaaacgtaggagttagggtagaaagtaaaaagtagaacgtaacggtgaccgtacccggttagaaaacgggaacgtaacgttacaacccgtatacccgtaacgaaaggaagtaacgttaaactttaacccgaaaaaacggtaccgggtttaagttaagttttaacgaactaaaaagttacgaaaaccggtacggtaaccccgtaaacggtaaaaacccggaacgggaaaccgaaaccggaaccgttacccgggtttaactttaaaccgttttaaccgttaacccgtaaacccgaaacggttaacggttaacggttttaacccggggaaggtttaccggtaacccgtaaacggtttaacccgggaaaccgggtttaaaacgggggaacggttaacccgtttaaacggtttacgtttacccgggtttttaacgttaaccggtttaacgtttcccggggtaaccgggggttacccccgtaaacgggggttaaccttaaagggtttaccccgggggg

SEQ ID NO: 115054 - DNA, 599 bp, Homo sapiens
  misc_feature: GYAE6OF02INXUA.15.86.H09.1.454.CMB.1.raw
  modified_base (122)..(122): a, c, t, g, unknown or other
  misc_feature (122)..(122): n is a, c, g, or t
  modified_base (216)..(216): a, c, t, g, unknown or other
  misc_feature (216)..(216): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (438)..(438): a, c, t, g, unknown or other
  misc_feature (438)..(438): n is a, c, g, or t
tcagtctacgtagccacgaccggtgctcgatttagtgctatagacttgggtttgggggggggagaggacgccccagccttgggatccccaagttgttttcattcagtgatcaggactgaacncagaggactcaccatggacgttcgggctgcgcgtggtttcctgcgtgctatagtaaggtcgctgtgtgagtcgcgtggtggaggctcgtggggntcgttagaacgcgtcggggtccttagcgtctcgagtgtcgcctgagtatctacgttagtancggtangtntagcgtgaccncgtgctgaaggtgcgnaggcgtgtacttaanaaagaatgagtagtcgaanaaacgttgacgagtccgctaacgagtaaaccgganaaccgtnacctgtacagaagatactaagaaagaacgtcggtagtatacaaagtaanacgaacgacgtaacgaacgaacgaacgaacacgacgtacctactactaacgtacgtacgtacgtaagtacgtacgacgtacgaacgtacgtacgtacgagtacgtacgtactagtagttagtagtacggtaccggtacggacggacggtacgtacggtcgg

SEQ ID NO: 115055 - DNA, 789 bp, Homo sapiens
  misc_feature: GYAE6OF02IAW80.15.86.H09.1.454.CMB.1.raw
  modified_base (135)..(135): a, c, t, g, unknown or other
  misc_feature (135)..(135): n is a, c, g, or t
  modified_base (143)..(143): a, c, t, g, unknown or other
  misc_feature (143)..(143): n is a, c, g, or t
  modified_base (234)..(234): a, c, t, g, unknown or other
  misc_feature (234)..(234): n is a, c, g, or t
  modified_base (463)..(463): a, c, t, g, unknown or other
  misc_feature (463)..(463): n is a, c, g, or t
  modified_base (772)..(772): a, c, t, g, unknown or other
  misc_feature (772)..(772): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttnattttccncacaggtctctgtgctctgcctgtgcctgactcaccgcccccgtttgactatctcgtccttgcgtgggactcctcgactcgaagtcccacnctacgacctaaacgtagtagtcgacactaaccgtaaccgtaccaccgtaactacgtaacgtacggttacgtaacaacgtaagaacggaaccgtaccggtaaaccgggtaacccctaccgtaaagttaacttaaaaggttaacgttaaaaggtaaacggtagtacggtagtacggtacaccgaacgtaaccgaaccggaaacgggggaacggtaccctaaccggttaccncggttaccgttacgaacggttaccggtcggttaacccgtccgtttaagggtcccgggtaccgtaccgtaaccgtccccgttaaccgtaacccacccgtacctaaccgtttaaccccgaaccttaacccgtcggtaagtacctagggttaccgaggttacgcgtagttaacggtacctaccggtgtagtaacggaacgcggtaaccgtaaccaggtaaaccgttgtaggtacgtccggtaaacgtacgggtaggggttacggttcggttaagccgggtaacgacggcgtacgacggtacccgtagttacncccggggtataacccgg

SEQ ID NO: 115056 - DNA, 752 bp, Homo sapiens
  misc_feature: GYAE6OF02F1I0P.15.86.H09.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
tcagtctacgtagccacgaccggtgctcgatttagtgctatagacttgggtttggggggggagaggagccccagccttgggatccccaagtgtttttcattcagtgatcaggactgaacacagaggactcaccatggagttcgggctgagcgtggttttccttgacgtgctatacttaaaaggtgtccagtgtgaagtgcgaggtggtggngtcgtgggganccttaggtaagccgtgggggtcccttagatctctgtgtggccttgtggattctactttcagtaatggctggatgtgttgggtccgccgtaggcctcggaggggaacggggcgtggggtaggttggggttaggtacggtttaacgaaaaaggttaaaatggtaacgtggtagaaagtaaaagtacgacgttacggtgaccgaccggtaaggaaaaggaagtaacttacaaccgtatactagaaacgtaagtaattaaacttaaaccgaaaaacgtaccggttaagtttaacgtttacgaagtaaaagttacggaaaaccgtacggtaaccgttaaaccgggaaaaacccgtagggaaacccaacgaaacgttcccgtaacttactttaacgacggtacctaacgagttaacgtttacgggaagtcgtaactaacgtaccgtaaagggtaacggaaggtccttaaggttacgtttacgtttacgatttacggtacggtaccgggacccgtaagggtacgtaggtttaccggg

SEQ ID NO: 115057 - DNA, 643 bp, Homo sapiens
  misc_feature: GYAE6OF02GYCFE.15.86.H09.1.454.CMB.1.raw
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
  modified_base (339)..(339): a, c, t, g, unknown or other
  misc_feature (339)..(339): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtggggagcgttaggtaagccggtggggtcctagngtctctgtgtgcctgtgnttcacttcagtatgctgagtgaggttggccgcgaggctcggaggggagggcgtggtggtgggttggtaacgtttaanaaaagtaaagtgagtggtagaagaaatagacgtacggtcgacgaccgtaggaaaggacactaccgactactactagaagaataactaactaacgaaaacgtggtaagttattcgaataagtacgaacgacgtacgaaacggaaaccgagacacgacgtccgttacttactacgtacgtaccataggtacgttacgtagtcgaacacgtaacggtaacgtaaggacggttactacggttacttacggtttaagtacgttacggtcgggtaccggggtaacccggtagggtaactacgggttcggg

SEQ ID NO: 115058 - DNA, 804 bp, Homo sapiens
  misc_feature: GYAE6OF02JPUG2.15.86.H09.1.454.CMB.1.raw
  modified_base (261)..(261): a, c, t, g, unknown or other
  misc_feature (261)..(261): n is a, c, g, or t
  modified_base (783)..(783): a, c, t, g, unknown or other
  misc_feature (783)..(783): n is a, c, g, or t
  modified_base (791)..(791): a, c, t, g, unknown or other
  misc_feature (791)..(791): n is a, c, g, or t
tcagtctacgtagccacgaccggtgctcgatttagtgctatagacttgggtttgggggggagagggagccccagccttgggatccccaagtgttttcattcagtgatcaggactgaacacagaggactcaccatcggagttcggctagagtcgttggtttcctgctgcctatacgttaaaggtcgtcctagtgttagaacgtgtcgaggtggtcggagtcgtggggaatccgttaggaacgccggttaggggtccctaggngttacctccgttggtcggtcgccgtcttagggacttccgtactttaccgagttaacgcggtcgtacggtattcggtaggttccgggaccctcgaacggtccgttaacggaggggtaacgggtcgtacgggtgtacggggttaccgacgttaacgtaaaacgtaacgtgggaagttccggtaaggtaaagtaaagtacggtaccgtacgtaggaccgtaccggttagaaaccggtagacgtttacaaccgttctacgtaagacgtacgtaaagttacgtaccgtaaacgtaggtcttaagttacgaacgttaaacgacgtaacgtcgtaacgtacgtaaaccggtccgtaagaccgttcgggtaccctttaaggttaccctttaacccgggtaacgtaccgttaacgtaacggtaaccgtttccggtaaagtcccgtaaggttaacccgtagtaaccgggttaaggttaccgaacgttccgttaacggtacctttggaacggtccttcggggtaccgtaaccngggttacnccggtttaccggg

SEQ ID NO: 115059 - DNA, 837 bp, Homo sapiens
  misc_feature: GYAE6OF02F7N57.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcagggtggtggagtcgtggggggagtccttgggtaaagccgtgggggtcccttaggagtctcctgtgtggcctcgtggattctactttcagtagtggctaggtatggtaggttcgggtcccgaccgtaggtccgtaccggaagggggtaaacggggggtccgtaggggtacgggtttggggtttacgggttaaaccggttttaacgtaaaaaaaggttaaaacgttggtaacggttgggttaaggaaaaggtaaaaacgttaggaaccggttacggttacgaccgtaaccgggtaaggaaaaacgggaagtacgtttaccaaccgtaagttaccgtaacgaaaggtacgtaaacttaaacgttaaacgaaaaaacgggtcgtttaaaggtttaactttaagaaaccgtaaagtaacgaaaccgaacgtaccccgaaaggtaaaaacccggtacgaaaccctaacggaaccgtacccgttaacgtttaaacgttacgttaaccgtaacccgtaagtaacggtaacgtttacgggaatacggacctaagtaccggtaacggtaagggtacggtaattaggttacgttaccgtttagtaacgttacggttccggacggggtaccctaggggtacgttacgttacggg

SEQ ID NO: 115060 - DNA, 1011 bp, Homo sapiens
  misc_feature: GYAE6OF02H3F2H.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggtttttccttgctgctatacgttaaaaggtgtccagtgtgaagtgcaggtggtggagtcgtgggggagtccgttagggtaaacgccggttcggggggttcccttaggtacgttccttcccgttgttcggtcggtcccttcgtggtactttacctaccgttttaccgaaggtttaaagttcgggtccgttgggtaagttcggtaacgggtttcgggggttccccggtacccggtaacgggtcccgttaccgggaacggggggtaaacgggggtccgttagggggtaaggggtttcgggggtttacgggtaaaccggttttttaaaacgaaaaaaaacggtttaaaaaagttggtaaacggttagggtaaggtaaaaacggtaaaaacgttaaacggaacgttaaaccgggttaccggaacccggtaaaccggtaaggtaaaaacggggaaacgttaaccgtttaaccaccgtaaacgttacccgttaaccggaaaagaacggtttaaagtttaaaccgtttaaaaccgaaaaaaaccgggtaccgggtttaagtttttaaacgttttacggaaaactaaaagttaccggaaaaccgtaacccgggtaaacccgttaaaaccgggaaaaacccggtaagggtaaccctaaaccgtaacccgggttacccgttaaaccttttaaacggttaacccttaaccggtaaacccgtacgtaaacggttaacggtttaacggggtaaactcggtaaacgtaacgttaaccgggtaaacggtaacgggtagggtactttaacgttgttaacgttttacgaacgtttacggtcggtaccggggacccctaagggtaccgtaacgtcgg

SEQ ID NO: 115061 - DNA, 880 bp, Homo sapiens
  misc_feature: GYAE6OF02JN43D.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacttaaaaggtgtccagtggtgaagtgcgaggtggtggagtcgtgggggacgtccgttgggtaaagccggttcggggggtcccttaggacgtcctccgttgtggtcggcctcgtggtacttctacttttccgaaggttaatggtcgtggaagttggtaggtttcggggtcccgtccggacggccgttccggaagggggaacgggggtcgttagggtaggggtttgggggtttacgggtaaccgttttaaccgtaaaaaaggttaaaaagttgggtaagttagggtaggtaaaacgaaaaagttaggtaaccggttacgggtagacccgtaaacccgggtaaggtaaaacgggtaaacgtaagttccgaaacccgacttacgaaccgaaagtaacgtaaagttaacgttaaacccggaaaaaacggttacggttaacgtttaacgtttcggtaaaaccgaaagttaaaccggaaccgtaacggtaccccgtaaaggtaaaaacccgggaacgtaaaacccgtaaccgaacggttacccgtaacttaacgtttacgtaaccgttaacccgtacgtaacggtagtttaaaccgggtaactacggtaactaacgtacggacggtaaaacggtcggtaaccgttagttggttaacgtttcggtaaagttcgttaccgggtccggtaaccggtaacgggtacgtaagggttccgg

SEQ ID NO: 115062 - DNA, 670 bp, Homo sapiens
  misc_feature: GYAE6OF02HSTT3.15.86.H09.1.454.CMB.1.raw
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctcacaggtctctgtgctctgcctgtgctgactcacgcccccgtctgcatctgccttgctgggancctcgatcaagcctcacctgaccaccctaagtagtgagnactacgaacctacaccaatcgaatggtactacaacagacgaccgaagggaaccgtcccccgagtactaataaatagaaaagttaagaggtgagtggacagccaacgaaccggaaggggaccggactccccgaatcgtctgacgtcggctccgtagttcgtagggtcctacgaccgtacctacccgtaccaaccgtacttccctacccgtaacctccgtacgtctacggactagttcggaacggtctagtagtctaccgtagttgggtaggaagtaacgacgaaccctaacgaattaacgttagtacgttaccggaccggttaaagggttccgggttaggggttccggttaccggggtaccgggtaaccgggtaaccgtaacggcggttcccggtaacccggttacccggtagggtaccctaccggg

SEQ ID NO: 115063 - DNA, 893 bp, Homo sapiens
  misc_feature: GYAE6OF02IW2MW.15.86.H09.1.454.CMB.1.raw
  modified_base (141)..(141): a, c, t, g, unknown or other
  misc_feature (141)..(141): n is a, c, g, or t
  modified_base (314)..(314): a, c, t, g, unknown or other
  misc_feature (314)..(314): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggtagtcggntgagtcttggtttcctgtctgtctatacgttaaagtcgtctagtgtagtagtgacgtaggtggtgtagtcggtcggggagtccggttaggtaacgtccggtcggggtaccgttagacgttccgtcgtaggtgtcgtccgttacgtggtactacgttactttacgaagttaggnggtacgtgtagtgtacggttcggtaccgccgtaggtacgtaccggagggtaacgggtcgtagggtggttacggtaggttaaccgttaaaagaaaagtaaagtacgaggttagtaagaaacgtaaagtaacggtaacgtacgtacgaccgtaacgtaagtaaacggatagtaacgactagtaacgtacgaacgtaagtaacgttaaaacgtaacgtaaaaccggggtattaagttaacgtaacgttaaacgtaacgtaacgtaaacctcccggttaaaacgaaccgggaaaaccgttaaaccgaacgttaccggtaaaaccgttccgttaaaacccgttagttacgtaaaacccgtttaaccgaagtttaacccggaacgtttaacgggaaacgttaccgaaaccgttaacggggttaaccccgttaaaaggtaaccgggtaactttacggttaaacccgtttggggtttaaaaccccttttaaggtaaacgggttttacccggtaaaccccggggggtttccccgggtaaaaccggggtttaaacccgtttaaaccggggttacgtttaaccccggggg

SEQ ID NO: 115064 - DNA, 926 bp, Homo sapiens
  misc_feature: GYAE6OF02GDCME.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggttttccttgctgctatacgttaaaggtcgtccagtgtgaagtgcgaggtggtggagtcgtggggagtccgttaggtaaacgccggtcgggggttcccttagacgtcctccgtgtgtcggcctcgtggtacttctactttcgaagtaagtcggtcgtggtatggtacggttcgggtcccgccgacggcctacccggaagggggtaacggggtcgtaggggtacgggttggggttacggtaacggtttaacgaaaaaagttaaaaacgtggtaagttaggtaagaaagtaaaagtacgtaacgttacggtacgaccgtaaccggtaaggtaaaacggaacgtaacgttaaccaaccgtaacgttaccgtaacgaaagtaacgtaaacgttaaaccgttaaaaccggaaaaacgggttacggttaagtttaacgtttaacggaaacgtaaaacgtaacggtaaaccgtaaccggtaaacccgttaaacgggaaaaaacccggtacggtaaacccgtaaccgtaaccgttaccccgtttaactttaacgtttaacccgtaaccgttaacccgtaaacgtacggttaaccggttttaaccggggaaacgttcccggtaaaccgtaaaccgggttaaccggttaaacgggtaaacgggttaccggttaagttaaccggtttacggtttaccgtttttaagaaccggtttaccggtttaccgggggtaacccggggtaacccccggttaaaggggtaacccgttaagggtttccccgggg

SEQ ID NO: 115065 - DNA, 752 bp, Homo sapiens
  misc_feature: GYAE6OF02HMDS0.15.86.H09.1.454.CMB.1.raw
  modified_base (474)..(474): a, c, t, g, unknown or other
  misc_feature (474)..(474): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaacgtccgtgggggtcccttagagttctcctgtgtggcctctggtattctactttcagtaatggctggagtgaggttcgggtccgccgaggcctaccggaggggaaggggtcgtgggtggttggggttacggtacgtttaacgaaaaagttaaaatcgtagtgggtagaagtaaaagtaggtaacgtacggtagaccgtaaccggtagaaaaggtaacgtagtaccactaactcctacgaaganaattaaacgtaaacgaaaacggtcggtagttaacgttagaactaaaagtcgaaactaacggtacctaaaacggaaaccggaacggtaactaccgaacggtacccgttaacttacgttaacctaacgggttaccaacgaacggttaacgtacgggtaaacgtcgtacgtaaccgtacgggtaaccggttaaagggaccgttaagtacggttacgttacgttttacgaagtttacgtacgggtccgggtaaccccgtaagggtacccctaaggttcccgg

SEQ ID NO: 115066 - DNA, 670 bp, Homo sapiens
  misc_feature: GYAE6OF02GFWZL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaaggtgtccagtgtgaagtgcaggtggtggagtcgtgggggagccgttggtaaagccgtgggggtcccttagagtctcctgtgtggcctgtggattcactttcagttaatggctggatggtaggttgggtcccgccgaggcctccggagggaaggggcgtggaggtgggttggtacgtttagaaaaagtaaagtgagtggtagaagtaaaagtagacgtacggtgaccgaccgtagaaaggagtatacacatcacgaagagtaataactaacgaaaacggtggttaagttagtttacgaactaaagtagaaccgaagacccgtaaggaaaaccgaggaccaacgacgtccgtactaattaccacgtaccagtacgtacgttacggaagtgaccgtagtaccgggtaacgttaagggacgtacgttaacgtcggtttacttttaaggactttacggtccggttaccggggacccgtaagggtaccgtaggttcgg

SEQ ID NO: 115067 - DNA, 781 bp, Homo sapiens
  misc_feature: GYAE6OF02H4CLF.15.86.H09.1.454.CMB.1.raw
  modified_base (331)..(331): a, c, t, g, unknown or other
  misc_feature (331)..(331): n is a, c, g, or t
  modified_base (740)..(740): a, c, t, g, unknown or other
  misc_feature (740)..(740): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgtcggttttcgtgacgtcgctatacgttaaaggtgtccagtgtgaagtgacgaggtggtggagttccgtggggtagtccgttaggtaaacgtccggtacgggggtcccttagtacggtccttccttggtgtcggtccctgtggtaacttcgtactttacagttaatggtacgtggatcggngttacggtccgtcgacggtcgaccggagggacgggtcgtggtggtaggtaggtacgttaacgaaaggttaaatgacgttaggagtaagtaagtacgtaacgtcgacgtccgtaacgacggtaaacgacgtactaccgtaactacgtactacggaaagtacggttaaaactaacggtaaaccggtaaaacccggtcggtttaaacgttttacgtaaacggtaaacttaaaccggtaacgtaaacgtacccgtaaacccggaaacggttaaaaccggaacgtaaccgtaccgggtaacgtacccttaacgttaactttacgtaaccgtaacgtaaccgtaagtaccggttacgagtaccgtagtaccgtaacggttacggttaacggagttaccgtattacgttacgttanacgttacgtcggttaccggaccgtaggtacgtaccggttgg

SEQ ID NO: 115068 - DNA, 642 bp, Homo sapiens
  misc_feature: GYAE6OF02FIIGU.15.86.H09.1.454.CMB.1.raw
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
tcagtctacgtagccacgaccggtgctcgatttagtgctatagacttgggtttgggggggggagaggagccccagccttgggatcccccaagtgttttcattcagtgatcaggactgaacacagaggactcaccatggagttcgggctgagctgggtttttccttgctgctatcttaaaaggtgtccagtgtgaagtgcaggtggtggagtctgggggagccttggtaaagcctggggggtccctttagagtctcctgtgtggcctctggattcactttcagttaatggctgggatcgagttgggtccgccagggctcaggggaggggctggagtgggttgacgtttcaaaagtaaaatgatggngagaaaatagactacggtgcaccgtgaaaggaanactcaccatactcaaganataattacaaaacggacgtgttaatttgacaaaagtgaaaccagacccgttacgaaaaccgtacggaaccaccgagtacccgttactaacgttactacggttacccaacaggtaactttccgggaaaattcggaccaagtacgggtacgtaaaagggacggtaactaagtaggtacctttttaggacttagtccgaggggaccctacgggggactaaggtacggg

SEQ ID NO: 115069 - DNA, 822 bp, Homo sapiens
  misc_feature: GYAE6OF02HB6ME.15.86.H09.1.454.CMB.1.raw
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
tcagtctacgtagccacgaccggtgctcgatttagtgctatagacttgggtttgggggggggaggagggaggccccagccttgggatcccccaagtgttttctattcagtgatcaggactgaacacagaggactcaccatggagttcgggctggagcgttgggttttccttggctgctatcttaaaggtgtccagtgtgaagtgnaggtggtggagtcgtggggagtccgttagggaacgccggtgggggtcccttaggacgttctcctgtgtcggcctcgngtgttctactttcgtagtaatggcgtggtagtagtaggttcgggtcccggccgtacgggccgtaccgggacggggaacggggcggttgggtacggttgggggttacgggttacggtttaaacgtaaaaaaggttaaaaacgtaggtaagtagggtagaaagtaaaaagtacgtaacggtacggtaggtaccgtaaacccgtagggaaaagggtaaacggtaacttaaccgtaaccgtactacgtaacgaaacggtaagtaaacgttaaaactaaaccggtaaaaaccggtaacgggtttaacgttaacgtttaggtaagttaaaaacgaaacggttaaaccgaaccggtaaacccggttaacgaaaaaaccgggtaacggaaacaaccgaaccggtacctagttaacttaaccgtacgtaaccaacgtagtaacgttacggtaacgtacgactagtaccgtaacggtaagggacggtagttactaggttagttaacgagttacgttcggtaccgggacccggtaaggaccgttagtcggg

SEQ ID NO: 115070 - DNA, 654 bp, Homo sapiens
  misc_feature: GYAE6OF02FM4AM.15.86.H09.1.454.CMB.1.raw
  modified_base (443)..(443): a, c, t, g, unknown or other
  misc_feature (443)..(443): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcccttagagtctcctgtgtggcctctggattcactttcagtaatggctggatgaggttaggtccgccaggcctccgaggggaaggggcgtgggaggtgggttggtacggtttacgaaaaagtaaaaatgaagtgggtagaagtaaaataggaacgtacggtagacgtaacccgtagaaaggaagattacacctatctacaaganataatacaaaacgacggtagtattgacaaatgaacacgactagaaaccgaggaacacgagtaccgtactaattaccgtacgtaccaactagtacgttacgggaagtcgaccagtaccggaacgtaacgggtaggtcttaagttcgttacgtttttaggaactttacggttccggtacgggggtacccctaaggggaacctaggtttccggg

SEQ ID NO: 115071 - DNA, 708 bp, Homo sapiens
  misc_feature: GYAE6OF02JPVZB.15.86.H09.1.454.CMB.1.raw
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (421)..(421): a, c, t, g, unknown or other
  misc_feature (421)..(421): n is a, c, g, or t
  modified_base (670)..(670): a, c, t, g, unknown or other
  misc_feature (670)..(670): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtccagtgtgaagtgcaggtggtggagtcgtgggggagccgttagggtaaagccggtacgggggtccccttaaggacgtcgtcctggtgtggcctcgtggtattctacttttgagttaagtcgtcgttggagttagtggttgggtccgactagggctccggagggacgggntaggnggttggggttcgtacgtttaacaaaaggtaaaatgtagtaggagaacgtaaaagtacgacgtaggtnaacgtaccgtagtaaaaggatacgttcaccgtagtacctagaacgtaaggtaattacggtaaacctaaaacgggtaacgtttaaggttacgttagaacgttaaacgtataaccgagtaacgtaacggaaacgtaagacctagacggctaactacgtaccgtatacctaacgagtacgttagggactaggtaccctaagttaccggaacggtacggtaggtccgtaagtccggtttaacttacgtaacgngttaccggaccgggttacacgggtactacggttacggg

SEQ ID NO: 115072 - DNA, 636 bp, Homo sapiens
  misc_feature: GYAE6OF02GPGUA.15.86.H09.1.454.CMB.1.raw
  modified_base (423)..(423): a, c, t, g, unknown or other
  misc_feature (423)..(423): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttgggtaaagccgtggggggtcccttagagtctcctgtgtggcctctggattcactttcagtaatggctggatgagttgggtcccgcaggcgtccgaggggagggctagggagtggggttggacgtttacgaaaagtaaaatgataggtagaagaaatagactacggtgacgaccgtagaaaggaagattacactatctacaaganaataactacgaaaacgtacggtagtactttagaactaaatacgaacacgtacctaacggaaaaccgaggaaccacgaagtcccgtatacttactacgtaccactaggtagttaccggaagtcagtacgtaccggtaacgtaaagggcggtactacgttgttacgttttgaattacgtccgggtacggggacccaggggtactaaggttccggg

SEQ ID NO: 115073 - DNA, 786 bp, Homo sapiens
  misc_feature: GYAE6OF02FIPEC.15.86.H09.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
  modified_base (276)..(276): a, c, t, g, unknown or other
  misc_feature (276)..(276): n is a, c, g, or t
  modified_base (778)..(778): a, c, t, g, unknown or other
  misc_feature (778)..(778): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtgggttttcctgctgctatacttaaaaggtgtaccagtgtagagtgcnggtggnggtagtcgtggggagccgttaggtaaagccgtgggggtcccttagagtctcgtgtgtgctgtggnttcacttnagtaagtggctggatgtaggttggtccgacgaggtcctacggaggggtacggggtctcgggtaggttcggggttacggtacggtttaacgtaaaaaaggttaaacgtaggtaagttagggtaacgtaaggaaaaaacgttacggtaaccggttacgggtagtacccgtaaacccggtaaggtaaaaacggggaaagtacgttaccgaaaccggtattaccgtaacgaaaacggtaacgtaaacttaaacggtttaaacgaaaaaaccggtacggggtttaacgtaaacgttttacgaaacgtaaacggttaactaaaccggaacggtaaccggtaaacgaaaccggtaacggaacctacgaccggtaccttaccgtaattaacgtactaacccgtaagtaacgtacgtttaccggtaacgtcgaccgtattaccgggtacgtaagggacggtacttaagttcgtacttttagtacgtacgtcggtaacgggactacgggtanagttcggg

SEQ ID NO: 115074 - DNA, 779 bp, Homo sapiens
  misc_feature: GYAE6OF02FUM0J.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatacttaaaggtgtccagtgtgaagtgcgaggtggtggagtcgtggggagtccgttaggtaaaggccggtcgggggttcccgttaggtacgtcttccgtcgtgtcggtcctcgtggtacttctactttcagtacgtggctggagtgtaggttcgggtcccgcgaggtccgtaccggaggggaaggggtcgtaggggagggttggggttacggtaacggtttaacgtaaaaaggtaaaagtaggtaagttgggtaagtaagaaaagtacggacgtacggtacgaccgtaccggtaaggaaaacggaagtaacgttaccaaccgtaagtaccgtaaccgaaaggtaacgaaattaacgttaaaccggaaaaacgttcggtaacgttaagtttacgaacgtaaagtaacgaaacgtaccgtaccgtaaacggaaaaccggacgaaccgaaacggtacgtacccgttactaacgtttacgtaccgtaaactaccggtaagttaccggttaagtaacgtcgaacgtacgtaccggtaacggtaaaggtccgaagttacgttacgttcgtttaagaacttcggtaccgtaccgggtaccgaggttaacgagttcggg

SEQ ID NO: 115075 - DNA, 838 bp, Homo sapiens
  misc_feature: GYAE6OF02I88I9.15.86.H09.1.454.CMB.1.raw
  modified_base (176)..(176): a, c, t, g, unknown or other
  misc_feature (176)..(176): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttcttgctgctatctaaaggtntccagtgtgagtgcgaggtggtggagtcggtgggggagtccgttaggtaaacgccggtgggggtcccttagacgttcgtccgttggtgtcggccttcgtggtacttctactttcgagtaagtggtcgtggatggtaggttcgggcccgacgacggtcctccggaaggggaacggggtcgtgggtagggtcggggtttacgggtacgttttaaacgaaaaaagttaaaacgttaggtaagtagggtacgtaagaaaaggtaacgacggttaaccggagtacccgtaaccgggtaacgaaaaggaacgtaagttacccaaactagttcccgaaactaaggaacgtaacgtttaaagtaaaccggtaaaaacgtaaccgggttagtttaacgtttagtaaaccgtaaagtacgtaaaccgaacggttaccgtaacggaaaaaccggtacgggtaaccaacggtaacgtaccccgttacttaaacgttaaccgtaccgtaacccgaacttaacggtaacgttaaccgggtaacggtacgttaaggaaccccgttaggttaacgggtaaacgggtacggtcgtttaaacggttcgtttaaccgtttagtaaaggttacggttacccgggttagggacccccgggtaaggtacggaacggtttcccgg

SEQ ID NO: 115076 - DNA, 845 bp, Homo sapiens
  misc_feature: GYAE6OF02G89OV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcttgggttttccttgctgctatactaaaaggtgtccagtgtgaagtgcgaggtggtggagtcgtgggggagtccgttaggtaaacgccggttggggggttccccttaggacgttccttccttggtggtcggtcctcgtggtatttctacttttacgagttaaagttggccgttgggagttacggtaaggtttcgggggtccccggcccgacgggccttacccggaaggggggaaacggggggtccggttaggggaaggggtttgggggtttacggggtaaccggtttttaaacgtaaaaaaaggttaaaaaagttaggtaagttaggggttaaggggtaaaaaaggttaacggtaaacgttaaccggggtacggacccggtaaccccgggttaaagggaaaacggggaaaacggtaactttacccgaaccctaactaccgttacgaaaggaagtaaactttaaacgttaaaccgaaaaaacgggtacggtttaaggtttaagtttacgtaacgaaattacgaaacacggtaacccgtaaggaaaaccggaaggaaccacgacgtaccgttacctacgtttaacgtaccgttaaccacgtaagtacgttaacggagtcgactacgtagaacgtacggagtaccgtatcgttgtttagagttacgcggttccgggaccgaaggacgtagtggttacccg

SEQ ID NO: 115077 - DNA, 926 bp, Homo sapiens
  misc_feature: GYAE6OF02F9ZPR.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggaggtcgtgggggagccgttggtaaacggccgttcgggggtcccttaaggtcgtcctccgtggtagtcggccttcgtggtacttcgtactttcgtagtaagtcggtcgtaggtagtaggttacggttcgggtcccggtacccggtacgggtcccgtacccgggtaacgggggtaaacgggggtccggttacggggtagggttacgggggtttacgggttaacgggttttaaaccggtaaaaaaacggttaaaaaagttaggtaaaggttagggtaacggtaaaggtaaaaaagttaacggtaacgtaaacgggttacggaacccgtaaccccgggtaaaggtaaaaacgggtaaacggtaacgttaaccgtaaacccgtaacgttacccgttaacgaaacggtaaagtaaagttaaacgttaaacccgtaaaaaacggtaacgggttacgttaaacggttttacgaaacgttaaaacgtaacgtaaaaccgtacgtaacccgttaaacggaaaaccggtacggaaaccgtaaccgaacggtaccggtttaacctaacgtttaaccgaacgttaaaccgaacgtacgtaacgtaccgggtaaacgtcggaaaccgtagggtaacccgttaagggtaaacggtaccgggtattaccggtagttaccgtttaggtaacttacggtccggttaacgggtaccgaacggttacgtaaggttaccggg

SEQ ID NO: 115078 - DNA, 801 bp, Homo sapiens
  misc_feature: GYAE6OF02IAR74.15.86.H09.1.454.CMB.1.raw
  modified_base (219)..(219): a, c, t, g, unknown or other
  misc_feature (219)..(219): n is a, c, g, or t
  modified_base (670)..(670): a, c, t, g, unknown or other
  misc_feature (670)..(670): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtggggganccgttaggaaagtccgtcgggggtccttaggagtctcgtgtgtgcctacgtgattctactttcagtaactggctaggtatgaggttcgggcctcgacggtctacggaggggaacggggcgtggtaggtggggttcggtacgttttaacaaaaagttaaaagtgtaacgtagggtagtaaagaaaagtacgaacgtacggacgaccgaaccggtaaggaaacggaaagtacgttaccaaccaattcgtaaccgaaaggaacgtaattaaaccgtaaacgtaaaaacggtaaccgggtttagttaagtttacgaaaccgttaaaagtacgaaaccgtacgggtaacctaaacgggtaaaaacccggaggaaccaaaccggtacggtacccggttaacttaaacgttaaccgtaaggtaaaccctaacgtaaggttaacgttagggtaaaccgngttacctaaacggttaccgaaacgggttttaaaagggaccggtaactttaagggtacgtttagtttttaacggattttaacgggcggttaaccgggggtaaccctaacggggtaacctacggtttaacggg

SEQ ID NO: 115079 - DNA, 922 bp, Homo sapiens
  misc_feature: GYAE6OF02HTNX1.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggttttccttgctgctatacgttaaagtgtccagtgtgtaagtgcaggtggtggaggtcgtggggacgtccgttaggtaaacgccggtcgggggtacccgttaggacgttccgttccgttggtggttcggcccttcgtggtactttcctacttttcgaagttaacgtggtacgtggtataggtcggttcgggtccccgcgtacggtccgtacccggaaggggtaacggggtcgtaggggtagggttaggggttacgggttaccgtttaaacgaaaaaaggttaaaagtaggtaagtagggtaagtaaagtaaaagtacggtaaccgtacggtaccgaccgtaacccgggtaagtaaaacggtaacgttaacgtaccgtaacctaacgtaccgtaacgaaaggtaaactaacttaaaacgttaaacccgaaaaacggtaccgggtttaagtttaacgttacgtaaacgtaaaacgttacgaaaccgtacgtaacccgaaaggtaaaacccggaacgtaacgaacccgtaaccggttaccgttaaaccgtttaacgttaacccgttaacgtaaacccgtaacgttaacgtaaccggtttaaacgggtacggttacccgaacggttaaccgttaaacccggtaacgggtttaaacgggaaggttaccgtttaacggtttacgtttaacgttttaacgttacggtttaaccgggttaccgggtacccgggggtttaaacccgggaacggtttaaccgggtaagggttttccccggg

SEQ ID NO: 115080 - DNA, 896 bp, Homo sapiens
  misc_feature: GYAE6OF02G3CZF.15.86.H09.1.454.CMB.1.raw
  modified_base (789)..(789): a, c, t, g, unknown or other
  misc_feature (789)..(789): n is a, c, g, or t
tcagtctacgtagccacgaccggtgctcgatttagtgctatagactttggggtttgggggggagaggacgccccagccttgggactccccaagttgttttcattcagtgatcaggactgaacacagaggactcaccatggagttcggctgagcgttgggttttccttgctgactattacgttaaaaggtgtccagtgtagagtgcgaggtggtggacgtcggtgggggactccgttagggtaacgcccggttggggggttcccttaaggacgttccttccgttggtacggtcgaccttcgtggtactttcctacttttacgtagttaagtcggtcgtggattaggtacgggtttcgggtccccggaccgtagggccctaccgggaagggggaacgggggtccgtggggtacgggtttagggggttaggtaaaccggttttaaacgaaaaaaggttaaaagtcggtaaggttagggtaaggaaaacggtaaaaagtacggtaaaccggttacggtacggaaccgaacccgggtaaggaaaagggtaacgtaaccgttaccaacccgtaacttacctacggaaaaggtaacgtaaatttaaaccttaaacggaaaaaaccccggttagggtttacttttaaggtttaaccgaaacgtaaaagttaacggaacccgtaaccggtaccggtaaaaccggaaaaccgggtaacggtaaccaaacgtccggaaacccgtttaatttacgtaaccttaccggaaacctaccgtaagggttacgttacggaaacgtntaaccaagggtaaccggaacggtaaaggtcggtattagtttacggttactttaggacgtttacggccgggttacccggggaacccgagggttaagtaccgtttcggg

SEQ ID NO: 115081 - DNA, 1072 bp, Homo sapiens
  misc_feature: GYAE6OF02GJQWO.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagtccgttagggtaaacggccggttcggggggttcccctttaggtacggttccgttcccgttggttcggttcgggtcccttcgttagggtaactttccgtaaccgttttccgaaggttaagttcgggtccgttgggaagttgggtaagggtttcgggggtaccccgcccgtaacggggtcccgttaccccgggaaggggggtaaacgggggggtccggttgggggtaaggggtttcggggggttttacgggtaaccggtttttaaaccggtaaaaaaaaggtttaaaaaacgttggtaaaggttagggttaaggaaaaggtaaaaaacggtacggtaaaccggttaaccgggttacggaaccccgtaaacccgggtaaagggtaaaaaacggggtaaacggttaaacctttaacccgaaacccgttaacgtttaacccgtaaaccggtaaaaagggtaaacgtttaaaacgtttaaaaacggttttaaaaccccggaaaaaaaaaccggggttacccggggttttaaaggttttaaaaccgtttttaacggaaaacccgtttaaaaaagttacggggtaaaaccctaacgggtaaaccccgttaaaacgggaaaaaaaccccgggacgggtaaacccaaaccggtaaccgtaaccccgggtttaaacttaaaccgttttaacccgtaacggttaaccccctaaaggtaaccgttaacgggtttacgggaaacgtcggtaacccgtaaacggtaacccgggtaacggtaaaacgggtcggtaacttaacggttcgttacgttttagacgtttacggtccgggtaccggggacccgtaaggggtaacctagggtttccggg

SEQ ID NO: 115082 - DNA, 724 bp, Homo sapiens
  misc_feature: GYAE6OF02FW1UU.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaacgccggtgggggtcccttagagtcctcctggtgtcggcctcgtggtattcgtactttcagtaatggcgtggatggtaggttcgggtccgccgaggtccgtaccggaggggaacggggcgtgggtacgggttggggttacggtacggtttaacgaaaaaggttaaaagtgtaacgttagggtagaaagtaaaagtaggaacgtacggtagaccgaccggtaagaaacggaatacgtacaaccagtactacaaagagtaacgttaataacgaaaaacggtcgttaagttagtttacgaaactaaagtcgaaacgacgtaacccgtaaaggtaaaacccgacggaacacggacgtccgtactaacgttactacgtaccataggagttacggaagtcgacgtaacgtaacggtacggtaaacggcgtaacggttaattaccggtacttttagacgtttaacgtcgggacccgggactaaggtaaccgtagttcccggg

SEQ ID NO: 115083 - DNA, 654 bp, Homo sapiens
  misc_feature: GYAE6OF02IWHAP.15.86.H09.1.454.CMB.1.raw
  modified_base (217)..(217): a, c, t, g, unknown or other
  misc_feature (217)..(217): n is a, c, g, or t
  modified_base (277)..(277): a, c, t, g, unknown or other
  misc_feature (277)..(277): n is a, c, g, or t
  modified_base (583)..(583): a, c, t, g, unknown or other
  misc_feature (583)..(583): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggganccgttggtaaagccgtgggggtcccttagagtctcctgtgtggcctctggattcactttnagttaatggctggatgagttggtccgccaggctcgagggaggggctggaggtgggtggacgtttacaaaagtaaaactgatggtagaagaaaatagaactacggtgactacccgtagaaaggaagacttacgaccatctacaagagaataataacaaaaacgtacggttagtaatttgactaaagtacgaacacgacccgtaagaaaaccggacggacaaccgacggtacccgtacttaacttaccgtacgttaccacgtaagtacgttagggaagtcgacgtaacaccgggtaacggtaaacggnggtaacttagtacgttcgttttagattacgttacgggtaccgggacccgtacgggtacgtagttaccgggg

SEQ ID NO: 115084 - DNA, 634 bp, Homo sapiens
  misc_feature: GYAE6OF02GB94D.15.86.H09.1.454.CMB.1.raw
  modified_base (241)..(241): a, c, t, g, unknown or other
  misc_feature (241)..(241): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccttctgcatctgccttgctgggagcctcgatcgaagctcacctgcaacctaagtagtganctatacgaacctacaccgatacgaagtggtataccaacgacgtacgaccgaacgggaaccgtacccccaagttataataagtagtaaagtagagtgagtgacgacgaccgacgaacggaggggacgacgtcccgatcgactacagtcgctcgtacgttcgtcgggactcgaaccgtacctaccgtacctaccacgtacctacccgtacctacccgtagtcctacgacgacgttcgacggtcgtagacgttctcgtcgtagtaggacgagtaacgcccgtaacgagtacttacgagtacgtaccgtaaagggtccggttggggttcggttaccgggaaccggtacgggaacgaacgtccgtaccggtaccggtaccggttagtcccgaacccgg

SEQ ID NO: 115085 - DNA, 806 bp, Homo sapiens
  misc_feature: GYAE6OF02GV3TT.15.86.H09.1.454.CMB.1.raw
  modified_base (346)..(346): a, c, t, g, unknown or other
  misc_feature (346)..(346): n is a, c, g, or t
tcagtctacgtagccacgaccggtgctcgatttagtgctatagacttggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcctgggggagccttaggtaagccgtgggggtcccttagagtctcctgtacgtggcctcgtggattcacttttcagtatggctggatgtacgttgggtccgcgaggtcgtccagggaagggctggagtgggtgacgtttanaaagtaaatgatggagagaatagactaggtgacgaccggtagaacggtaagacttcgacctagtccttacgaagtaagtaacttaagtttaacgaaaaacccggttgggtacgtttaacgttttacggaactaaaacggttacggtaaaccgacggtaacccgttaagggaaaaacccggtacgggtaaccgttaaccgaaaccgggttacccggttaccgttaaaacttttaccggtttaaccggtaaaccccgtaaccggttaacggggttaaaccttttaaccgggggaaacggttttaccgaccgtttaacggtacccgggtttaaacccggttaaacgggttaaccgggtacccggtttaagttccgggtaacgtttttttacggaaagtttaccgggttcccgttaacggggggtacccccggtaagggttaaccggttaacggtttaccgggg

SEQ ID NO: 115086 - DNA, 916 bp, Homo sapiens
  misc_feature: GYAE6OF02G2RBA.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagagactcaccatggagttcggctgagcttgggttttccttgctgctatcgttaaaaggtgtccagtgtgaagtgcgagggtggtggagtcggtgggggagtccgttaggtaaacgccggttcgggggtcccttaggacgttcctccgtggtgtcggccttcgtggtacttctactttacgagtaagtggcgtggattggtacggtttcgggtcccgaccgtacggtccgtaccggaagggggaacgggggtcgtaggggtacgggtttgggggttacggggttaaaccggttttaaacggtaaaaaaggtttaaaaacgtgggtaacggttagggtaaggaaaaggtaaaaacgttaacgtaaccggttaacgggtaccggaacccgtaacccgggttaaagggaaaaacgttaacggtaccttaaccgaacccgttactaccgtaaaccgaaggtaaagtttaaacgttaaacgtttaaacccgaaaaaccgggtttagggttaaacgttttaagttaaacgtaaacgttaaaaagtacccggaaaccgtaccgggtaaccccgtaaaacggaaaaacccggacgggtaaacccaacgggttaccgtacccggtttaaacttaccgggtttaactaacccgttaacccgtaacgtaaacggttaccgttaacggggtaacttacgaacgttacgtaaccgggtaaacggttaggaaccgttacgtttacgttaacgttctttagacttacgggttccggtaacccgggtcggtaacggtacgtacggttcccgg

SEQ ID NO: 115087 - DNA, 1039 bp, Homo sapiens
  misc_feature: GYAE6OF02GP5U6.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtgggaggtcgtggggggtacgtccggttaggtaaaacggtcccgggttagggggggttccccgttaaggtacggttccgttaccgttggttcgggttcggcccttccgttagggttactttccttaaccgttttccgtaaggttaaacgttcgggtaccgtttagggtaagttgggtttaacgggtttccgggggttaccccggtccccgacggggtccccgttaccggggaacgggggtaacggggggtccggttacgggggtacgggtttacggggggtttacgggttaaaccggttttaaacggtaaaaaaaaggtttaaaaaggttaggtaaagggttaaggggttaagggtaaaaaggtaaaaacggttaacggtaaacccggttaacggtaccggttaacccgggtaaacccgggtaaacggggaaaaaacggggtaaacggtaaaccgtttacccgaaaccgttaaccgttaccgttaacggtaaaacggtaacggtttaaacgttaaaaccggtttaaaacccggtaaaaaaaaccggttcggggttttaacggttttaaagtttaacgggaaacgttaaaaggttacgaaaaccgttaaccggacccgttaaaaaccgggaaaacccgtaaggaacccaccggtaaccgtaccgttacttaaccgtttaacccgtaacgtaccaaccggtagttacggttaacggaacgtcgtaaccgtaacgtacggaaacgggtaagggtaccgtacgtttacgttcgtttacgtttaaggtattaacgtccggggttaccgggaacccgtagggtacccgtaggtttacccgg

SEQ ID NO: 115088 - DNA, 777 bp, Homo sapiens
  misc_feature: GYAE6OF02JP7FM.15.86.H09.1.454.CMB.1.raw
tcagtctacgtagccacgaccggtgctcgatttagtgctatagacttgggtttgggggggagaggaggccccagccttgggatccccaagtgttttcattcagtgatcaggacgtgaacacagagactcaccgatggaggttcgggctgagtcgttgggttttcctgctgctatacgtaaaaggtgtcgagtgtgaacgtgcgtacggtggtgaggtcgtggggacgtcgttagggtaaaggtccggtcgggggtacccttaggacgttccgttccgttggtcggtcgggccccgttaaggttgggtactttccgtacttttacgaagttaagttcggtcgttggtagttgtaggttcgggtccgaccgtacggccgtacggtaacggggacggggtcgtaggtaggtttcgggttaggttacccgggttaagtaaaacggttaaaaagtcgtaaagttgggacgttaaaaggaaaaggtacgtaaggttaccggtaaggtcccgtaaacgttagggaaaacggtaagtaactccgtaacgtactaccgaagtaagaacgtaactaacgtaaactaaacggcggttaagtgttaacgaacgaattaacgaaccgtagtaccgtaacgtaaaaccggcgtaacgtacccagttccgtaacgttacttaacgtatacccagtacgacgttagaccgtgtacgtactacggtaacgaacgtggtacctaggtcttaacggttagtacttagggcgtaggaccggtaggtactacggttgg

SEQ ID NO: 115089 - DNA, 707 bp, Homo sapiens
  misc_feature: GYAE6OF02HAFQW.15.86.H09.1.454.CMB.1.raw
  modified_base (160)..(160): a, c, t, g, unknown or other
  misc_feature (160)..(160): n is a, c, g, or t
  modified_base (396)..(396): a, c, t, g, unknown or other
  misc_feature (396)..(396): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgtgngtgctatacgtaaagtgtccagtgtgaagtgcaggtggtggagtcgtggggagccgttggtaaagccgtgggggtccctaagcgtctcctgtgtcggcctcgtggattccactttcgagtacgtggctaggtatggtaggttcgggtccgcgaggccgtaccggaagggacgggtcgtggaggttgggttgtaacggtttaagaaaaagttaaagtagtagttagggtaacgtaanaaaagtcggtaacctaggtcgaacaccggtaggtaaacgggtatactaccgaactattacgacaaaggtatattaaacgtaacgaaaaggtacggttataagtttcgaactaaagtcgaaccggtaacgtcgtaaacggaaacgacggtacaaacgtccgtaacctacttacgttaacgtaccgtacgtaacgtagtaagttaccgtaggttaccgataccgtaacgggtaacgtaaaacggcggttctaggttccgtaatttacggaattccggttaccggacggacccggtaagggtactacggttccg

SEQ ID NO: 115090 - DNA, 675 bp, Homo sapiens
  misc_feature: GYAE6OF02HZTUJ.15.86.H09.1.454.CMB.1.raw
  modified_base (285)..(285): a, c, t, g, unknown or other
  misc_feature (285)..(285): n is a, c, g, or t
  modified_base (640)..(640): a, c, t, g, unknown or other
  misc_feature (640)..(640): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatcttaaaggtgtccagtgtgagtgcaggtggtggagtcgtgggggagtccgttggtaaacggccggttcgggggttcccttaggtacgttccttccgtgtggtcggcctctggtnttctactttcagttaagtggcgtggatggtaggttcgggtccgccgaggtcctaccggaggggaacggggcgttggggagggttggggttaggtacgtttacgaaaagttaaaagtgtagtaggtagaaagtaaagtacgacgtacggtcgacgtaccgaggaacgaagtactacgacagtactacgaagtataattaactaacgaaacgtacggtagttattagaagtaaatagacgataccgaagaaaaccgacgaacacgacgtaccgattaacttacgtacgttaaccgaacgtagtacgtacgtaagcgagtaacgcgtaaggtacggagtcgttgttgttacgttagtntacggtcgtaccgggaccgtagtacgtagttcggg

SEQ ID NO: 115091 - DNA, 821 bp, Homo sapiens
  misc_feature: GYAE6OF02GQRG8.15.86.H09.1.454.CMB.1.raw
  modified_base (806)..(806): a, c, t, g, unknown or other
  misc_feature (806)..(806): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtgggggagccttagggtaaagccgtgggggtcccttagagtctcctgtgtggctctggattcacttcagtaatcggctggatggtagttcgggtccgcgaggtctccgaggggaacgggcgtgggagttggggttgtacgtttacgaaaaagtaaaatggtagtagggtagaaacggtaaaataggaacgttacggtagtaccgaacccggtaggaaaagggtaacgtaacgttaccgaacgtaacgtaccgttaacgaaaggtaacgtaagttaaactttaaccggaaaaaaacggttcggtaagtttaactttacggtaacaaaaaggttacggtaaaccaagggtacccgttaacgggaaaaacccggtaggaaaccaaccgtaacggtacccggtttaacttaaaccgttttaacacgggtttaaaccccaacgttaacggtaacgtttacggggaacgtttcgaaccgttacggtaacccggtaaggggtaaaacgtaccggggttacttaacggtttacggtttacccgttttaaggtaacgtttaacggttcccgggttaccggggggaaccctacgggggttaaacccncggttttaacggggg

SEQ ID NO: 115092 - DNA, 775 bp, Homo sapiens
  misc_feature: GYAE6OF02I2NDD.15.86.H09.1.454.CMB.1.raw
  modified_base (179)..(179): a, c, t, g, unknown or other
  misc_feature (179)..(179): n is a, c, g, or t
  modified_base (204)..(204): a, c, t, g, unknown or other
  misc_feature (204)..(204): n is a, c, g, or t
  modified_base (381)..(381): a, c, t, g, unknown or other
  misc_feature (381)..(381): n is a, c, g, or t
  modified_base (684)..(684): a, c, t, g, unknown or other
  misc_feature (684)..(684): n is a, c, g, or t
  modified_base (692)..(692): a, c, t, g, unknown or other
  misc_feature (692)..(692): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcgtggtttcgtgacgtcgctatacgtaaaggntcagtgtgaagtgcgaggtggtggngtcgtaggggacgtccgttaggtaaacgccgtgggggtccccttaggaggttcctcctggtgtcgcctcgtggacttcgtactttcgtaggtaatcggtctggtagtgtaggttcgggccgcgaggtcaccgaggggtaaggggcgtgggtaggttgggttacggtaccggtttaanaaaaaggttaaaatggtaagtacgggtaagaaaggtaaaaagtacggtaacgttacgggtaaccgacgaaccccgggttaggaaaaggggtaaactaacgtttaacccgacaaaaccgttcgttaactaaaggaacggtaaacttaacgtttaaaccgaaaaacgttcggttaagttacgttaggtaaacctaaagtacgaaacggaccgtaaccgtaacggaaaacgtacgggaactaacgaccgttcccggtaattaaccttacggtaacgtaaccctaggaacgttcgtaaccgggtaanccgtaagngtaaccggtacggtaagacggtagttagtaccggttatttagaacttcggccgtacgggttaccagggttaacacggttacgg

SEQ ID NO: 115093 - DNA, 777 bp, Homo sapiens
  misc_feature: GYAE6OF02H510F.15.86.H09.1.454.CMB.1.raw
  modified_base (729)..(729): a, c, t, g, unknown or other
  misc_feature (729)..(729): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagtccgttggtaaacggccgtggggggtcccttaggagttcctcctgtgtcggccttcgtggtattctactttcagtaatcggctggatggaggttcgggtcccgcgacggcctaccgaggggaacggggcgtgggtaggttggggtaggtacggttttaacgaaaaagttaaaaagtgaagtaggtagaaggaaaagtagaacgtacggtgacgtacccggtaaggaaacgggaaagtacttaccgaacctaacttacgtacgaaaggtaagttaataaacgtttaaaccgaaaaaccggggttacggtttaaggtttaaagttttacgaaactaaaaacgtacgtaaaacccgtacggtaacccgttaaaaccgggaaaacccgggtaacggaaaccgaaccgtacgggtaccccgttaacttacgtttaaccgtaaccgtaaccgtacgtaaggtacgttaacgggaagtcgaacgtacgtaaccgaaggtaacgggtagcttagttacgtnttttagacgttacgtaccggcgggtacccgtagggacctaggttccgg

SEQ ID NO: 115094 - DNA, 1199 bp, Homo sapiens
  misc_feature: GYAE6OF02IGUO7.15.86.H09.1.454.CMB.1.raw
  modified_base (178)..(178): a, c, t, g, unknown or other
  misc_feature (178)..(178): n is a, c, g, or t
tcagtctacgtagccacgaccggtgctcgatttagtgctatagacttgggtttgggggagaggagccccagccttgggactccccaagtgttttcattcagtgatcaggactgaacacagaggactcaccatggagttcgggctgagcttgggtttcctgctgctatacttaaaggtntcagtgtgaagtgcgtaggtggtggacgtcgtggggagtccgttaggtaaacgccggttcgggggttccttaggtacgttcctccgtggtggtacggccttcgtgtacttccgtactttcgtaagttaagtcggtcgtaggtagttaggacggtttcgggttcccgaccggaacgggtccgtaccgggaacgggggtacgggggtacgtaggggtaacggggttttacgggggttaacgggttaacccgggtttttaaaaacaaaaaagggtttaaaaaaaccgtttcggggtaaagggttttaacggggtaaaacggttaaaaacggttaaaaaaggttaagggttaaaacccggtacgggtttaaccgggtaaaccccggtaaaccccggggtaaaaagggtaaaaaaccggggtaacgtttaaccggttaaacccgttaaacccgtaaaacgtttaccccgtaaaaaccggtaaaacgggtaaaaccgttttaacgttaaaaaaccgttttaaaaccccggggtaaaaaaaacggtttaccccgggggtttttaaaggtttaaacgttttaaacccgggtaaaaaaaggtttaaaaaccgttaacgggtaaaaaaccccgttacccgggtaaaaccccgttaaaaaaccggggttaaaaaaaccccggaaacggttaaacccggaaaacccggggttaaaccccgttaaaccggtttaacccgtttttaaaacgggttaaacccccttttaaccggaaaaaccccccgggttaacgttaaaaccgggtttaacgggttttaacccgggaaaacgggtttaaacccgttaaccggttaaaccggtttaaaccggggtaaaaacccgggttaaaggggggtaccccgtttaaacggttttaaacgttttaaccggggtttaaaccctttttaaaagggccgttttaaacccgggtttacggggggttaaaccccccggggtaaacccggttagggttaaaccccgggttaacggggtttt

SEQ ID NO: 115095 - DNA, 841 bp, Homo sapiens
  misc_feature: GYAE6OF02HTTWD.15.86.H09.1.454.CMB.1.raw
  modified_base (143)..(143): a, c, t, g, unknown or other
  misc_feature (143)..(143): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggntgagcgtgggttttccttgctgctatacgttaaaaggtgtccagtgtgaagtgcgaggtggtggagtcggtggggagtcgttaggtaaacgccggtcgggggtaccttaggacgtcgtcgtgtggtcgccttgtggtacttcgtacttttcgagttaagtggtcgtgagtaggtggttccgggtccggcgtacggccgtaccgggaaggggaacgggtcgtaggtaggggttcgggttacggtaacgttttaaaccgtaaaaaaggttaaaaaggttggtaaaggttagggtaaacgtaaagtaaaaaaggtacgttaacggttaaccggtacggaacccgtaacccggtaaagggtaaaaacggaagttaacgttaccaaccgtactacccgaaggaaaagtaacgtaagttaaaacgtaaacgaaaaaccggtacggttagttaatttaacggaaacgtaaaatacgggaaaacctcggtaaacgtaaacggaaaacgaacgaaccaacgaaacgttccgtacttaacgttaacccgttacgaaacccgtaacgacgttaacgttaccgggaagttccggaactaaccgggtaaccgtaagggtaaggtaacggttcgtaaacgttcgttaacgtttaacggagtttaaccgaccgggttaaccgggacccggaaggttaccgtaagggtttccgg

SEQ ID NO: 115096 - DNA, 771 bp, Homo sapiens
  misc_feature: GYAE6OF02JS3O7.15.86.H09.1.454.CMB.1.raw
  modified_base (135)..(135): a, c, t, g, unknown or other
  misc_feature (135)..(135): n is a, c, g, or t
  modified_base (636)..(636): a, c, t, g, unknown or other
  misc_feature (636)..(636): n is a, c, g, or t
  modified_base (698)..(698): a, c, t, g, unknown or other
  misc_feature (698)..(698): n is a, c, g, or t
  modified_base (738)..(738): a, c, t, g, unknown or other
  misc_feature (738)..(738): n is a, c, g, or t
  modified_base (765)..(765): a, c, t, g, unknown or other
  misc_feature (765)..(765): n is a, c, g, or t
tcagtctacgtagccacgaccggtgctcgatttagtgctatagacttgggtttggggggaggaggagccccagccttgggatccccaagtgttttcattcagtgatcaggactgaacacagagactcaccatggngtcgggctgagctgggttttccttgcttgctataccgttaaaaggtgttccagtgtgaagtgcgaggtggtggagtcgtaggggagtccgttaggtaaacgtcggttcgggggttacccgttagtacgtccttccgtggtcggtggtcccttacgtgggtacttcactttcgagttaagtggtacgtggattcggtaggttcgggttacccgccgaggtcccgtaccggaaggggaacggggtcgtagggtaggttcgggttggtaaccgtttacgaaaaaaggtaaaatggtaaggttaggtaggtaaacggaaaaatacggttaacgtacgggtgaccgtaaccggaaggtaaagggaatacgtacggtaacctaagtcgtaaccaaagggtaactaacgtaaacttaaacccgaaaaagggttaccggtttaagttaacgtttacgaaacgtaaagacgtaaaccgaacgtaaccgtaacggtaaaaccaggaaccgngtaaccggtaccttacgtattaaccgtcgtaaccgtatacggtacgttaacgacaccggtanagttacgaggtacggattaacgtactaggttctttaacgnttacgcggtacgggacgtaggtacgtntacggg

SEQ ID NO: 115097 - DNA, 679 bp, Homo sapiens
  misc_feature: GYAE6OF02JD4U1.15.86.H09.1.454.CMB.1.raw
  modified_base (357)..(357): a, c, t, g, unknown or other
  misc_feature (357)..(357): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagctgggttttccttgctgctatcttaaaaggtgtcagtgtgaagtgcaggtggtggagtcgtggggagccgttaggtaagccgtgggggtccgttagagtctcctggtgtcggtcctcgtggtattctacttctagtagtggctggtatgtaggttggcccgtccgagccgtcggaggggtacgggcgtggaggtacgggtggtacggttanaaaacgtaaatgagtgtagaagaaacgtagacgtacggtacgaccgacgaaggaaacggatacgtaccaactagtctacgaaagtaagaacttaaataccgtaaaaacggccggtttaagttactttaaggaacgtaaaatacggaaactacaccgtaacgaaaaccgagggaacaacgtaccgtcctacggtaattcctacgtacccaatacgtagtacgagtcgtactacgtacggaacgttaaggcggtctacggttacgttcggtttagatttaccggtagggtcccggggaacctacgggggtactaggttaccggg

SEQ ID NO: 115098 - DNA, 790 bp, Homo sapiens
  misc_feature: GYAE6OF02IOPXP.15.86.H09.1.454.CMB.1.raw
  modified_base (201)..(201): a, c, t, g, unknown or other
  misc_feature (201)..(201): n is a, c, g, or t
  modified_base (666)..(666): a, c, t, g, unknown or other
  misc_feature (666)..(666): n is a, c, g, or t
  modified_base (674)..(674): a, c, t, g, unknown or other
  misc_feature (674)..(674): n is a, c, g, or t
  modified_base (722)..(722): a, c, t, g, unknown or other
  misc_feature (722)..(722): n is a, c, g, or t
  modified_base (744)..(744): a, c, t, g, unknown or other
  misc_feature (744)..(744): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcacataggagttcgggctgacgtactgggttttcctggctgctagtacttaaaaggtcgtccagtgtgaagtcngaggtggtggtaggttcgtggggtacgaccgttaggtaaacgtccggtagggggtaccttaggagtcctccgtgttcgcggccttcgtaggaccttcgtaactttcgtagttaacgtggtactcgggaacgttagacggttcgggtaaccccggccgtaacggcgtaacccgggaagggggtaaacggggttctggggacggtttacgggttcgggtaacgtttaacgtaaaaaaaggttaaaccgttaggaagttgggttaacgaaaaagtaacgtaacgtaacggtacgtagacctaaaccgggtagaaaagggtaactaagtaccaaccagtacaacgaaacgagtaacctaaagttaaccgtaaaaaggtaacgttagttaagtttcgaaaccgtaagtaacgaacgaaggtaccgaaaggtaaaccggtagaccgtaacaccggtacctagttaacgtanacccgtanaccgaagtacgtacgaaagtcgtacaaccggttacaaggacgggttancggtttaatacttcggtttaanaacgtcgttacggaaccggtcccggtaaaggtacgtacgttaacgg

SEQ ID NO: 115099 - DNA, 703 bp, Homo sapiens
  misc_feature: GYAE6OF02H2MW9.15.86.H09.1.454.CMB.1.raw
  modified_base (539)..(539): a, c, t, g, unknown or other
  misc_feature (539)..(539): n is a, c, g, or t
  modified_base (603)..(603): a, c, t, g, unknown or other
  misc_feature (603)..(603): n is a, c, g, or t
  modified_base (656)..(656): a, c, t, g, unknown or other
  misc_feature (656)..(656): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttgggtaaaagccgtggggggtccttagagtctcctgtgtgcctctggtattcactttcagtaatggacttggatggacgttgggtccgaccaggtccttaccgagggacggggactgggagtggggttaggacgtttaacaaaaggtaaaaatgaagtgtagaagaaaataggaactggtagaccaacccggtaggaaaggtaagacttacgacctaactctaacgaaagacgtaagtttaaactaacgaaaaacgtacggtaagttaactttagaacctaaagtaacgaacgaacgtaccgtaaagaaaaacccggnggaacttaacgacggtacctctaagttacgtacgtacctaacgaagaacggttcgtaacggtanacgtaacgtaccggaagttaaacggggctaaggttacctagttaccggtttanaagttacttccgggtacgggaacccgtacggggtacaacgttcgggg

SEQ ID NO: 115100 - DNA, 780 bp, Homo sapiens
  misc_feature: GYAE6OF02FO0PM.15.86.H09.1.454.CMB.1.raw
  modified_base (567)..(567): a, c, t, g, unknown or other
  misc_feature (567)..(567): n is a, c, g, or t
  modified_base (577)..(577): a, c, t, g, unknown or other
  misc_feature (577)..(577): n is a, c, g, or t
  modified_base (644)..(644): a, c, t, g, unknown or other
  misc_feature (644)..(644): n is a, c, g, or t
  modified_base (687)..(687): a, c, t, g, unknown or other
  misc_feature (687)..(687): n is a, c, g, or t
  modified_base (693)..(693): a, c, t, g, unknown or other
  misc_feature (693)..(693): n is a, c, g, or t
tcagtctacgtagccacgaccggtgctcgatttagtgctatagacttgggtttggggggggagaggagccccagccttgggatccccaagtgttttcattcagtgatcgaggactagaacacgagagactccacagtaggtaggttcgggctggagtcgtttcggttttctgtctgtactattaacgttaaaggtcgtaccgtaggtgtaggtaagtgacggtagggttgggtagggtacggttcgggtagggggacgttccggttaagggtaaacggttccgggggttccgggggttacccttaaggtacgttccgttccggttggttcggtcggtaccgttcgttaggtacgtttaccgttaccgttacgtaaagttacggtggtacgtaggtgttaggttacgggtttccgggcccacgtacggtccgtacgggaagggggacgggtcgtgggtaggggttgggttacgtaacgttaaaagaaaaagtaagtgtaaggttaggacaaaggtaaatacggaccgttggacgaccgtaacggaaggaaaagtctacgtaacactanccgtaagaanataaataacgtaaacgaaacggtgttatagtaacgactaaagcgaacgtacgacgaaaacgacgganacctagcgtctagtaattcgacacgtaagtccgttagtaacgntccganaacggttagaacggtcgaacgttaatggttaccttgtttaaccgagttccggcggggtaaccggacggtacggtactaggttcccgg

SEQ ID NO: 115101 - DNA, 907 bp, Homo sapiens
  misc_feature: GYAE6OF02HVONI.15.86.H09.1.454.CMB.1.raw
tcagtctacgtagccacgaccggtgctcgatttagtgctatagacttgggttggggggagaggagccccagccttgggatccccaagtgtttcattcagtgatcaggactgaacacgagaggactcaccatggagttcgggctgagcgttgggttttccttgctgctatacgttaaaaggtcgtcgagtgtgaagtgcgtaggtggtaggaggttcggtacgggggtacgtccggtttagggtaaaccggtccgggttccgggggttacccgttaaggtacgttccgtccgttggtcggtcggtcccgttcgtggtacttccgttactttactaagttaagtcggtcgtaggtagtaggttacggttccgggtcccgtacggtacggccgttaaccggggagggggtaacggggtcgtacggggtacgggttacggggttacggttaacggttttaaaaccgtaaaaaaggttaaaaggttaaggtaaggttagggtaagtaaaaggtaaaagtaaccggttaacggtaaccggtacggtaacccgtaaccggtaaaggaaaacggtaacgtaacttaccgtaacctacgttaacctaacgtaaggtaagtaaacgttaaaccgttaaaacgtaaaacccggttaggtttaacgttaacgtttacgaaacgtaaaagtaccggtaaaacgccgtaaccgtaaacggaaaacggacgaaaccaccgtacgtcctacgttaacgttaaccgtacgtaaacccgtaagtcgttaacgacggttaacgtacgtaaacgtacggtaaggaaccggtaggttacccggagttaccggtttagttacccgtttaagtacgtttacgggttccgggaacccgggtaaccggtaacggtaacccgttggttaccgg

SEQ ID NO: 115102 - DNA, 901 bp, Homo sapiens
  misc_feature: GYAE6OF02FRJC6.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccagtggagttcgggctgagtcgttgggtttttccttgcttgctatacttaaaaggtgtccagtgtgaagtgcgtaggtggtggtacgtcgtgggggacgtccgtttagggtaaacggtcccggttcggggggttaccctttaagtacggttccgtcccgttggttcgtcgggtccttcgttggtattaccttacgtttcgaagtaagtcggtcttggatggtaggttcggtccgtaccgaggtccgtaccggaggggtaagggccgtgggtaggttggggttacggttaacggtttaaacgtaaaaaagttaaaagtagtagttagggtaagaaagtaaagtaacggtaaccgttacggcgtaccggtaaccggtaaggaaaacggtaacgtacgtaacctacctacgtaaccgtaagtaaggtaacgtaaacgttaaactaaacgtaaaaacggttcggtttaaagtttacgttacgaaaaactagttaaacgaaacccgtaagtaaccccgtaaaacgggaaaaacccggtgaaaacccgtccggtaaccgttacccgttttaactttaaaccgttcctaaaacccggttacctaaaggttaccggttaaccgggttaaagtaaccgtaccgggtactttaagggtaacccggttaacggggaagtaccggtttacggttaacgtttaggttttaacctttaaggttaacgttcgggttaacccggtccccggggttaaacccgaggggtttaacacggggtttacccgg

SEQ ID NO: 115103 - DNA, 684 bp, Homo sapiens
  misc_feature: GYAE6OF02GLFIE.15.86.H09.1.454.CMB.1.raw
  modified_base (634)..(634): a, c, t, g, unknown or other
  misc_feature (634)..(634): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtgtccagtgtgaagtgcaggtggtggagtcgtggggagccgttaggtaaacgccgttgggggtcccttagacgtctcctgtgtcggcctcgtggtattcgtacttcagtaagtcggctggatggtaggttcgggtcccgccgtacggccgtccggaggggtagggtcgtggtaggtgggttagggtacgtttaacgaaaaaagttaaaagtggtaacgtggtagtaaagtaaaacgtacgtaacgtacggtacgaccgtaacccgtaaggaaaaggagtaacgttccaacgtaacgtacctacgaaagagtaaataaagtaacgaaaacggtacgtaagttacgtttagactaaagtacgaacgtacacgtaaacgaaaccggtaggacacgtaccgactactagtacctactacgaccgtataccggtagtaatcgatacgtaccggagtaacggngtaactatacgttcctatacgtactcgggtacggcgaaggacctaggtcg

SEQ ID NO: 115104 - DNA, 604 bp, Homo sapiens
  misc_feature: GYAE6OF02GNMOV.15.86.H09.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
  modified_base (498)..(498): a, c, t, g, unknown or other
  misc_feature (498)..(498): n is a, c, g, or t
  modified_base (534)..(534): a, c, t, g, unknown or other
  misc_feature (534)..(534): n is a, c, g, or t
  modified_base (556)..(556): a, c, t, g, unknown or other
  misc_feature (556)..(556): n is a, c, g, or t
  modified_base (570)..(570): a, c, t, g, unknown or other
  misc_feature (570)..(570): n is a, c, g, or t
  modified_base (576)..(576): a, c, t, g, unknown or other
  misc_feature (576)..(576): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaagcgtcgggggtacccttgacgtctctgtgtggcctcgtggtatctacttcagtagtgcgtgatgtgttcgggtccgcgngcgtcgaggggaggcgtggtggtgggtgtacgttanaaaaggtaaatgtagnggtagaagaaatagacgttacggcgacgaaccgtaggaaagaagtacgtactaacagtactagaaacgagtaataaacttaacgaaaagtcgggttatagtagataaagtagaactgacctaaggaaacgacgacganacgctagtactgacgtacgacagtacgtacgagtancgtagtaccgtaggacgaggtntgtagttcgttagngttacncgggtaccggccgaaggtactaggtacg

SEQ ID NO: 115105 - DNA, 854 bp, Homo sapiens
  misc_feature: GYAE6OF02IZ3PW.15.86.H09.1.454.CMB.1.raw
  modified_base (159)..(159): a, c, t, g, unknown or other
  misc_feature (159)..(159): n is a, c, g, or t
tcagtctacgtagccacgaccggtgctcgatttagtgctatagacttgggtttgggggggagaggagccccagccttgggatccccaagtgttttcattcagtgatcaggactgaacacagagactcaccatggagttcggctgagctggttttcctgntgctatacttaaaggtgtaccagtgtgaagtgcgaggtggtggagtcgtgggggagtccgttaggtaaacgccgtcggggggtccctttaggacgtcctcctggtggtacggccttcgtggtattccgacttttcagttaacgtggtcgttggagttggtaggttacgggtccccgcgtacggccgtacccgagggggaaagggtcggtagggtgggttgggggttagggtaaccggttttaacgaaaaaaaggttaaaagttcggaagttagggtaagaaacgtaaaagtacggtaaccgtacggtacgaccgtaacccggtagaaaaacgggtaacgtacgttaacctaacccgaataccgtaaccgaaaaggtacgttaaagttaaaccgtttaaaacgtaaaaaacggtacgggtttaagttagtttaacgtaactaaaagtacaaaccgtaacgaaccccgttaaagggaaaaacccgtaggaaacgaaccgtacccggtacccgttaaacctttaagttaacccgtttaaccgtaaaccctacggtaaaccgtaagggttttaacccggaaggtttagaacctagtaacccggtaaacggttaacggaggtttaacgtaacttcggttacgttaagttagtaccgtttccgggtaccggggaacccggaggtacccggtaatttacggg

SEQ ID NO: 115106 - DNA, 792 bp, Homo sapiens
  misc_feature: GYAE6OF02IXRQW.15.86.H09.1.454.CMB.1.raw
  modified_base (266)..(266): a, c, t, g, unknown or other
  misc_feature (266)..(266): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgtctatacgttaaaaggtgtaccgagtgtgaagtgcgaggtggtggagtcggtggggacgtaccgttggtaaacggtccggtacgggggttccctaaggngtccgtccgtggtggtcggcctcgtggtattacgtaacgtttaagtaatggtctggtagtggtaggttcggtcgccgacggtcgtacgaggggagggtcgtggtaggtgggttgtaacggttaacaaaaagtaaagtaggtagtaggtaagaaagtaaaagtacggtaacgttacggacgttacccgaaccggtaaggaaaaacggtaacgttacttaaccggaacctaagttaaccctaacgtaaaacgggtaaagtttaaacttaaaacgtaaaccggttaaaaaacgggtaccgttttaaggtaaccgttttaggaaaacccgtaaagttacggaaactaaccggtaaaccgtaaacggaaaaccggtacgtaaaccaccgtaaaccgtccgtaaactttacgtactaaccgtaccacggagtacgtacgaagtcgaacctagtaacgaagacgagttacgtaacgtcttagttacgacttacggacggtacccggtagggaacaacggttaggtccggtacg

SEQ ID NO: 115107 - DNA, 817 bp, Homo sapiens
  misc_feature: GYAE6OF02JLLGP.15.86.H09.1.454.CMB.1.raw
  modified_base (205)..(205): a, c, t, g, unknown or other
  misc_feature (205)..(205): n is a, c, g, or t
  modified_base (554)..(554): a, c, t, g, unknown or other
  misc_feature (554)..(554): n is a, c, g, or t
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagcgtggtttcctgacgtcgtctacttagttaaagtcgtcagtgtgaagtgatgtggngtgtgtaggggactccgttaggaacgccggtgggtccctagtcgtctctggtgtcggtccttcgaggtcttcgtactttcgaagttagtcggtctgtaggtgtgtcggtcccgacgtcggactcggtaagggacgggtcgtggtagggttcgggttgtaacgtaacgtaaaagtaaacgtgtaagttgaaggtaagtaaaagtgtaaccggtagtcccgtacgtaaccgaaggtaaacgtacgtaccttaaccgtactaaccgtactaacgtaacgtaaacggtaattaaaccgtaaaaccggtaaacggttaaccgttaaggtttaagttaaacgtaccggttaaaanaacgggtaccgtaaaccgtaacccggtaaaacgaaaacccgtaaccgaaacccgtacggtaaccgtacccggttaaatttaaccccgttagtaaccccgaaacgtacggtaacgttaaccggtaccggttaaacgacgtaccctaaagttacggtaaccgggaaaggttcccggtaaaggtttaagttacggtttagtttaccggtaacctttccgggtaaccggtccccggttaaacgggtggtaacccggttaccggtcgg

SEQ ID NO: 115108 - DNA, 659 bp, Homo sapiens
  misc_feature: GYAE6OF02I4K65.15.86.H09.1.454.CMB.1.raw
  modified_base (437)..(437): a, c, t, g, unknown or other
  misc_feature (437)..(437): n is a, c, g, or t
  modified_base (503)..(503): a, c, t, g, unknown or other
  misc_feature (503)..(503): n is a, c, g, or t
tcagtctacgtagccacgaccggtgctcgatttagtgctatagacttgggtttggggggggagaggagccccagccttgggatccccaagtgttttcattcagtgatcaggactaaacacagaggactcaccatggagttcgggctgagctgggttttccttgctgctatcttaaaaggtgtccagtgtgaagtgcaggtggtggagtcgtgggggagccgttggtaaacgccgtggggggtcccttagagtctccgtgtcgtggcctcgtggattctactttcagtaatggctggatgtaggttgggtccgccaggctccggagggagggcgtggaggtgggtggtacgttacaaaagtaaaatgaagtggtagaagtaaatagacgtacggtgactacccggtagaaacggaagacttacacctatctacaaganataacttacgaaaaacggtcgttagtaagtttacgactaatacgaatacgaccgtagaaaaccggngaaccacgtacgacccgttataacttaccgtataccgaacgtagtaggttacgaagttcgacgtagtacgaaaccgttaaggacgtactaacgttacgttattttagacttagttccggtacggggtaaccctagggtaactacggttgggtaccg

SEQ ID NO: 115109 - DNA, 821 bp, Homo sapiens
  misc_feature: GYAE6OF02FXBEG.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagtccttagggtaaagccggttcgggggtcccttagacgtcctccgtgtgtcggccttcgtggtattctacttctagtaatggactggatggtaggttgggtcccgcgtaggtccgtaccggaggggtaacggggtcgtggggtacgggttggggttacggtaacgtttaacgtaaaaaggttaaaagtagtagtaggtaagaaacgtaaagtagtaacgtacggtacgaccgtaccggtaaggaaaggtaagtacttaccgaactacgtacctaacgaaaggtaacgtaaagttaaactaaacccgaaaaacgggtcgggtttaagttaaagtttacgaaactaaaagttacgaaaccgtaaccgaccgttaaacgggaaaaccggtagtaaccaacgggtaacttaccccttaaggttaacctttaaccgaaccgtaacctaaccgtaaggttaaccgttaccggggaaattccgaaacgttaacgtacccgggttaaaggtaaacgggtccgtaacgttaaggttttacggttccttttaaacgagttttcggacccgggttacccggggaaccccgtaaggttaccggtaggtttacccgggg

SEQ ID NO: 115110 - DNA, 765 bp, Homo sapiens
  misc_feature: GYAE6OF02IIJWL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatggagttcgggctgagctgggttttccttgctgctatcttaaaaggtgtccagtgtgaagtgcaggtggtggagtcgtggggagcctttggtaaacgccgtgggggtcccttagacgtctcctgtgtggcctctggattctactttcagttaactgggctaggagtggtaggttcgggtacccgccgaggtccgtacccggaggggaacgggggccgtggggaggttgggggttaggtaccggttttaacgaaaaaaggttaaaatggtaagtagggtagaaacggaaaaagtacggtaacgttacggtacgtaccgtaaccccggtaaggaaaacggaacgtaattaccgtaactacttacctacgaaagaagtaacttaattaaccgaaaaacggtcgttagttaatttcgactaaaagtacgaactagtaccgtaaagaaaaccggtacgaacctacgacgtacccgtacttacgttaaccgtacgtaccgaacaggttaacgttacggagttacgactaacgtacggtaaacgggtaacgggaggttacgttaagttcggttaaccgttttagacgtttacggtcggttaccgggggaaccccgtaagggtaccgtaaggtttcccgggg

SEQ ID NO: 115111 - DNA, 794 bp, Homo sapiens
  misc_feature: GYAE6OF02I5EQO.15.86.H09.1.454.CMB.1.raw
  modified_base (208)..(208): a, c, t, g, unknown or other
  misc_feature (208)..(208): n is a, c, g, or t
  modified_base (719)..(719): a, c, t, g, unknown or other
  misc_feature (719)..(719): n is a, c, g, or t
  modified_base (760)..(760): a, c, t, g, unknown or other
  misc_feature (760)..(760): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggctagagtcctgggttttccttgtcctgcttactaacgttaaaaggtcgtccaggtgtagaagtgngaggtggtggagtcgtggggtatcgtaggaacgcgtcggggtcctagagtctacgtgtgtggtacctcgtgtacttacgtacttataacgtagtcggtctaggtagtaggtaggttcgggtccgaccgacgggtactccgggaggggtacgggtcggtcggtaggtcgggttaggtaccgttaaacgaaaaaggttaaacctagggtagtacgggtaagttaacgtaaaagtacgggtaactaggtaccgtaccgaacgtaaggtaaaagtaacgtacgttaccgaacgacgtaccgtaaacaaggtaactaacgtaaacttaaacccgtaaaaaggttggttaaacgttattacggaaacttaaggtaacaaacggttccaaaccggtaaaagaaacccggagaaaccgtacgaccgttacgttaccgtaaacgttacgtagtaaacccgataacgttaacgttaacgagtaaccggacctaagggacgtaaacggtacggaaccggttntaccggttaagttccggttaagttcgacggtttaacccggnggggtaacccgtaaaggtcggtaaggtttcccgg

SEQ ID NO: 115112 - DNA, 753 bp, Homo sapiens
  misc_feature: GYAE6OF02FSTKA.15.86.H09.1.454.CMB.1.raw
  modified_base (638)..(638): a, c, t, g, unknown or other
  misc_feature (638)..(638): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggtttttccttgctgctatacttaaaaggtgtccagtgtgaagtgcagggtggtggagtcgtgggggagtccgttagggtaaaggcccggtggggggttaccccttaaggtacgtccttcccgtggtcggtcggtccctcgtaggtacttcctactttcagtaagtggctggatgaggttcgggtcccgcgagggtccgtaccggaggggaaggggcggtggagggttggggttacggtaacggtttaacgaaaaaggttaaaagtggaagttagggtagaaagtaaaagtaggaacgttacggtgaccgtaaccggtaaggaaaggtaagactacacctacgtctacgaagaacgtaattaaaccgtaaagtaaaaccggtaggttagttaacgttagaataaagacggaaacctaacggtaacccgtaaacggaaaaccggacggtacaacgacgtccttacgttacgtacgtacgtaacccgntaacgtacgttaacggtagtcgaccttagaccgggtaacggaacgggtacgtacgttagtaccgtttgtttacgtagttcgtcgggttaccgggaccgtaggacgtaggttcggg

SEQ ID NO: 115113 - DNA, 849 bp, Homo sapiens
  misc_feature: GYAE6OF02IQRMR.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttcgggttttccttgctgtcttatacgttaaaaggtcgtccaggttgttagaagtgcgtagggtggtgggtaggtcgtagggggacgtccgttagggtaaacggccggttacgggggttccccttaggtacgttccgtccgttggtggtcggtccttacgtcggtattccgtactttacgagttaacgtggtcgtaggtagttggtacggttccgggtccgccgacggtccgtaccgggaaggggtacgggtcgtagggtagggttcggggttacggtaaccgtttaacggtaaaagttaaaagtaggtaacggttaggtaacggtaaagtaaaagtacggtaacgtaaccggtacgaacccgtaaccgggtaaagggtaaacgtaaacggtacttaaccgtaaccgtaacttaccgtaacgtaaagaacgttaacgttaaacttaaaccggtaaaaaggtcggtttaacgttaacgttaacggaactaaagtaccggtaaacctacggtaaaccgaacgtaaaaccggtacggaaccgtaacgtaccgttaccgtaacggtttaactaacccggttataacccgtaagacggtaacgtttaccggaacggtccaacgttagtaaccgaaggtaaggtcgtaacgttgtacgttctaggtacttcggtaccggaccgggtctaacggactggtacccgg

SEQ ID NO: 115114 - DNA, 830 bp, Homo sapiens
  misc_feature: GYAE6OF02H348C.15.86.H09.1.454.CMB.1.raw
  modified_base (570)..(570): a, c, t, g, unknown or other
  misc_feature (570)..(570): n is a, c, g, or t
  modified_base (655)..(655): a, c, t, g, unknown or other
  misc_feature (655)..(655): n is a, c, g, or t
tcagtctacgtagccacgaccggtgctcgatttagtgctatagacttgggtttggggggagaggagccccagccttgggatccccaagtgttttcattcagtgatcaggactgaaacacagaggactcaccagtggagttcgggctgagcgttgggttttccttgctgactatacgttaaaaggtgtccagtgtgaagtgcaggtggtggagttcggtggggacgtccgttagggtaaacgtccggttacgggggttcccgttagtacgttctccgtggttcggtcggcctagtggtatttctacttttcgaagttaacgtggtacgtacggtagttggtacgggtttccgggtacccggaccgtaccggtaccggttaccgggaaggggaacgggggtccggttaggggtacggggtttgggttacgggttaaccgtttaaagaaaaaacggtttaaaagtaggttacggttagggtaagaaaaggtaaaacgtagttaaccggtaggtacgaccgtaaccggtaaaggaacggtaaactcgttaaccacgtacgtactaacggtaaanaagtaacttaaacgttaacgaaaaacggttcgggtttaagtttaacttagaaatttaacgaacgtaacgacgtacccggtaaaanaaaacccggtagaaccgaacgtaccgtactacgtttaacttacgtacgaaacctacgaagttaaccgttagggactaacgcgttaacgaacggggttaactaagggtactacggtttatcggttactttagagttttacgacgggtacccggtacggtaagtaccggtaggttcg

SEQ ID NO: 115115 - DNA, 731 bp, Homo sapiens
  misc_feature: GYAE6OF02IKLTQ.15.86.H09.1.454.CMB.1.raw
  modified_base (581)..(581): a, c, t, g, unknown or other
  misc_feature (581)..(581): n is a, c, g, or t
  modified_base (659)..(659): a, c, t, g, unknown or other
  misc_feature (659)..(659): n is a, c, g, or t
  modified_base (695)..(695): a, c, t, g, unknown or other
  misc_feature (695)..(695): n is a, c, g, or t
tcagtctacgtagccacgaccggtgctcgatttagtgctatagacttgggtttggggggagaggagccccagccttgggatccccaagtgttttcattcagtgatcaggactgaacacagaggactacaccagtggagttcgggctgagcgttgggtttcctgctgctagtctaaagtcgtcctagtgtagacgtgctaggtggtggagtcgtggggacgtccgttagggtaaacggtccggtcgggggtcccttagtacgttccgtccgttggtcggtcggtccttcgtggtatttcgtaccttagtaggtagtggcgtggtacgtggtacggttccgggtaccgtcccgtaggtccgttaaccgggagggtacggggacgttagggtcggtgggggtttaacgtaaccggtttaaacgtaaaaaagttaaaacgtggtaacgtaggttaacgaagtaaagtacgtaacggtacggtacaccgtaaccgggtaaggaaacggtaacgtacttacgaagtactacgtaagaacggaaagttataaaccgttaagaaaaccggtaggtattaggttaacaanaaacgtagaacgtacgaacggtaacgaacgacgtacacggcttacgaacttacggtacacacacgtgactgacttacnctagggtatacggaaggctacgtattgaagtttacngttacggtaacgcggtaaccgtaaggacgtatacgg

SEQ ID NO: 115116 - DNA, 729 bp, Homo sapiens
  misc_feature: GYAE6OF02JYG7D.15.86.H09.1.454.CMB.1.raw
  modified_base (275)..(275): a, c, t, g, unknown or other
  misc_feature (275)..(275): n is a, c, g, or t
  modified_base (462)..(462): a, c, t, g, unknown or other
  misc_feature (462)..(462): n is a, c, g, or t
  modified_base (511)..(511): a, c, t, g, unknown or other
  misc_feature (511)..(511): n is a, c, g, or t
  modified_base (605)..(605): a, c, t, g, unknown or other
  misc_feature (605)..(605): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggtttttccttgcgtgcttatacgttaaaaggtgtccagtgtgaagtgcgaggtggtggagtcgtggggagccgttaggtaaaggccgtgggggtcccttagacgtctccgtgtgtgcctcgngattcactttcaagtatggcgtgatgtaggtcggtccgcgtagccgtcgaagggaggcgtggagtggttaggacgttaacaaagtaaagtgagtggtagaagtaaagtagtagtacggtacgaccgtaaccggtaaggaaacggtaacgtaacgttaccgaaccgtaacgttactaacgaaagtaanaacgttaagttaaaccgaaaaacgggttcgttaagttaactaacgtaanaagtaacgaaacgacgtacgaaacggaacgtaacggacaacgcggaccttaagtacgtttaacacgtaaaccgagtaacgtagttaccggtaancgtaagacccgtaagggtacggtaaagggtccgtcgttaacggtggttttaaccgttagtaaccgttggttaccccggggttaagggtacccccgaaaggggttacccttaacgggttacccgg

SEQ ID NO: 115117 - DNA, 741 bp, Homo sapiens
  misc_feature: GYAE6OF02HF3O5.15.86.H09.1.454.CMB.1.raw
  modified_base (446)..(446): a, c, t, g, unknown or other
  misc_feature (446)..(446): n is a, c, g, or t
tcagtctacgtagccacgaccggtgctcgatttagtgctatagacttgggtttgggggggagaggagccccagccttgggatccccaagtgtttttcattcagtgatcaggactgaacacagaggactcaccatggagttcgggctgagctgggttttccttgctgctatcttaaaaggtgtccagtgtgagtgcaggtggtggagtcgtgggggagccttggtaaagccgtgggggtcccttagagtctcctgtgtggcctctggattctactttcagtaatggtctggagtgaggttcgggtccgccgaggcctccgaaggggaacggggcgtggaggttgggttggtacgtttaacgaaaagtaaaaatgaagtggtagaagtaaaagtaagacgtacggtgacctaaccggtaggaaaggaagtacgttacaactatcctanaagagaattaagttaaccgaaaaacggtacgggttagtttaactttcggaactaaaagtacggtaaacacggtaaccctaaacgggaaaacccggtacggaaacccaacggtaccgtacccggtacttaactttaaccgacggttaacccaacgtaagttaacgttacggaagttaccggataacggtacgtaaacgggttaaagggacggtcttaagttacgttcgttttaagagtttaccggtaccgggtaccgggggttaaccccaacggggttaactacgggtttaccggg

SEQ ID NO: 115118 - DNA, 709 bp, Homo sapiens
  misc_feature: GYAE6OF02FTR35.15.86.H09.1.454.CMB.1.raw
  modified_base (246)..(246): a, c, t, g, unknown or other
  misc_feature (246)..(246): n is a, c, g, or t
  modified_base (694)..(694): a, c, t, g, unknown or other
  misc_feature (694)..(694): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagngtctcctgtgtggcctctggattcacttcagtatggctggatggtaggttcgggtcccgccgaggtcctaccggaaggggtacgggggcgtggggtagggttggggttggtaacggtttacgaaaaaggttaaaagtgtagttgggtagaagtaaaatacgaacgtacggtacgaccgtaccggtaggaaaaggaacgtaacgttaccaaccgtactacgtacgtaagtaacgtaataacttaaccgaaaaacggtcggttagttaagtttagaacctaaagtcgaaactacggacccgtaaaggaaaacccggaggtaaccaacggaaccgtaccgtttactaacgtttaccacggttaaccagtaacgtacgtttaacggatcgactaacgcgtaacggtaaggacggtcttaagtcgttatttagattagtccggtcgggaaccngggtactacggtcgg

SEQ ID NO: 115119 - DNA, 748 bp, Homo sapiens
  misc_feature: GYAE6OF02IC8LR.15.86.H09.1.454.CMB.1.raw
tcagtctacgtagccacgaccggtgctcgatttagtgctatagacttgggttgggggagaggagccccagccttgggatccccaagtgtttcattcagtgatcaggactgaacacagaggactcaccatggagttcgggctgagctgggtttccttgctgctatcttaaaaggtgtccagtgtgaagtgcgaggtggtggagtcgtgggggagtccgttaggtaaacgccgtcgggggtcccttagacgttctccgtgtggtggcctgtggtattcgtacttcagtaatggctggatggaggttcgggtccgcgtaggcctccggaggggacgggtcgtgggtaggtgggttaggtacgtttaacgaaaaaggttaaaactggtaagtaggttaggaaagtaaaagtagtaacgtacggtacgaccgtaaccggtaggaaaaggtaagtacgttacgaacctagtacgtaacgaaacgaagtaactaacgttaaaccgaaaaacggtacggtttacgttaaagttacgtaacgtaaaagtacgaaaaccggtaggtaacctaaacgggtaaaaacccgaacgaaccgtaaccgaacgtaccgtacttaacgttaccgtaactaacccgtagaacggttagtaccggtaagtacgaagtaacgtacggaacggttaaaggcggtaattaacgttcgttacgttagtacgttacgtcggtaccggacccggaaggtacgtaacggttcgg

SEQ ID NO: 115120 - DNA, 802 bp, Homo sapiens
  misc_feature: GYAE6OF02GUZUR.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgttaggtaaagccgtggggggtcccttaggagttctcctgtgtcggcctcgtggtattcactttcagtaatggctggatgtaggttcgggtccgccgaggcctaccggaggggaacggggcgtgggaggttggggttacggtacgtttacgaaaaagttaaaatggaagtggtagaaagtaaaagtagacgtaacggtcgaccgtaacccggtaggaaaacgggtaagtaacttaccaaccgtaagtacctaacgaaaacggtaaagtaactttaaaacgttaaaccgaaaaaaaccgggttacgggtttaagtttaaacgtttaggaaacctaaaagttaacgaaacccggaacgtacccgttaaaacgggaaaaacccggtaaggaacccaaaccggaacggtcccgtttaacttaacgtttaaccgtaaccggttaaccccaaacgtagtaaccgtttacgggaaagtcgtaaccgtaagtaccggtaaacggtaacgggacggtacttaagttcgttaacgttttacgaagttacggttccggtaccggggacccgtaagggtaccgtagggttccggg

SEQ ID NO: 115121 - DNA, 833 bp, Homo sapiens
  misc_feature: GYAE6OF02FOOLT.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttcctgctgctatcttaaaggtgtccagtgtgaagtgcaggtggtggagtcgtgggggagtccgttagggtaaacgccggttgggggtcccttagtacgtcgtcctggtggtcggtcctcgtggtacttctactttcgagtaagtggctgggatggtaggttcgggtaccgccgtaggtcctaccggagggggaacggggtcgtagggaggttggggttaggtacggtttaacgtaaaaaggttaaaagtggtaagttagggtagtaaaggtaaaagtaggtaaccgtaacgggtacggaccgtaaccgggttaggaaaacggggtacgtaacgtttaaccgaaccgtagttaccgtaacgtaaacggtaacggttaaacttaaacgtttaaacccggaaaaaacggttccgggttaatttaacggtttacgaaacttaaacgtacggaaactaccggtaccgtaaacggtaaaaccggaggtaaccacggtacgtacccgtttaattaccgttaacgtaccgttaacccgagttaacggtacgtttaaccggggaattcggacgtaacgtttaccgggaagttaaacggggcgttaacttaggttacctttacgtttagaacgttaccggttacgggttaccgggacccgtaagggtaccgttaggttcccgggg

SEQ ID NO: 115122 - DNA, 871 bp, Homo sapiens
  misc_feature: GYAE6OF02I0I0E.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactacaccatggagttcgggctgagtctgggttttcctgctgctatacttaaaagcgtcagtgtagaagtgacgaggtggtaggagtcggtgggggagccgttagggtaaacgtccggtcgggggtacccttggacgttctaccgttagtggtcggccttcggtaggacttactactttaccaagttaactcggacgtggattggtaacggtttcgggtccgtaccgacggtaccggtaccggaacgggggaacggggtcggttagggtaggggtttacggggttacgggtaacggttttaaaacggtaaaaaaaggttaaaagttaacggtaaggttagggtaaagaaagtaaaaaccgtaagtaccggtaacggtaccgaacccgtaacggtaaggaaaaacggtaagtaaccgtaaccaaaccgtaacttaccgtaacgaaaagaagttaaacgttaaaacgttaaaccggaaaaaaccggttacgggttaatttaaacggtttaacggtaaaacttaaagaacgggtaaaacgaccgttaaaccgaaacgggaaaaaccgacggaaccgtaaacgtaacgcccgttaaattaacgtttaaccgacgttaaaccaacgaagttaacggtaaccgtaaaggtcccaagttaacgtaaggtaacgttaaacggaagttcctaaggtacgtttatttaagagtttacgcccgggttacgggaaacccgtagggacttaagggtccgg

SEQ ID NO: 115123 - DNA, 1070 bp, Homo sapiens
  misc_feature: GYAE6OF02GM6GK.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctattcttaaaaggtgtccagtgtgaagtgcgaggtggtggagtcgtgggggagtccgttagggtaaacggtcccggttcggggggttaccccgtttaggaacggttcccgttcccgttggttcgggttcgggtcccgttcgttcgggtaactttccttaaccgttttaccgtaaggttaaacgttcgggtaccgttagggtaagttagggtaacggtttcgggggtcccccggtacccgacggggtcccgttaccccgggaaggggggtaaacggggggtcccggttagggggtacggggtttacggggggttttaacgggggttaaaccgggtttttaaaccggtaaaaaaaagggtttaaaaaaacgtagggtaaaggtttaggggttaaagggtaaaaacgtaaaaaacggttaacgggtaaaacccggtttaaacggggtaccgggtaaccccgtaaaccccggggttaagggtaaaaaacggggtaaaccggttaacgttaacccgtaaacccgtaacgttaacccgtaaccggtaaaacgggtaaactaaaacgtttaaaaacgttaaaccccggtaaaaaaaaacgggtttccgggtttaaacggttttaaagttttaaaccggaaaccgttaaaaaagtacggaaaacgtaacccggtaaccctaaaacgggtaaaaaacccgaacgggtaaacccgaaccgaaccggttacccgttacttaaacgttaaccgtaccgttaaaccgacgtaaaggttaccgttaacggaagttacggacttaacggtaaccggtaaccggttaaagggtaccggtaattcgttaacggtttccgttttaagaaccgttgttaccgggtacggggtacccgtaagggtaccgttagggttacccggg

SEQ ID NO: 115124 - DNA, 858 bp, Homo sapiens
  misc_feature: GYAE6OF02FHSAP.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttcctgctgctatcttaaaaggtgtccagtgtgaagtgcaggtggtggagtcgtggggagccgttggaaagccgtgggggtcccttagcgtctccgtgtgtcggcctctggacttcgacttttcaagtaatggctggtatggtaggttcgggtccgaccgaggcctaccgaggggtaacgggtcgtaggtaacgttggggttacgtaacgttttaacaaaaaggttaaaaactgtaagtagggttagaaaagtaaaaattacgggaacgtttaaccgggttagacccgtaaccccgggttaagggaaaaagggtaaacgttaacgttacccaaaccgtaacttccgtaaaccgaaaggtacgtaaacttaaacgtttaaccgaaaaaaccgggtacgggtttattaaagttttaccggaataaaacggtacgaaaccgtacggaacccgttaaaggaaaaccccggtagggaacccaaccggtacgtacccgttaacgttaactttaaccgtaccgttaaccgaaacgttaaaggtaccgtttaacggggaaacttcggtaaccgtaacgttaaccgggaacgggttaaacgggaccgggtttaaccctaaggtttaccgtttaacgtttttaggaaccgttttaccggtacgggttaccccggggggaacctaacgggggtaacccttaagggtttacccgggg

SEQ ID NO: 115125 - DNA, 802 bp, Homo sapiens
  misc_feature: GYAE6OF02JAJQO.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttcttgctgctatactaaaaggtgtccagtgtgaagtgcgaggtggtggagtcggtggggacgtaccgttaggtaaacgccggtcggggggttacccttagacggttccttccgtggttggtcggtcctacgtaggtacttccgtaaccttttcaaggttaagtcggtcgtaggtagtggtacgggtttcgggtacccggtccgtacgggtcccgttaacccggaaggggggtaaggggtccggtaggggtagggtttggggttacgggttacgtttaaacgaaaagttaaaacgtaggtagtaggtagaagtaaagtaacggtaacgtaacggtgaccgtaacggtaacgaaacggtaagtactaccacgtataccgtaataaagacgttaacgtaatttaaaccgaaaaacggttacggttagttaacgttaagtaactaaataaccgtaaagaccgtaaccgttaaacggaaaaccggtaacgaactaaccgggacctacgtaccgttaacgtacttaacgttaacctaagtacgtagttacgtaagtagtactaacgtacgggtacgtaaggtacggtaagttagttacggtttgtttaacgtatttacggtcggttaccggaaccggtggtaacgtgttaccggg

SEQ ID NO: 115126 - DNA, 698 bp, Homo sapiens
  misc_feature: GYAE6OF02FM0UR.15.86.H09.1.454.CMB.1.raw
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (374)..(374): a, c, t, g, unknown or other
  misc_feature (374)..(374): n is a, c, g, or t
  modified_base (405)..(405): a, c, t, g, unknown or other
  misc_feature (405)..(405): n is a, c, g, or t
  modified_base (448)..(448): a, c, t, g, unknown or other
  misc_feature (448)..(448): n is a, c, g, or t
  modified_base (506)..(506): a, c, t, g, unknown or other
  misc_feature (506)..(506): n is a, c, g, or t
  modified_base (608)..(608): a, c, t, g, unknown or other
  misc_feature (608)..(608): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccttaggtaaagccgtgggggtcccttagacgtcttccgtgtgtcggcctctggtattccactttcagtaagtggcgtggagtgtaggttcgggccgcgaggccnccggaggggacgggngtggnggttgggttggtacgtttacgaaaagtaaaanggaagtggtagaagaaataggacgtacggtnacgaccggtaggaaacggaagtacttaccacctaataccgtanaaagtaagtaacttaacgtaaacgaaaacggtcggttaagtttagtttacgactaaanaccgaaacgtacgaccgtaaaccggaaaacgacggtaacacgaccgtaccgttacttacttaacgtacgtaacctaagtaccggtagttaacggacggttanacgtacgtacggaacggtacggagtaacgtagttacttacgtttagtagttccgtagggtcccgggaaccgtagggtacctaggtccggg

SEQ ID NO: 115127 - DNA, 1019 bp, Homo sapiens
  misc_feature: GYAE6OF02HQ17C.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtagaagtgcaggtggtggagtcgtgggggagtccgttaggtaaacggtccggttacggggggttccccttaaggtacgttccgttcccgttacggttcggttcgggtaccccgttcggttcgggtaacttttccgttaaccgtttttacgtaacggtttaaacggttcggggtccgttaggggtaagttaggttaacggggtttccggggtaccccggtacccggacgggtcccgttacccgggaaaggggggtaacggggggtacccggttagggggtaggggtttacgggggtttaggggttaacccgttttaaaacggtaaaaaaaggtttaaaaaggttcggtaaggtttaggggtaacggtaaaggtaaaaaaggttacgggaacggtttaaccgggtccggaacccgtaacccggttaagggaaaagggtaaacgtacgttacccaacccgttaactacctaacgaaaggaacgttaaacttaaaacgtaacccgtaaaaaaccgggtaacggtttacggttttaaagtttacggtaaaccttaaaagtacggtaaaccgtaaccggtacccggtaaacggaaaaaccccgggtagaaacccggtaaccgaaccgggtacccgtttacgttaacgtttaaacccgttaccggtaaccccgtaaccggtaacgttaacgggttaaacggtaacggtacctacgtaacggttacccggtaacgggttaaaaggacggtaacgttacggtttggttaacctttttaggtaacctttacggtaccgggtacccgggtacccggtaagggtacccggtagtttaccggg

SEQ ID NO: 115128 - DNA, 956 bp, Homo sapiens
  misc_feature: GYAE6OF02F9HTE.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttcctgctgctatacttaaaagtgtcagtgtgaagtgcgaggtggtggtaggtcgtgggggacgtccgttagggtaaacggtccggttcgggggggttaccccttagggtacgttccgtccgttggtacggttcgggtcccttcggttacggtactttccgtaaccttttcgaaacgttaagtggtcgttaggtagttcggtaacggttccgggttcccgacgtacgggtccgttacccggaagggggaagggggtccgtagggggtacgggtttacgggggttaacggggttaaccgtttaaaaccggtaaaaaaggttaaaaacggtacggttaaaagggtttggggttaaaggtaaaacggggttaaaaacgttaacgggtaaaccggttaccggggtaaccgtacccgggtaaacccgggttaaacggggtaaaaaccgggaaacggttaaccttaaccgtaaccccttaagttaacccgttaaaccggaaaggtacgttaaaacgtttaaaccgttaaaaccggtaaaaacgggttacggttagtttaacgttaacgaaccgttaaaagtaccgtaaacgtaccgaacccgttaaaggaaacccggtaacgtaaccgaaccgtaccggtaaccggttacttaaccgttacgtaccgtaaccgtactaaacggttcggttaacgggtaaactcgtaaaccgttagtaccggtaaacgtaaggtcgtaaccttgttaaccgttcgtttaacggattaccggtacggtcccggggaacgtacgaccggtaaggttcccg

SEQ ID NO: 115129 - DNA, 820 bp, Homo sapiens
  misc_feature: GYAE6OF02FZ92H.15.86.H09.1.454.CMB.1.raw
  modified_base (809)..(809): a, c, t, g, unknown or other
  misc_feature (809)..(809): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttcctgctgctatcttaaaaggtgtccagtgtgaagtgcgagggtggtggagttcgtgggggagtccgttagggtaaagcccggttggggggtcccttaggagtctcctgtgtcggtcctcgtggtacttctactttcagttaatgggtctggtagtggtacggttcgggtcccgcgacgggcctaccggaaggggaacggggcgtaggggtagggttggggttacgggttaacgtttaacgtaaaaaggttaaaagtagtaggtaggtagaaggtaaaacgtagaacgtacggtacgtaccgaaccggtaaggaaaaggtaacgtaacgttaccaacctagtacctaacgaaagtaactaaagttaactaaaccgaaaaacgggttacggttaagtttaacgtttagaaactaagttaaccggtaacgtaaccggtaccgtaaaacggtaaaacccggaggaaacccgtaaccggtaccgtacccgttaacttaaccgtttaacgtacccgtaaccaacgttaaccgggttacgtttaccgggaaagtacggaccttaacgggttaccgtaacgggtaagggtacgtaacgttagttacgtttccttttaagacgtttagtcccgggtacggggaacccggtacggtaacgnggtttcccggg

SEQ ID NO: 115130 - DNA, 722 bp, Homo sapiens
  misc_feature: GYAE6OF02JY2GP.15.86.H09.1.454.CMB.1.raw
  modified_base (587)..(587): a, c, t, g, unknown or other
  misc_feature (587)..(587): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagcgtgggttttccttgctgctatacttaaaaggtgtaccagtgtgaaaagtgcgaggtggtggagtcgtaggggtagtccgttaggtaaacggtccggtgggggttacccgtttaggacgtccgttaccgtggtggttcgggtcccgttcgttcggtactttccgtaccgttttacgaagttaagtggacgttggtagtcggtacggttcgggtcccggcgacggtcgtaccggaaggggaacggggcgtggtaggtcgggttaggtacgtttaacgaaaaagtaaaagtgtacgtaggtagaagtaaagtagtacgtaggagaccgaacgtaagtaaggtaacgtatcaacgtatcgtacgaagaagtaataactaacgaaaaccgtggttagttaatacggaactaaagtacgaaacagtaaccgtaacggaaaaccgngaaacgtacaacgtcctaacgtatacgtaccgaactagtacaacggttagagtacagtacgtagggaccgtaagcggtaacttagtccttagttagtacgtgtacgggaccggtacggtaagtacgtaggttcgg

SEQ ID NO: 115131 - DNA, 822 bp, Homo sapiens
  misc_feature: GYAE6OF02HGKUU.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcaccatggagttcgggctgagtcgttggttttcctgctgctatacgttaaaggtgtccgagtgtagaagtgcgtaggtggtggagtcggtggggactcgttaggtaaacgtccggttcgggggttacccttaggtacgttcctcgtggtcggtcggccttcgtggtacttccgtactttacgaagttaagtcgtacgtggtagttaggtcggttcgggtccgccgtacggtcctacggaggggtacggtacgtggacgggttgggttacgtacgtttaaacgaaaaggttaaaatgtagttaggacgtaaaagtaaataggtaacgtacggtagtaccgtacggtaagaaacggtatactaccactagtaccgaagaacgtaatactaacgtaacgaaacgggtcgttagttagttacgaagtaaacgtcgtaaacgtagtaccgtaaacgtaaaacggacgtacaaccggttaaccggttaccttaacggttaaacgtttaccgaaccggttaaacccgaagttaacggttaaaccggtacgttaaacgacgtaccgttaaacgtaaccggttaaaccgggtaaaggtcccgttaaacgtttacgggttaacgtttttaacggttaactaaccggttttcgggaacccgggtttccggggaaacccgtaacgggttaccgttaacggtttcccggg

SEQ ID NO: 115132 - DNA, 896 bp, Homo sapiens
  misc_feature: GYAE6OF02F1G74.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctggttttccttgctgctatacttaaaaggtgtccagtgtgaagtgcaggtggtggaggtcgtgggggagtccgttaggtaaacggccggttcggggggtaccccgtttaaggtacgttccgtcccgttggtgttacgggtccctcgtgggtactttccaacttttccgaagttaagtcggtaccgttgggaatacggtaggtttcggggtcccgaccgtaggtccgtacccggaagggggtaaacggggggtccgttaggggacggggtttacgggggtttacgggtaaaccggttttaacgtaaaaaaaaagggttaaaaaagttcggggtaaaagttcggggttaaataaaccggtaaaaaagttaaccgggtaaacgtaaccgggttaggacccgttaacccggttaggaaaaaggggaacttaacgtttaacaaccccgtaattcgtaaccgaaaggtaacgaaacttaaacgttaacgaaaaaacgggttacggtaacgttaagtttaacgacgtaaaatacgaaaacgacgtaaacccgtaaacggaaaaacccggtaggtaaaccgaaccggtaacgtacccgtacttaaacgttaacgtaaccgttaaccaacgtaagtaacccggttaaggaacgtacggaacacgttaccgtaacggtaaacggacggtactaagttagtcgtttaagacgtttacggtaccggtacgggacccctaagggtaccgtaaggttacgg

SEQ ID NO: 115133 - DNA, 665 bp, Homo sapiens
  misc_feature: GYAE6OF02F4A56.15.86.H09.1.454.CMB.1.raw
  modified_base (198)..(198): a, c, t, g, unknown or other
  misc_feature (198)..(198): n is a, c, g, or t
  modified_base (425)..(425): a, c, t, g, unknown or other
  misc_feature (425)..(425): n is a, c, g, or t
  modified_base (466)..(466): a, c, t, g, unknown or other
  misc_feature (466)..(466): n is a, c, g, or t
  modified_base (522)..(522): a, c, t, g, unknown or other
  misc_feature (522)..(522): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaggtgtccgagtgtagaagtgngtaggtggtggtagtcgtggggagtccgttaggtaacgtccggttcggggtcccttagagtctccgtgtgtgcctcgtgtattctactttcgtaagtaagtggcgtggtagttggtaggttcggccgtccgcggcctacggagggtaggggtcgtgggtggttgggttaggtaagttaacgtaaaaagtaaagtgtaagtgtaggtaaataaagtagtacgtacggngaccgtaccgtagaaagactactactacatacgacaagtanaatataacgaaacgtggtatacttgaactagtacaagtaccacgtaacggaaacgngaactacacgtccgtattaatacacgtacccagaagttacgtcgtaagtcgaaacgtacgtacgtaagggtaacgacgttagtacgttgttacgttacggtaagttggacccggttcgggtaacggacggtacgttagtcggg

SEQ ID NO: 115134 - DNA, 739 bp, Homo sapiens
  misc_feature: GYAE6OF02FY4EK.15.86.H09.1.454.CMB.1.raw
  modified_base (325)..(325): a, c, t, g, unknown or other
  misc_feature (325)..(325): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggagttcgggctgagcgtggtttccgtgacgtgctatacttaaaaggtgtaccagtgtgaagtgcgaggtggtggagtcgtggggagtccgttggtaaagccgtagggggttaccccttagacgtctccgttgtgtgccgtcgtggtattctacttacagtaatggtctggtatcggtaggttcggtaccgccnggtcctaccggaaggggtaacggggcgtggggacggtttcgggttacgggtaacgtttaacgaaaaagttaaaactggtaacgtaggtagtaaagaaaagtagtaccgtaacgtacgtaccgtaaccggtaaggaaaacggaacgttacgttaccaaccgtaataccgtaagtaaagacgtaaactaataaccgtaaaaacgtacggttagtacgtttagtaactaaagttaacgaacgtaacgtccgtaaacgaaacggacggaacaacgacgtacctattaacttacgtaagtacccaagtagttaacgtcggaactacgacgtagttaccgaagggtaaggtcgtaaccgtaagtcggttacttaggtaccttaacgtccggtaggtaccccgaggttaacgtagttccgg

SEQ ID NO: 115135 - DNA, 740 bp, Homo sapiens
  misc_feature: GYAE6OF02F11B2.15.86.H09.1.454.CMB.1.raw
  modified_base (344)..(344): a, c, t, g, unknown or other
  misc_feature (344)..(344): n is a, c, g, or t
  modified_base (434)..(434): a, c, t, g, unknown or other
  misc_feature (434)..(434): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttgggggggagaggagcccccagccttgggatcccccaagtgttttcattcagtgatcaggactgaacacagaggactcaccatggagttcgggctgagctgggttttccttgctgctatacttaaaggtgtccagtgtgaagtgcgaggtggtggtagtcgtgggggagtccgttaggtaaagcccggttgggggtccccttaggacgttccttccgttggtcgtcgggtcccttcgtggtacttctacctttacagttaatggcgtggatggtaggttcgggtcccgccgnggtcctccggaggggaggggcgtgggaggttggggtaggtacgtttaacgaaaagtaaaatggtaagtggagaagaaatagacgtacggnaccgaccggtagaaaacggtagtactacactatcaacgaagataattaaagtaaccgaaaacggtacgttagttaagtttgaaactaaacgagtaaaccncggtaaccttaaacgggaaaacccgaagaacccacgaccgtacccgttagttaaccttacggtacccgaacgtaacgtagggttaacgtttacggaaagtcgaacctaggtaccggaaggttaacgggacgttactaacgttggttaacgttttagtaagttacgtccggggtaacccgggacttaacgggacgtacggttccggg

SEQ ID NO: 115136 - DNA, 677 bp, Homo sapiens
  misc_feature: GYAE6OF02H10OS.15.86.H09.1.454.CMB.1.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (572)..(572): a, c, t, g, unknown or other
  misc_feature (572)..(572): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttggctgagctgggttttccttgctgactatacttaaaaggtgtccagtgtagaagtgnaggtggtggagtcgtggggagtcgtggtaaagccgtgggggtccttagcgtctcctgtgtgcctctggattcactttnagtaagtggtactggtatcggtagttcgggttccgcgtacggcgtaccgaggggaaggggctgggaggtgggttggtaaccgtttaagaaaaagtaaaatggaagtggtaagaaagtaaaacgtagtaacgtacggtagccgtaaccgaaggaacgtaaagtacttacgaacctagttacaacaagaagtaacttaaacttaacgaaaaacgtcggtaagtttacgtagaactaaaaggtacaacgaacgtacgtaaggaaaccggaagtacgaactacgtacgtacttaataccgtanaccgaatagtacttacgaagtcagaagtaccgaggtaaacggcgtacgtagttgtactttagattaccgtacggtaccgggacccaaggggtacctaaggtccgg

SEQ ID NO: 115137 - DNA, 832 bp, Homo sapiens
  misc_feature: GYAE6OF02H4HY7.15.86.H09.1.454.CMB.1.raw
  modified_base (213)..(213): a, c, t, g, unknown or other
  misc_feature (213)..(213): n is a, c, g, or t
  modified_base (292)..(292): a, c, t, g, unknown or other
  misc_feature (292)..(292): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtctggggganccgttggtaaagtccgtagggggtcccttagagtcctccgtgtgtggcctcgtggattcactttcagtaatggcgtggntgaggttcgggtccgccgaggtcctacccgaaggggacggggtcttagggacggttgggttcggtaacgttttaacgaaaaaggttaaaagttggtaagttagggttagaagtaaaaagtacggaacgtacggtacgaccgtacccggtaggaaaacgggtaagtacgttaccaaccgtaagtaccttaacgaaaggaggtaaacttaaacgtttaaaccggtaaaaaaaccgggtacgggtttaacgtttaaacgtttaggaaaccgtaaaaagttacgggaaaactaccggaaacccgtttaacggaaaaacccggtaagggaaccaaaccgtacgggtaacccgtaacttaagtttaacccgtacgtttaaacccaccggttaaagtaaccggtttaacgggtaaacggttacgaaccgtaagttaacccggtaacggggttaaacgggacgggtacctttaaggtcgttacgtttttaggacctttacggtccggttaccgggtaccccggtaagggtacctaaggtttaccgggg

SEQ ID NO: 115138 - DNA, 772 bp, Homo sapiens
  misc_feature: GYAE6OF02G7OON.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagagactcacatgagttcggctgagcgttagggttttccttgctgtcttatacgttaaaggtcgtccagtcgtagaagtgcgtaggtaggtggtaggtcggtggggacgtaccgttaggtaacggtccggtacgggggttacccttaagtcgtcctccgttgtaggtcgtccttcgttaggtaccttctacgtttcgtaagttaagtggtacgtaggtagttcggttacggtttccgggaccccgtcgaaccggtccggtacgggaaggggtaacgggtcgtagggtaacgggttgggttaacgttaacgtttaaaagtaaaacgtaaagtagtaggtagtaacgtaaagtaacgtacggtacgtacgtacgtacgacgtaagtaagactactaccactacgtctaagagaataactaagtaacgtaacggtagtatttacctaagaagtacaacgtacaaccggtaaccgaaacgaacggtacgacgtaaccgtacccgtacgtaacttaccgttaacgtaaccctacgtacgtagttaccggtaaccaggtcaaacgttacgtaacggaaggttaaggtctaaaggttacgtaccgttagtaacgttacgaccgggttcccggaaccgtaacggtacgttacggtgttccgg

SEQ ID NO: 115139 - DNA, 712 bp, Homo sapiens
  misc_feature: GYAE6OF02G0FY4.15.86.H09.1.454.CMB.1.raw
  modified_base (384)..(384): a, c, t, g, unknown or other
  misc_feature (384)..(384): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttggtaaagccgtgggggtcctagagtctcctgtgtggcctctggattcactttcagtatggctggatgagttggtccgcaggctccgagggaacggggcgtggaggttgggttcggtacgtttacgaaaagtaaaatgagtggtagaagaaatgacgtacggngaccgtaccggtagaaaggtagtacttacaacctatctagaagataattaaactaaccgaaaaacggtcggttaagttaatttacgaataaagtgaaacctacgtacctaaaggaaaacccggaggaccaacgtcgtacctaacttacttaaccgtacgtaaacccagtaacggttaacgttacggggtaaacgtcgtaaccgtacgtaaccgggttaacggtaaacgggtacggttaaccgttaaagtttcggtttaaccgttttaggaactttaccggttccgggtaccgggggaaccccgtaaggggtaactaggtttcccgggg

SEQ ID NO: 115140 - DNA, 889 bp, Homo sapiens
  misc_feature: GYAE6OF02JX7KS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccagtggagttcgggctgagcgttgggttttccttgtctgctatacgttaaaaggtcgtccagtgtgaagtgcgagggtggtggtagtcggtgggggacgtccgttaggtaaacggccggttcgggggtacccgttaaggacggttccgtccgtggtcggtcggtcccgttcgtaggtacttccgtacgtttacgtaagtaagtcggcgtggtagtggtaggttcgggtcccgccgaggtccgtaccggaagggggtacggggtcggtagggtagggttacggggttacgggttaaccggtttaaacggtaaaaaaggtaaaaagtaggtaaggtagggtaaggtaaacgtaaaaggtaacggtaacgtacggtacgtaccgtaacccggtaaggaaacggtaagtaactacgtaaaccgtacttaacgtaacgaaaggtaacgtaaacgttaaacgtaaaccggtaaaaacggtacggttaacggtttaaagttaacggaaacgtaaacgtaacggtaaacgtaaccggtaaccgtaaacgggtaaaaccgtaacgggaaccgtaaaccgtaccgtaacccggttacttaacggttaacctaccggttaacccgaacgtacgttaacgttacggtaaagtcgtaacgtaaccggttaacgtaacgggttaacggtcggtaacttaggttacggtttacgtttaggtagttaccggttacggtaccgggtacccggtaagggtacccttagggttcccgg

SEQ ID NO: 115141 - DNA, 596 bp, Homo sapiens
  misc_feature: GYAE6OF02IK17G.15.86.H09.1.454.CMB.1.raw
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtccttagagtctcctgtgtggctctggattcactttcagtaatggctaggatgagttggtccgcaggctccgagggagggctggagtgggtgacgttcaaaagtaaaagtgagtggtagaagaaaatagactaggtcacgacccgtagaaacggaagattacacatctacaagagataatacaaaacgtacggtatagtttanacaaatgaacngacctaggaaaaccgnggaacacganccgtactaacttaccgtataaccgacagtacgtcgaagtgctagtcgaagtaaggcggtactagtcggtacttttgaactttacgtacggtcgggtaacccgaggacgtaagttccggg

SEQ ID NO: 115142 - DNA, 1024 bp, Homo sapiens
  misc_feature: GYAE6OF02FV8C7.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttccttgctgctatacgttaaaaggtgtccagtgtgaagtgcgaggtggtggagtcgtgggggtacgtccgttaggtaaacggtccggtcgggggtccccgtttaagacggttcccgttcccgttggtcggttcgggtaccccgttcgttacgggtacgtttaccgtaaccgttttaccgtaacggtttaaacgttcggggtaccgttagggtaaggttcgggttaaacggggtttccgggggtaccccgtacccggtaacggggtcccgttacccggggtaaacgggggtaaacggggggtccggttaggggggtaacgggttgggggtttaaccggggttaaaccggttttaaacggtaaaaaaacggtttaaaaaacgttgggtaaacgtttagggttaacggaaaaggtaaaaagttaacggaaaccggtttaccgggtacgtaacccgtaaaccccggtaggaaaaacgggtaacgttaacgtttacccaaaccgtacgtaacccttaacggaaacgttaacgtaaacgttaaaccgttaaaccgtaaaaacgggttaccggtttaacggttaacgttttacgaaacgttaaaacgtacgtaaaccgtacggtaaccccgtaaacggtaaaaacccggcggttaaccgaaacccgtaaccgttacccgtttaagttaacctttaaaccgtaccggttaacccgtaaaccggtaaacgtaccggtttaacgggtaacgtaggtaaaccgtaccgggtaacgtacccggttaaagggacggttaacctacggtttacggttacgttttaacgacgtttaccggtacgttcccggggtaacccgacggttaacggtaccgttcccgggg

SEQ ID NO: 115143 - DNA, 1013 bp, Homo sapiens
  misc_feature: GYAE6OF02FVLN8.15.86.H09.1.454.CMB.1.raw
  modified_base (903)..(903): a, c, t, g, unknown or other
  misc_feature (903)..(903): n is a, c, g, or t
tcagtctacgtagccacgaccggtgctcgatttagtgctatagacttgggttgggggggagaggagccccagccttgggatccccaagtgttttcattcagtgatcaggactgaacacagaggactcaccatggagttcgggctgagctggttttcctgctgctatacttaaaggtgtcagtgtgaagtgcgaggtggtggaggtcgtgggggatccgttagggtaaaacggtccggttggggggttccccttaaggtacggttccttcccgttggtcggtcgggtaccccttcgtcgggtaactttccactttttaccaaggttaaatggggtaccttagggacgttcgggttaagggtttcgggggtaccccgtaccggtaacgggtacccgttcccggggaaaagggggggtaacgggggggaccgttggggggtaacggggtttcggggggtttacgggttaaaccgggtttttaaacggtaaaaaaaaggtttaaaaaagggttacgggtaaaggtttaacggggttaaaggtaaaaggtaaaaaaagttaccgggtaaaccggtttaaccggggtcggtaaaaccccggtaccccgggtttaaagggaaaaaacgggtaaacggttaactttacccgaaaacccgttatttaaccccaacggtaaaggaacgttaaaacgttaaaaccgtttaaaccgaaaaaaaccggggttacgggttaaacgttttaacggttttaacggaaacccggttaaaaataaccgggaaaattccgggtaaaccccgttaaaagggaaaaccgaaaccggtaccgaaaccgaacgttacccggtttaacttaaccggtttaaacctacggttaaccccgaaagttacggtaacgttacgggaaacgtnacctaaggtaacggtaacgggaaacgggtacgtaacgttagttacgttacttttaggaacctagttacccgggacgggggtacccggaacggtaacgttacgggtacggg

SEQ ID NO: 115144 - DNA, 946 bp, Homo sapiens
  misc_feature: GYAE6OF02JNY84.15.86.H09.1.454.CMB.1.raw
  modified_base (184)..(184): a, c, t, g, unknown or other
  misc_feature (184)..(184): n is a, c, g, or t
  modified_base (535)..(535): a, c, t, g, unknown or other
  misc_feature (535)..(535): n is a, c, g, or t
  modified_base (643)..(643): a, c, t, g, unknown or other
  misc_feature (643)..(643): n is a, c, g, or t
tcagtctacgtagccacgaccggtgctcgatttagtgctatagacttgggtttggggggggagaggagccccagcctttgggatccccaagtgtttttcatttcagtgatcaggactgaacacagaggactcaccatggagttcggctgagcttgggttttccttgctgctatcttaaaaggtntccagtgtgaagtgcaggtggtggagtcgtgggggacgtccgtttgggtaaacgtccggttcgggggggtcccttaggtacgttcgttccgtggttcggtcgggtcccttcgtggtacttccttacttttcagttaactggtacgtggagtgtaggttcgggtcccgcgacggccgtccgaagggggaagggtcgtgggtaggttgggttaggtacgtttaacgaaaaaggttaaaacgtggtaagttagggtaggaaaggtaaaagtcgtaaacgttacggtacgtaccggtaacccggtaaggtaaaacgggtaagtaacgttacgtaacccgtaaacttcccggtaanaaacggtaacgtaaactttaaacggtttaaaacccggtaaaaaacggttcggggttttaaaccgtttaacggttttaggaaaaccctaaaagtaccgggtaaaaaccncgggttaaaaccccggttaaaccggtaaaaaacccgggaacggggaacccgtaaaaccgtacccgggtaacccgggtttaaccttttaaactttaaccggtaacccgtttaaacccgaaacgtaaacgggtttacggtttaaacccgggtaaagttaccgaacccgttaacttaaacccggggtacggttaaaaacggggtacgtacgttttaaacggtcgggtttaaacccgttttagtacgtttaaccgttacggggtttcccgggaaacccgggttacgggtagttacccggttcggggg

SEQ ID NO: 115145 - DNA, 746 bp, Homo sapiens
  misc_feature: GYAE6OF02INYLX.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctcgtggattctactttcagtaagtggcgtggatgtaggttcgggtccgccgaggcctaccggaggggaggggcgtgggtaggttggggttggtacgtttaacgaaaaggttaaaatggtaagtggttagaagtaaaagtagacgtacggtacgaccgaacccggtaaggaaacgggaaagtacgttaccaaccgtactactaaccgaaagtaagtaacttaaacgttaaacgaaaaaaccggttacggttacggtttaatttacgaacgtaaaagtacgaaactacgtaaccgtaacggaaaaaccggacggaaccaacgaacgtccgtaccttaacttacgtacggtaaccacgtaacgtagtaacggtaacgtacgaccgaagtaaccggtaacggtaaagggacggtaacgttagttacgttacgttttagagttacgttacgggtaccgggtcccgtaagggtacccgtaggttccggg

SEQ ID NO: 115146 - DNA, 650 bp, Homo sapiens
  misc_feature: GYAE6OF02H2UEI.15.86.H09.1.454.CMB.1.raw
  modified_base (267)..(267): a, c, t, g, unknown or other
  misc_feature (267)..(267): n is a, c, g, or t
  modified_base (582)..(582): a, c, t, g, unknown or other
  misc_feature (582)..(582): n is a, c, g, or t
  modified_base (587)..(587): a, c, t, g, unknown or other
  misc_feature (587)..(587): n is a, c, g, or t
  modified_base (613)..(613): a, c, t, g, unknown or other
  misc_feature (613)..(613): n is a, c, g, or t
  modified_base (617)..(617): a, c, t, g, unknown or other
  misc_feature (617)..(617): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagcgttaggtaaacgccgtgggggtccttagacgtcttctgtgtggcctntggattctactttcaagtaatggctggatggaggttcgggtcccgccgaggtccgtacggaggggtaagggtcgtagggtagggttggggttacggttacgtttaaacaaaaaggttaaagtgagtaggtagaaagaagtagtacgtacggtcgaccgtacgtaaggaaaggaatactacactatacgagaaagaagtaattaacgaaacgaaaacggtgttaacgtttattacgaataaagtacaacgcgtaaacctaaggaaaccgagacaacgtcgactacttattaccgataccaagtagtacgttacganacganacgtagaacgtaggtgtactattgtnttanagttacggtcggacggacgtaaggatagttcgg

SEQ ID NO: 115147 - DNA, 895 bp, Homo sapiens
  misc_feature: GYAE6OF02HDG8D.15.86.H09.1.454.CMB.1.raw
  modified_base (665)..(665): a, c, t, g, unknown or other
  misc_feature (665)..(665): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttggctgagcttgggtttctgctgctatacttaaagtgtccagtgtgaagtgcgaggtggtggaggtcggtggggacgtccgttaggtaaagccggttcgggggtccttaggacgtctccccgtgtggtcgcctcgtggtacttctacttacgaagttaacgtggcgtaggtagtcggtaggttcgggccgtccgacggtccgtcggaacgggggaggggcggtacgggtaggggttggggttacggttaaccgttttaaacgaaaaaaggttaaaacgtggtaacggttagggttaagtaaaaggttaaaaacgtaacggtaaccgttacgggtacgtaaccggtaaccggtaaagggaaaacggtaacgtaacttaccgtaacctacgttactaacgaaagtaacgtaaatttaaaccgtaaacgaaaaacgggttcggtttaagtttaagttaacgaaaacttaaaggtaacgtaaaccaagtaaccggtaaaacggaaacccgtagggaaccaacgggttaccncccgttaagtttacctaacgttacccggtaaaactcggtaacgttaacgggtacccgttaaagggtccgtaaacgttaaccgggtaaacccgggttaaaagggtaaaccggggttggttaaacccgtttggttacccggttttaaggttttaaacggaccgtttttaacggggttcccggggacccggggaacccggttaacggggtaacggtcggggttttaccccggg

SEQ ID NO: 115148 - DNA, 736 bp, Homo sapiens
  misc_feature: GYAE6OF02JVPGC.15.86.H09.1.454.CMB.1.raw
  modified_base (314)..(314): a, c, t, g, unknown or other
  misc_feature (314)..(314): n is a, c, g, or t
  modified_base (382)..(382): a, c, t, g, unknown or other
  misc_feature (382)..(382): n is a, c, g, or t
  modified_base (447)..(447): a, c, t, g, unknown or other
  misc_feature (447)..(447): n is a, c, g, or t
  modified_base (579)..(579): a, c, t, g, unknown or other
  misc_feature (579)..(579): n is a, c, g, or t
  modified_base (645)..(645): a, c, t, g, unknown or other
  misc_feature (645)..(645): n is a, c, g, or t
  modified_base (698)..(698): a, c, t, g, unknown or other
  misc_feature (698)..(698): n is a, c, g, or t
tcagtctacgtagccacgaccggtgctcgatttagtgctatagacttgggtttgggggggagaggagccccagccttgggatccccaagtgttttcattcagtgatcgaggactgaacacgaggacgacctcacctagtggtggttcgggctggacgtcgttcgggttttccttggtctacgtcgttacttaacggttaaaacggtcgtccgtaggttagtaggtaagttcggacggtaggttcgggtggtacgtcggtggggtacgtcgttaggtaacgtccggtcgggtcctagtcgtctcgtgtgtcgctntgtctctcgttcagtatcggactgagtgtaggttcggccgtgacggtccgtacggaagggacggggtntaggtaggttcggtacggtacgttaaacgaaaaggtaaagtgtagtaacggtagaaagtaaacgngtacgacgttcgaccggacgtaagaagtacacttacaacgtctacaacgataacgtaataactaaacggtaaacgtcggttaattgtacgtaaacaaagttcgaaacccaggttacccgaaaggaaacccgngaaacgtccgtaaaccggtccttatacgtttacaaccgttaccgaactaggtaccgttacacggtntaccgaaggttaaaccgaggaacgtagttctagttatccgtaagttggtaacnccggggtacccggttaagaccgtttacgaggtaccggg

SEQ ID NO: 115149 - DNA, 908 bp, Homo sapiens
  misc_feature: GYAE6OF02I8WFJ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgcatcttaaaaggtgtccagtgtgaagtgcgaggtggtggagtcgtgggggagccttggtaaagccgtgggggtcccttagagtccgtcctgtggtaggcctcgtggtacttcacttttcgagttaagtggtactgggtatggtaggttcgggtcccgccaggccgttaccgaggggaacggggtcgtgggagggttggggttacggtacgttttaaccgaaaaaagttaaaagtcgtaagtggttacgaaagtaaaataggtaacgttaaggtcgaccgtaacccggttaggaaaaggtaacggtaatttccgaacctaactacgttacgaaaaggtacggtaaactttaaacgttaaccgtaaaaaaccggtaccgggtttagttaagtttttaacggaacgttaaaacgtaacggtaacgtaacggtacccttaaacgggaaaaacccgtaacgggtaaaccgaaaccggtaacgtaacccggggtttaccgtttaaaacgtttaaccgtttaaaccgttaaccccgtaaacgttaaaccggggtaaccgtttaacggggaaacggttttaccgaaccggttaacggttaacccgggaaaacgggtttaaacggggaacgggttaccgtttaaacggttacggtttaaaccggtttttaggtaaccgtttaacggttacccggggtttaacccggggaacccccgggtaaggggtaaccccgggttaaggtttaccccgggg

SEQ ID NO: 115150 - DNA, 776 bp, Homo sapiens
  misc_feature: GYAE6OF02HQKTC.15.86.H09.1.454.CMB.1.raw
tcagtctacgtagccacgaccggtgctcgatttagtgctatagacttggggtttgggggggggagaggagccccagccttgggatccccaagtgtttcattcagtgatcaggactgaacacagaggactcaccatggagttcgggctgagctgggtttccttgctgctatctaaaaggtgtccagtgtgaagtgcgaggtggtggagtcgtgggggagtccttgggtaaacgtccgtggggggtacccttagacgtcttcctgtggtcggcctcgtggattcactttcgagtaagtggcgtgagtggtaggttcgggtccgccaggcgtccgaggggagggcgtggtacggtgggttaggtaccgtttaagaaaaacgttaaaagtgtagtgggtagaaacgtaaaagtagtaaccgttaggacgtaccgaacccggtaaggtaaaacgggaaacggttactaccaaccgtaacgtacctaagaaagaaggtaacttaaacttaaaccggaaaaaccggttcgggtagtttaacgtttaaggaacctaaagtaggaaacgtaccgtaaccgtaacgaaaaaccgggctaacgaacgacgtacccggtattaacgtacccttaggaacctaaccgtaagtacgttaacggaacggtacgtaactaccggtaagggtaaaccggtaaagggggtacctacgttaagtcgggttacttttaacgggattcggtacccggtcccgggggttaccgaaggttaccggtaacggttaccggg

SEQ ID NO: 115151 - DNA, 814 bp, Homo sapiens
  misc_feature: GYAE6OF02H67DD.15.86.H09.1.454.CMB.1.raw
  modified_base (215)..(215): a, c, t, g, unknown or other
  misc_feature (215)..(215): n is a, c, g, or t
  modified_base (709)..(709): a, c, t, g, unknown or other
  misc_feature (709)..(709): n is a, c, g, or t
tcagtctacgtagccacgaccggtgctcgatttagtgctatagacttgggtttgggggggagaggagccccagccttgggatccccaagtgtttttcattcagtgatcaggactgaacacagaggactcaccagtggtagttcgggctaggagtcgttggggtttttccttgtcgtgtcttattaacgttaaaaggttcgtcagtgtagagtggngtaggtggtggaggtcggtgggggagtccgttaggaaacggcggttcgggggttcctaggcgttcctcgtggtcggtcggccgttacgtcggtaatttaccgttacttttacgtaagttaacgtcggtgtagggtattaggtacgggtttccggggtcccgaccggtaggtaccccggttacgggtaacggggaccgggggtacggttgggtacggggttaggggttaccggttaaacggtaaacgttaaaaaggtaaaagttggaaggttacggaaagtaaggtaaaacgtaacggtaacgtacggacgtaccggtaaacgtaaggaaacgggaacttactacgacctatacgtacgaacgtaataacttaagttaaaacgaacggtaggttaatttcgaaagtaagtaaagacgtaacagtaacgaaacgaacgagacaacgtccttaccgtataacgttccttaaacgctacgtaattaacggtagaacgntaacgtacggaacggtaagtaagtacgtcgttaaggttctttaacggtttaactacggttcggtacccggggaaccggtaccggaacggttaacgtcggttccgg

SEQ ID NO: 115152 - DNA, 788 bp, Homo sapiens
  misc_feature: GYAE6OF02GP658.15.86.H09.1.454.CMB.1.raw
tcagtctacgtagccacgaccggtgctcgatttagtgctatagacttgggtttgggggggagaggagccccagccttggatccccaagtgttttcattcagtgatcaggactgaacacagaggactcaccatggagttcggctgagcgtcggtttcgtgacgtgctatacgtaaaggtgtccagtgtagagtgcgaggtggtggagtcgtagggggactccttaggtaaagccgttcgggggtccctttaggacgtcctccgtcggtggttcgcccttgtaggtattacctaaccgttttcgaagttaagtcgggtcctagggtagttaggtacggttcgggttaccccgaccgtacgggtaccgtacccgtaagggggtaaggggccgttagggacggtgggttaggtacgttacgaaaaagttaaagtgacgttaggtaagaagtaaaacgtagaaccgttacggtacgacgtacccggtaagaaaggtaacgtattaccgacctagtactaccggtaagtaagtaacgttaacgttaaccgaaaaacgggttcggttacttaaagttaccggaaataaacgttcgaaaccgtacgtaaccgttaacggtaaaacccgagtaacgacccgaaccgttaccgttattaacgttaacccgttagtaacccgtacgtaaggtaccgttaagggtaaactacggtaataccggtaccgtacggtaacggtacgacgttacggttagttacttgtacgtagtccgtcgggaacctacggtacaggttccgg

SEQ ID NO: 115153 - DNA, 894 bp, Homo sapiens
  misc_feature: GYAE6OF02HSP4M.15.86.H09.1.454.CMB.1.raw
  modified_base (180)..(180): a, c, t, g, unknown or other
  misc_feature (180)..(180): n is a, c, g, or t
tcagtctacgtagccacgaccggtgctcgatttagtgctatagacttgggtttggggtacgatttgatgttacctgatgcttagaggcttttcctggaagcagggcatttgttgcttcagccaccgtagtgcctcgtcatcacgcctcagccttgattttccgatttgcctggaaaaccngcctacccgacttaaaccgggactaaccgtccgcccggaccaacatacgccttacctcccgtccccccttcgacacgtaaccaccaaagtacaaggaatactaacctgttacccatcgactacgtcctttcggcctcgtccgttacggggctactccaccctgaccccgtattaaccggttggaaccgtacgggtaaccccttgggtaccttcccggacggtacggtccggggttacctttttccgaaccccggttactttttaacgttccggtttaaccttaagttccggtaccgtaacgtctaacgtttccggaccttaccggtttcctaggtaaaccttaaccctacccgtaggaccgttactacccggtccctaccgtaaccgtaacgtaccctaaacccttaacccgtttaccgaaacgtaccggttaacctaaaacccgtaaacgggttaaaccccgtcccccgtaaacccccgttaaaccccaaaaaccgtaaccgtaacctaaacggttaaaaccggtcccgttaaccgtacccgtacgtcccggtaaccgttaacggtccgttaccggggtaaccgtaccgttacgggtttaacgggttttaccccgttaaccccgttttccgtaacccttttccccgggtaccccgttacccgttaacgttaccggtacgtaacccggttaaccggttaaccgtaggtaaccgg

SEQ ID NO: 115154 - DNA, 753 bp, Homo sapiens
  misc_feature: GYAE6OF02IID8L.15.86.H09.1.454.CMB.1.raw
  modified_base (218)..(218): a, c, t, g, unknown or other
  misc_feature (218)..(218): n is a, c, g, or t
  modified_base (311)..(311): a, c, t, g, unknown or other
  misc_feature (311)..(311): n is a, c, g, or t
  modified_base (452)..(452): a, c, t, g, unknown or other
  misc_feature (452)..(452): n is a, c, g, or t
  modified_base (550)..(550): a, c, t, g, unknown or other
  misc_feature (550)..(550): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggngccgttggtaaagccgtggggggtcccttaaggagtcctccgtggtcgtggacctcgtggattcactttcagtaatggctgatgagttggccncaggctccgaggggaggggcgtggtagggtcgggttacggtacgtttaacgaaaaagtaaaatcgtaagtgggtacgaaagaaataggacgtacggtgactaacccggaggaaaaggatattccaactactactacgaaanaagtaattaaacttaagaaaacccggtgggttattaaccgtttagaaaccgtaaagtagaaaccgaccggtaaccgttaaaggaaaacccgggttaanaaaccgaccggttaacgtcccggtttaaaccttaagttacccggttacgtaaaccgtaccgttaaaggttaccgtaaccggggtaatcgtaaccgttaactacgggtaaacgggtttaaggcgggtaccttagggttcggtttacttttagtaacgttacgttccggggttcggaaccccggtaagggtactaaggttccggg

SEQ ID NO: 115155 - DNA, 648 bp, Homo sapiens
  misc_feature: GYAE6OF02IC9MY.15.86.H09.1.454.CMB.1.raw
  modified_base (311)..(311): a, c, t, g, unknown or other
  misc_feature (311)..(311): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggggatccgttgggtaaacgccgttggggggtccctttaggacgttctcctggtgtggccctgtggattcactttcagtaatggctggatgagttggccncaggctccgagggagggctggaggttggtggactttacgaaaaagtaaatgagtggtagaagaaatagacgtaggtcgacacccggagaaacggaagtacttacgactatactacgaaagacgtataaattaacgaaaaacgtcgttagtatttacgataaancgaaacganccgtaaagaaaaccgtgaacacacgtctaactagttaaccacgtaccaagtaagtcgttacggaagttcgactaacgtccgaaacggttaaaggacgtctaagtgtccgttttaagcgttacgttacgggtcgggacccctaaaggggtacctaggttacccggg

SEQ ID NO: 115156 - DNA, 822 bp, Homo sapiens
  misc_feature: GYAE6OF02JALQS.15.86.H09.1.454.CMB.1.raw
  modified_base (194)..(194): a, c, t, g, unknown or other
  misc_feature (194)..(194): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgccctttcattttcgtccactaggtctctgtagctctagcctgtagcctgacctcacgcccccgtntgcatctgtaccttgccgtgggactccgtacgactcgaacgtccgtcaccgtcgaccctaaccgttaaaggttaggtcgaacgtccgtaactacccgtaaaccctaaccgtaacctaacgtaccggtaaagttcggttaacctaaccgaaacgtacggaacgaaccggaacgggtaaccccgtacccctaaggtaaacttaacgtaaacgtaacggtaaacggttaacgacggtacgtacgtacggtaccgtaacggtcccaaccggtacgggaaacgggggtaccggtaaccgtacccgggtactacggtaccgttagacggttacggtccgtaacgtcgttaccggtagggtacccgtacggacccgttcgtaccacgtaccctacgttacctacccgtaacctccgtaacttaccgacggacctagtacggacgttccgtagtacgtaccgtactcggttaggacgtacggactaccggacctaaaccgtaacgtacgttacggacgttaacgggaccgtaacgggttacgggttacgggttacggtaccggggtaaccgggtacgtaaccgttacggtaccgttaccggtaaccgggtttccgttaaccgggcttaacccgggg

SEQ ID NO: 115157 - DNA, 816 bp, Homo sapiens
  misc_feature: GYAE6OF02GX1W5.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgcctgctatcttaaaaggtgtccagtgtgaagtgctaggtggtggagtctgggggatccgttagggtaaagcgtgggggtcccttagagtctccgtgtgtcggctcgtggtacttcactttcgagtaatggcgtaggatggtaggttcggtaccgtcgaaggtctaccggagggaagggtcggtaggaggttcgggttaggtaacggtttaaccgaaaaaaggttaaaacgtaggtaagttacggtagtaaaggaaaagtacggtaacgtaacggtacgtaccgaaccgtaacgtaaaagggaagttaaacgttacaaccgtaagtccgtaacgaagtaagaaacgttaaagtaaaccgaaaaaacgtacggttagtttaacgttagtaaacctaaaagtacggaaactacgtaacccgtaacggaaaaaccggtaacgaaacgtaacgtaacgacccgtttacgttaacttaaccgtaccgttaaaccgaccgtaaaggttaaccgttacgggtaaggtacgtaacgtaaggtaacccgaacggttaaaacgggacggtaacttaacgggttacgttacggttttaacgtaacggttaaccggtttaccggtaccggggtacccggtaaacgggtaccgtaaggttaacccggg

SEQ ID NO: 115158 - DNA, 884 bp, Homo sapiens
  misc_feature: GYAE6OF02GH5FO.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttcctgctgctatcttaaaaggtgtccagtgtagagtgcgaggtggtggagtcgtggggagtccgtaggtaaagccgtgggggtcccttaggagtctcctgtgtcggcctctggtattctactttgacgtaatggcgtggtagtgtaggttcgggtacccgcgtacggccgtaccgaggggaaggggcgttaggaggttgggttaggtagtttaacgaaaaagtaaaagtgaggttggtagaagtaaaacgtaggtaacgtacggtacgacctaaccgggtagaaaaggtaagtaacgtttacaacccgtaacttaccgtacgaaaacgtagtaaattaaacgtttaaacgaaaaaacgggttacccgggttagtttaaacgttttacggaaacgtaaaaccggtttacggaaaaaccgtaacggtaccccttaaaagggggaaaaaacccgtaagggaaacccgaaccgtaaacccggtaaccccgtttacggtttaaaaccttttaaccgtaaccggttaaaccccgtaacggtaaacggttaaccggttttaaccgggaaagttttccgggaaactaacggttaacggttaacccggggttaaaaggggaaccgggttacccggttaaggttccgggttttaatttttaaccggaagtttaacccggttggggtttccccggggaaaacccccggtaaggggtaaaccgttaggtttaacccggggg

SEQ ID NO: 115159 - DNA, 894 bp, Homo sapiens
  misc_feature: GYAE6OF02F3P8C.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtggttttccttgctgctatacttaaaggtcgtccagtgtagaagtgcaggtggtggagtcgtggggacgtccgttaggtaaacggtcccggttacgggggggttcccctttaaggtacgttccgttacccgttggttcggtcggtccgttacgtcggtatttcctaccttttacgagttaaacgtggtctgggtaactggtaggttgggtccccgacgcggtccgtaccggaagggggacggggaccgttggggtaggttgggggttacggttaacggttttaaaccgtaaaaaaggttaaaaattggaagttagggtaacgaaagtaaaagtaagacgttacggtacgtccgtaaccgggtagaaaagaacggttaactacctaaccgtattacgacgtaaacggtaataagtttaaaaccgtttaaacggaaaaaacccgtaggggtttaacgtttaacgtttaacgtaaacgtaaagtaaccggttaaaagtaacccggttaaccgtaaaccggtaaaacccgggaaggtaaacccgaacgtaaccggtaccccgtttaacttaaaccggtttaacgttaacccgacccgttaaaccgtaggttaaaccggttaccggttaaagtaccgaacggtttaccgtaaccgggtaacggtaaaacgggtccggtaattaccgtagttttaccgtttagtaacgtcgtttcgggtaccggacccgtaagggttaacgtggtttaccgg

SEQ ID NO: 115160 - DNA, 782 bp, Homo sapiens
  misc_feature: GYAE6OF02HKJIJ.15.86.H09.1.454.CMB.1.raw
  modified_base (635)..(635): a, c, t, g, unknown or other
  misc_feature (635)..(635): n is a, c, g, or t
  modified_base (654)..(654): a, c, t, g, unknown or other
  misc_feature (654)..(654): n is a, c, g, or t
tcagtctacgtagccacgaccggtgctcgatttagtgctatagacttgggtttggggtccactgggcagtctcgaatagagctcttggaagtccctccaaaccatggcctgggtctccttctacctactcgccctttctattttcctccacaggtctctggtgctctcgtcctgtcgcgtcaactccgaccgtcccccgtatcgactactcgtcgtccgttgaccgtagggtacgtccctacgatacgtaacgcctacaccgtacacctaaaccgtaagtcggacgacgaccgtaacgtaaccgtaacctaactaaccagttacggtaaacgttacgtaacaaccaacgtaagaccggtaaaccgaacgggtaaccccttaacccggtaaattaacgtaaagttaacgtaaaacggtaaaagttaaggtagacgttaaggacgacgaacgtaaacccgaacggtaacggggaacggggtaccgtacccgtacgtaccgtagtcccgttagacggtaacggtctacgtaaggtccgggtaggcccgttacgaccgttacaaccgtaacgtactaacctcgtaaaccctacgtcgtacgtgaaacgtacgaagtaaccgtggactagtaacgttaanccggttagtaaggacgaanacgtacaaaccgattaacggaagtcgaaacggtaccgaaggttaaggttcgggtaacgggcgttaacgggaacgggtaaacgtccgacggttaccgacgggtaaaccttacgggacgacgaacccggg

SEQ ID NO: 115161 - DNA, 789 bp, Homo sapiens
  misc_feature: GYAE6OF02G68WX.15.86.H09.1.454.CMB.1.raw
  modified_base (170)..(170): a, c, t, g, unknown or other
  misc_feature (170)..(170): n is a, c, g, or t
  modified_base (217)..(217): a, c, t, g, unknown or other
  misc_feature (217)..(217): n is a, c, g, or t
  modified_base (246)..(246): a, c, t, g, unknown or other
  misc_feature (246)..(246): n is a, c, g, or t
tcagtctacgtagccacgaccggtgctcgatttagtgctatagacttgggtttggggggaggaggagccccagccttgggatccccaagtgttttcattcagtgatcaggactgaacacagaggactcaccatggagttcgggctgagctgggttttccttgctgctatnttaaaaggtgtccagtgtgaagtgcgaggtggtggagtcgtgggggnccgttaggtaacgccgtgggggtcctagngtcctctgtgtgcctctggtattcgactttcgagtaatcggtatggtatggacggttcgggtcccgacgacggtcctaccgaggggaacggggcgtaggtagggttggggttaggtaacggttttaacgaaaaaagtttaaacgtaggagttacgggtaggtaaacgtaaaagtacgtaacgtacgggtagacccgtaccgtaaggaaaacggtataacgttaccaacgtactacgttaaccaaaggtaactaagttaacgtaacgtaaaaaaccggtcggtttaagttaatttaacgggaactaaaagtacggtaaaaccgtacggtaacccgtaaacggaaaacccgggtaccgaaacctaacggaaccgtaccggttaaccttacgtttaacgaccgttaaaccgaattaacgggacgtttaacgggaaggtaggaccttaacgtaaccggtaagggttaaacggacgtcgttagttacggttaattacgttataaccggttcgggtaccggaacccggaaggttaccaagggtttccgg

SEQ ID NO: 115162 - DNA, 876 bp, Homo sapiens
  misc_feature: GYAE6OF02JHC2G.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatacttaaaggtgtccagtgtgaagtgcgaggtggtggtagtcgtgggggtagtccgttggtaaagccggtgggggttccccttaggtacgtccgttccgtggttggtcggtccttcgtacggtacttctactttcgaagttaagtcggcgtggtagttggtacggtttacgggtcccgacgtacggcctaccggaaggggaacggggtcgtagggtaggtaggggtacggttacggttaaacgtaaaaagttaaaacgtgtaagtaggtaggaaagtaaaagtacgtaacgttaggacggtaccgtaaccggtaagtaaacggaacgtaacttaccgaaccaagtaaccgtaccgaaaggtaacgtaaagttaaaaccgttaaccggaaaaagggtttaccggttagttaaacgtttaacgtaaacgttaaaaagtaccgggtaaacttaacccggaaccgttaaacggaaaaacccggttaacgaaaccgtacgtaccggttaaccgtaactttacggttaaaccgacccggtttaaaccgcggtaaagttaacccggttacgggttaaaaccgtcgaccgttaaggtaacccggtaacgggaagggtaacggtcggtttaaacgttccggtttaaattacgttaacgggttacgttccggggacccggggttaacccgttaaggggtacccgttagggttacccggg

SEQ ID NO: 115163 - DNA, 858 bp, Homo sapiens
  misc_feature: GYAE6OF02JKQGQ.15.86.H09.1.454.CMB.1.raw
  modified_base (788)..(788): a, c, t, g, unknown or other
  misc_feature (788)..(788): n is a, c, g, or t
  modified_base (802)..(802): a, c, t, g, unknown or other
  misc_feature (802)..(802): n is a, c, g, or t
  modified_base (839)..(839): a, c, t, g, unknown or other
  misc_feature (839)..(839): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttccttgctgctatacttaaaggtgtccagtgtgagtgcaggtggtggagtcgtggggacgtccttaggtaaacgccgttcgggggtcccttaggagttccgtcctggtggtcggcccttcgtcggtattcctactttacgaagttaagtcggtcgtacggtagtcggtacggtttcgggtcccgaccgtacgggtctacccggaacgggggtaacggggtccgtaggggttaggttaggggttacgggtaaccgtttaaacggaaaaaagttaaaagttacggtacggttagggtaaggtaaaacggtaaaagttacggtaacggttaacggtaccggaaccgttaaccggtaaggtaaaacgggtaacgtaacgttaccaaccgtattaccgtaaccgaaacggtaacgtaacgttaaacgttaaaccgaaaaccggtagggtttacgttaacgtttacggaacgttaaaacgaacggtaacgtaacccggaccgtttaaacggaaaacccggtacgaaccgtaaacgaccggttaacccgttacctttaagtacccttaacggttaacccgaacggttaacgacgtttaacgggagttaccgacgtaacgttaacccggtaagtaaccggggngttaactacggttnttacggtttactaacggtattccggtccgggtaaccnggtacccgttaagttacgg

SEQ ID NO: 115164 - DNA, 679 bp, Homo sapiens
  misc_feature: GYAE6OF02ICSWF.15.86.H09.1.454.CMB.1.raw
  modified_base (346)..(346): a, c, t, g, unknown or other
  misc_feature (346)..(346): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagcgttggtaagccgtgggggtccttagagtctcctgtgtggcctcgtggattctactttcagtaatggctggatgagttgggtccgccgaggctccgaggggagggcgtggaggtgggtggtacgttanaaaagtaaaatgatggtagaagtaaagtacgagtacggtcgaccgaccggtagaaaggaagtacttacacgtatactacgaagaagtaataacttaacgaaaaggacggttagttaagtttagaataaagtagaaacacgtacctaaggaaaacccggagaacaccgaagtcctaacttaattaccgtacgtacccaagacgtacgttacggaagtacgacgtaagtccggtaacggtaaacggcggtaacgttacgtcggtttaacgttttacggaagtttacggttaccgggtaccggggtaacccggtaagggtacctaaggttcccggg

SEQ ID NO: 115165 - DNA, 857 bp, Homo sapiens
  misc_feature: GYAE6OF02IONA3.15.86.H09.1.454.CMB.1.raw
  modified_base (311)..(311): a, c, t, g, unknown or other
  misc_feature (311)..(311): n is a, c, g, or t
tcagtctacgtagccacgaccggtgctcgatttagtgctatagacttgggtttggggggggagaggagcccccagccttgggatccccaagtgttttcattcagtgatcaggactgaacacagaggactcaccatggagttcgggctgagcgtgggttttccttgctgctatacttaaaggtgtcctagtgtgaagtgcgtaggtggtggagtcggtggggagtccgttagggtaaacgccggtcgggggtccgttagacgttctccgtgtggtcggtccgtcgtggtattcgtactttcgagtagtggtntggtagtggtaggttcgggtccgccgtacggtccgtaccggaggggtaacgggcgtagggtaggttcgggttaggtaccggtttaaacgtaaaaaggttaaaagtggtaagtaggtagaaagtaaaagtacggtaacggtacggtacgaccgtaaccggtaaggtaaacggtaacgtacgtacaacgtactacgtaacgaagtaagtaaacttaacgtaaaaccgaaaaggttacggttaagttaagttacgaaccttaaaagtaacgtaaaccgacgtaaccgtaaacggaaaaaccggacgtaaacctaacgaccggtacctttaacgttaaccgttaaaccgttccgtaaaccgtaacgtaacggttaacgttaaccgggtaagtacccgtaaagtaaccgttaaccggaaaacccgggggttaaaagccgggtaaagtttaaccgggtttaagttttaacggttttaacgggaaactttaacggggtccccgggttacggggaaaaccccggttaagggtaaccgttaagggtttccccggg

SEQ ID NO: 115166 - DNA, 906 bp, Homo sapiens
  misc_feature: GYAE6OF02JJ7LN.15.86.H09.1.454.CMB.1.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggganccttagggaaacnccgtgggggtcccttaggacgtctccgtgtcgtggcctctggacttcgactttcagtaatcggcgtggatgagttgggtccgcgaggtctccgaggggaggggtctggtaggtgggttacggtaacgttttaacaaaaaaggttaaaaatcggtaagttgggtaaggtaaacggtaaaaatacggtaacgttaaccgggtacgacccggtaaacccggttaagggaaaaacgggtaaacggttaaccgtttacccgaaaacccctaaggtttaacccttaacggaaaaacggtaaacggtaaactttaaaacgtttaaacccggaaaaaaaaacgggtaccggggttttaaggtttaaacgttttaacggtaaacccgtaaaaacggtttaaccggaaaaaccggtaacccggtaacccggtttaaacgggaaaaaaccccgggtaaacggtaaaccgtaaccccggaagttaaccccggttattaaaccgtttaaacccgtacgtaaaccccgtaaacggtaacgttaacgttaaccggggtaaagtaccggtaccgtaaagttacccggaaacgggttaaaagggcgttaaacggttaaccgtaagttacgtttacggtaaattccggtaacggttaccggggacccggaacgggttaactaggttaccgggg

SEQ ID NO: 115167 - DNA, 773 bp, Homo sapiens
  misc_feature: GYAE6OF02HRSFA.15.86.H09.1.454.CMB.1.raw
  modified_base (326)..(326): a, c, t, g, unknown or other
  misc_feature (326)..(326): n is a, c, g, or t
  modified_base (445)..(445): a, c, t, g, unknown or other
  misc_feature (445)..(445): n is a, c, g, or t
tcagtctacgtagccacgaccggtgctcgatttagtgctatagacttgggtttggggtacgatttgatgttacctgatgcttagaggctttttcctggaagcagggcatttgttgcttcagccaccgtagtgcctcgtcatcaccgcctcagccttgtacttttccggatttgcctaggaaaccagcctacccgacttaaaccgggacaaccgtcgcccggaccaacatacgccttcctcccgtccccccttcgacagtaacaccaagtacaggaatattaacctcgttccatcgactacgcctttcggcctcgccgttagggtcnctcaccctgccccgattaaccgttggaccaacggtacccgttggtaccttccggacgacggccggtccttttccgacccgtacttttactccggtttacttaagtcgtcctagaccgtnttacgtcctactttcctagtaaccttacccgttcccaacggtcctaactcgtacccgtacccacgactaccacctaaccctttaccaaccgtacggtacccttaacaacggtaacccgttacccctacccccgttaaacccaaacgaaacccgacgtaacgtaaccgtacgtaccgcccttaccggcccgaccgttacggtccttacgggccgtaccgttacggtttaccggttttacccggtccccgtttacgtacccgtttacccgttcccccggtacctaaccgttcgttccggtacgtttaacccgtacggtttacctaaccgg

SEQ ID NO: 115168 - DNA, 768 bp, Homo sapiens
  misc_feature: GYAE6OF02HODVX.15.86.H09.1.454.CMB.1.raw
  modified_base (143)..(143): a, c, t, g, unknown or other
  misc_feature (143)..(143): n is a, c, g, or t
  modified_base (381)..(381): a, c, t, g, unknown or other
  misc_feature (381)..(381): n is a, c, g, or t
  modified_base (670)..(670): a, c, t, g, unknown or other
  misc_feature (670)..(670): n is a, c, g, or t
  modified_base (686)..(686): a, c, t, g, unknown or other
  misc_feature (686)..(686): n is a, c, g, or t
tcagtctacgtagccacgaccggtgctcgatttagtgctatagacttgggtttggggggagaggagcccccagccttgggatccccaagtgttttcattcagtgatcaggactgaacacagagactcaccatggagttcgggntgagcgttgggttttcctgctgtctatacgttaaaaggtcgtcctaggtgtaggtaagtcgacgtagggtgggtggtaggttcggtggggggtacgtaccggttaaggggtaaacggtccgggttccggggggttacccttaggtacggtccgttccgttggtggtcggtccttcggttggtactttccgtactttacgagtaagtcggtctggatggtaggttcgggtccgtaccgnggtccacggacggggtagggcgttggggtagggttggttacggttaaccgtttaaagtaaaaaggtaaacgtaggtagtagggttaagaaagtaaagtacgaacggttacggcgacggtaaccgtaagaaagggtactattaccgactacgttacaagaaaggtaattaacgtaaaccgtaaacgtaaacggttacggtaggttaaatacggaaactaaaggtagaaaccgtcggtaaaccaacggaaaaccgagaacctacgacgtactacttacgtacgttaccganacgtaagtacggtagngtacacgagtaccaaggttagaggttctagtgttaaccttagtaccgacggtggacccggacggtaagaccgtacggttcgg

SEQ ID NO: 115169 - DNA, 775 bp, Homo sapiens
  misc_feature: GYAE6OF02IQ0F7.15.86.H09.1.454.CMB.1.raw
  modified_base (179)..(179): a, c, t, g, unknown or other
  misc_feature (179)..(179): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggtttcctgctgcttatacttaaaggtntccagtgtgaagtgcgtaggtggtggagtcggtgggggtacgtccgtttagggtaaacggtccggttacggggggttccccttaaggacgttccgtccgttcggtggtcggtccttcggttgattcctacgtttcgaagttagtggtacctggacgttggtaggtttccgggtccgtaccggtaggtccgtaccgggtaagggggaacgggtctaggggtacggttgggtttacggtaacggtttaaacgaaaaaggtaaaagttcgtaagttgggtaaaggtaacgtaaaagttaggaccggttaagggtaccgtaccgaaccgggttaaggaaaacggtaacgtacttaccgtaaccgtattaccgaacgtaaagaagttaacgtaacttaaacggaaaacgtacggtaagttaacgtagtaactaaagtagaactagacccgtaaagaaccggtaagacaacgacgtacgttactaagtacgtacctacgaactgacgttagaagtcatacgagacggtaagagttacgttacttggtacttttaaggatttacggttaccggacggtaccggtacggtaagtcttaacgggg

SEQ ID NO: 115170 - DNA, 770 bp, Homo sapiens
  misc_feature: GYAE6OF02F1W1A.15.86.H09.1.454.CMB.1.raw
  modified_base (182)..(182): a, c, t, g, unknown or other
  misc_feature (182)..(182): n is a, c, g, or t
  modified_base (742)..(742): a, c, t, g, unknown or other
  misc_feature (742)..(742): n is a, c, g, or t
tcagtctacgtagccacgaccggtgctcgatttagtgctatagacttgggtttggggggggagaggagcccccagccttgggatccccaagtgttttcattcagtgatcaggactgaacacagaggactcaccatggagttcgggctgagcgtggttttccttgctgctatacttaaaggtntccgagtgtagaagtgcgaggtggtaggtgtcgtggggagtccgttaggtaaacggtccgggttcgggggtcccttagcgttccgtccgtgtcggtcggtccttcgtaggtacgttacctcgttttacgagttaagtcggtcggttgtagttaggtacggttcgggtcccgaccggtacggtccgtacccgggaaggggtaaccgggtggtacggggtaggttacggggttacggttaacgtttaaacgaaaaaaggtttaaaagtggtaagttggtaaacggaaagttaaaagtacggtaacggtacggtacgaccgtaaccggtaaaggaaaggtacgtacttaaccaacctacgtacgtacgtaaagaacgtaaacttaacgaaacgtaaaacggtggttaacgtatttaaacgaaacttaacgaaagtaccgaacgtaccgtaaaacgaaccgacgtaaccgacgagtccgtactacgttacactcgaaactgtaacgttacgagtaccgtgacgtacgtaaggaacgtacgtctagttgtaccgtttagaccgtnttcgggaccggacacggtataggttcgg

SEQ ID NO: 115171 - DNA, 901 bp, Homo sapiens
  misc_feature: GYAE6OF02FR8KE.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagccgtgggggtcccttagagtctcctgtgtggcctcgtggtattcactttcaagttaatggctggatggtagttcgggtcccgccgaggcctaccgagggggaacggggtccgtgggtaaggttggggttaggtaacggttttaaccgaaaaaaaggtttaaaaaacgtggtaaacgttagggtaaggtaaaaggtaaaaaacgtaaggtaaaccgttaacgggtcggaacccgtaaccccgggttaaggaaaaacggggtaaacgtaacgtttaacccaaaccgtaacgttacccttaacgaaaacggtaaacgtaaacttaaacgtttaaaccgaaaaaaacgggttcgggtttaagttaaagttttacggaaactaaaaagttacggaaaaccgttaacgtaacccgttaacgggaaaaaacccgacgggtaaaccaaccggtaaccgtaccccgtttaagttaaaccgtttaaaccgtaccggttaaaccctaacgtaacggtaacgttttaaccgggaaaagttcgtaaccgtaaccgttaccgggaaacggttaaacgggacggttaccttaaaggttcgtttaccgtttttaaggtaaaccttacggttaccccggggttaaccggggaccccggtaacggggtaaccgttaagggtttcccgggg

SEQ ID NO: 115172 - DNA, 694 bp, Homo sapiens
  misc_feature: GYAE6OF02GUMLK.15.86.H09.1.454.CMB.1.raw
  modified_base (250)..(250): a, c, t, g, unknown or other
  misc_feature (250)..(250): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggttttcctgctgctatcttaaaggtgtccagtgtgaagtgcaggtggtggagtcgtggggagccgttaggaagccgtgggggtcctagagtctcctgtgngcctcgtggacttctacttacagtactggctggatgtagttggtccgccgaggcgtccgagggaggcgtggaggtggttcggacgttaacgaaaaggtaaactgagtaggtacgaagtaaagtaagtacgtacggtacgaccgtaacccggtaggaaaacggtaacgtacgtaccgaacgtactacgttaacgaaacgtagtaataaacgttaaccgaaaaacgtccggtaagttacgtttagaacgtaaagacgtaacacgaccttaacggaaacgacggaacaccacggtaccttacgtaacttacgtacgtaaccgacgaagttacgttaacgacgtacgaccgtaagtaccggtaaggtaaacgtacgggtaacttaggtcttaggtttacgaagttagtccggtaccgggaccggtaacgggacttaaggttacccggg

SEQ ID NO: 115173 - DNA, 907 bp, Homo sapiens
  misc_feature: GYAE6OF02ILKQB.15.86.H09.1.454.CMB.1.raw
  modified_base (201)..(201): a, c, t, g, unknown or other
  misc_feature (201)..(201): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatcttaaaaggtgtccagtgtgaagtgcgaggtggngagtcgtggggagccgttggtaagccgtggggtcctagagtcgtcgtgtgtcggcctacgtggattctacgtttcgaagttaagtcggcgtaggtagtagtacggttggggtacccgtccgtaacggggccttacccggaagggggtacggggtaccgtagggggtaacggttcgggggtttaacggtaaccggttttaaaccgtaaaaaaagggttaaaaaaacgttcgggtaaaggttacggggttaagaaaaggggtaaaaaaagttaacggggtaacgttaaccgggttacggtaacccgtaacccggggttaaaggtaaaaacgggtaaacgtttacgtaaacccggtaaccctaaacgttaacccgtaaccgtaaaggtaaacgtaaacgtttaaacgttaaaccgtaaaaaacccgggttaagggtttacgttaaacggtttttaacggaaacgttaaaaagtaaccggttaaaaccgtaacggtaaccccgttaaaaacgggaaaaacccgggttacggaaaacctaaccgggtacggttaaccgttaaccgtttaacgttaaacccgtagtaacccgaacgtaacgttacgtaaaccggtagtacgacgttaacgacggaacgtaaggtcgtactattccggttaacttgaaacgtcgttacccgggaagggtccctaaaggcgttaagttcccggg

SEQ ID NO: 115174 - DNA, 877 bp, Homo sapiens
  misc_feature: GYAE6OF02HRY2U.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcggctgagctggttttccttgctgctatcttaaaaggtgtccagtgtgaagtgcgaggtggtggagtcgtggggacgtccgttacggtaaacgtccggtcgggggttacccttaggacgttcctccgtggtgaacgccttcgtggtactttccgaccgtttgacgtcctacgtttacgttaggacttagtaccggttcgggttaccccgtaccggtacggtacccgttacccggaaggggggtaacggggtccggttagggtacggggttcggggtcggtacccgtaaccgtaaaacgtaaaacgaaaaacggtagttaacgggaaggtaaccggtaacaacccgtaaaccgttaccgttagtaacgttaaaccttcgtacgggttacgtaacggttacgggaccgtaacgtttacccgaaccggttaccctaaccggtaacggtaaacgtaacccgggaccggacccgtaaaaacgtacccgttaaccgtaaacgtaaccttaacttaccgtacgaaaccgttaaaaccgtaaccgtaaaccgaaccgttaacggaaacggaccgtaaccgggaaacgtaaccgggtaccgtacgttacggttacgttaagttaccgttagggtacggtacggtagtcgttaagttcgttacggtcggtaccgggttacgggaccgtaaccggggttccgtaaccggttcccgtaacctcccggtttaaccgtccgtacccgtacccgg

SEQ ID NO: 115175 - DNA, 770 bp, Homo sapiens
  misc_feature: GYAE6OF02GDC8U.15.86.H09.1.454.CMB.1.raw
  modified_base (62)..(62): a, c, t, g, unknown or other
  misc_feature (62)..(62): n is a, c, g, or t
  modified_base (145)..(145): a, c, t, g, unknown or other
  misc_feature (145)..(145): n is a, c, g, or t
  modified_base (160)..(160): a, c, t, g, unknown or other
  misc_feature (160)..(160): n is a, c, g, or t
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
tcagtctacgtagccacgaccggtgctcgatttagtgctatagacttgggtttggggggganaggagccccagccttgggatccccaagtgttttcattcagtgatcaggactgaacacagagactcaccatggattcgggcagngtcggtttcgtttcntcgtgtactacttaaaaggtaaggtcctagtaggtagtaaggtagcgacggtagggttggtaggtacgtgggggtaggaccttggtaaaaggaccggttcgggggtaccggttactaagtcctccttcgngtcgggtcctcctggtntacctatttcagtaatagtcgaggtagtacgtagtacgggtccggccgtaggccgtaccgaacggggtaaggggtacgtaggtagggtgggttaggttaaccggtttaacgtaaaaacggtaaaaataggtaagtagggttaaggaagtaaaaacgtaagtaacgtacggtacggactaccggtaaacggtaaagaaacgggttatacgaaccgactatacgaacgtaagacgtaactaaacgtaaacgaaggtgtaagttactaagtaaacttaagaactaacgtacgtaaacgtaaacggaacgtaacgaccgaagtaccggtacctaattaacggtacctaacgtaacctaagtacgttaacgaagtacgactaaacgtacgtaaacgggtaagacgtacgatacggttattacgtagttaacgccggtacgggcgtaaccggacgttaagtcggtacgg

SEQ ID NO: 115176 - DNA, 825 bp, Homo sapiens
  misc_feature: GYAE6OF02I0CF6.15.86.H09.1.454.CMB.1.raw
  modified_base (578)..(578): a, c, t, g, unknown or other
  misc_feature (578)..(578): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttaggtaaaggccggtcgggggttcccttaggacgtccgtccgtaggtggtcggtccttacgtggtattccgtactttcgagtaacgtggctggagttgaggttgggtcccgacgacggacctaccggaaggggaacggggtcgtagggtagggttacggggttacggtaaccggttttaaacgaaaaaggttaaaaacgtggtaagtggtaaggaaagtaaaagtaaggtaaccgtaacggtacgtaaccgaaccccggtaaggaaaacgggtaaacgtaacgttaacccgaaaccgtaacgtaccgtaacgtaaaggaacgtaacttaaacgttaaaccgtaaaaaacccggngggtttaactttaagtttaacgaaacgtaaaagtacggaaaacctacggtaaccgtaaacgtaaaaaccggagtaaaccaacgtaacggtaccctagttaaacgttaccgtaacgtaaccgaacgtaagtacgttacggaaacttcgaccgtaaacgaccgtaaacgggtaaagcggttaaccgtcgttagttacgtttacgaatttaggtcccggtacgggacccgaagggtaaccttggtaccgg

SEQ ID NO: 115177 - DNA, 877 bp, Homo sapiens
  misc_feature: GYAE6OF02I49XT.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtagaagtgcaggtggtggagtcgtgggggagtccgttagggtaaacgccggtcgggggggttacccttaggacggtacctcccgttggtggttcggtcccgtccgtagggtactttctaacctttccgtaagttaagtggtccgtaggtagttggtaacggttcgggtacccggaccggtacgggtaccgtacccggaaggggggaacgggggtccggttaggggtaggggttaggggttcgggtaaaccggtttaaacggtaaaaaaggttaaaaacgtgggtaattagggtaagtaacggtaaaaagtacggtaacgttaacggtcgtaaccgaccggtaaggtaaacgggaagtacttaaccgaacctacgtacgaacgtaaagaacgtaaataaacgttaaacgtaaaaacgggtcggttagttaaacgttacaacgtaaaagttagaaaccgacggtaacccttaaagggaaaaacccgacgggtaaccgaaccgaccgggttaacccgtaatttaacgttaacccaggttaaaccccaaaggttaaccgttacggttaaaccggtaggaacgtaccgttaaggaaccgtaacgggtaagggtacctaaggtttacgtacgttaacgttttagattaaccgggtcggaacccggggtacccgtagggaaccgttagggtaccgg

SEQ ID NO: 115178 - DNA, 770 bp, Homo sapiens
  misc_feature: GYAE6OF02JOPPQ.15.86.H09.1.454.CMB.1.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
  modified_base (514)..(514): a, c, t, g, unknown or other
  misc_feature (514)..(514): n is a, c, g, or t
  modified_base (694)..(694): a, c, t, g, unknown or other
  misc_feature (694)..(694): n is a, c, g, or t
tcagtctacgtagccacgaccggtgctcgatttagtgctatagacttgggtttgggggagaggagccccagcccttgggatccccaagtgttttcattcagtgatcaggactgaacacagaggactcaccagtggagttcggcttaggacgtgttccccccccccgggtttattgctgaccttatacgttaaaggtctccgtagtcgtgaagtgcgtaggtggtagngtcgggtagggaccttcggttaaggaaccgtcggggttaccgggttacctaggctcctcgtggtgtaccgctggagtctcgtctacatagtcgngtagacgtggttacggtaccgtcacggtgtacccgtacggtagggggacggtcgtaggttacgggtacggtacggttttcccgggaaaaattaaaaacgttgaacttgggtaaccggataaaaggtagtaccgtaccggttagcgacccgttaggaaggaagtagtcctaaaccgtacgtactcggaaaacgngtaaaccttataaccgtaaacgtaaacggttcgttaacgttacgtagtaaactaaggtacaacgttcgaaacgttaaacggactaggtaccacggtcctaacttaccgtaagttaccgaccgttacgaagtcgttaacgtaacgggactacgtaacgtacgtagtaacggacgtaacgtnttaacccggttgttaaccgtaacgttagtaccccggttaggaacccccgggttaggtaacgtcgtttcggtaccgg

SEQ ID NO: 115179 - DNA, 859 bp, Homo sapiens
  misc_feature: GYAE6OF02IA9F7.15.86.H09.1.454.CMB.1.raw
tcagtctacgtagccacgaccggtgctcgatttagtgctatagacttgggttgggggagaggagccccagccttgggatccccaagtgtttcattcagtgatcagggactgaacacagagactcaccatggagttcgggctagagcgtgggttttcctgctgctatacttaaaggtgtccagtgtagaagtgacgtagggtggtggtagtcgtgggggtatccgttaggtaacgccggtcgggggttacccttagggactccgttccgtggtcggtacggtccttcgtacgggtacttcctacgttttaccgagttaaacgtcgggtacgtaggacgttacggtaacggttccgggtaccccgtacggtacggtcgttaacccgggaaaggggaccggggtacgttgggtaacggttcggggttaacgtaacggtttaaaccgtaaaagttaaaaagtggtaaacggtagggtaacgaaggtaaaacgtcgtaaccggttaacgacggtaacccgtaaccggtaaggtaaaacggtaacgtacctttaacgaacccgttactacgtaacgtaaaggtaacgttaaacttaaacgttaaaaccgtaaaaccgggtgttaacggttttaagtaccgtaaggtaaactacggtaaaccggtcttaacccggaaacggttaaacccggaacggactaccgtaaccggtcgtaactacgtttccgaacgtacgtacgaaacgggttctaacgggtaagtccgaagtaccgtaacgttaagggtaacggtagtcgttaaccgtggtttacttacggtaacgcgttaccggggtaacgaccggggtaactaacgggtcttaacggg

SEQ ID NO: 115180 - DNA, 933 bp, Homo sapiens
  misc_feature: GYAE6OF02GI5KZ.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcgaggtggtggagtcgtgggggacgcctttagggaaacgtccggtggggggttacccttaggacgtcctccgttggtgtcggcctcgtggtacttcgtactttcgaagttaagtcggtcgtgggtaagtgggttacggttcggggtaccccgaccgtacgggtcctaccgggaaggggggaacggggcggtaggggtaggggtttagggggtttacgggttaaaccgggtttaaacgaaaaaaaggttaaaaagtggtaaagttagggtaaggaaaacggtaaaaaagttaacggtaacggttaccgggtacgtaacccggtaaaccggttaaaggaaaaacgggtaacgttaaccgttaacctaaaccgtaacttaccgtaaacggtaaaacgtaaagggtaaaactttaaaaccgtttaaaacccggtaaaaaaaccggggtttacgggtttaaacggttaaagttttttaccggaaaaacgtaaaagttaaaccggaaaccgtaacggtaacccggtaaaacggtaaaaaacccggggtagaaacccgtaacgacccggttaaccgtttaattaacccgtttaacgtaaccgttacccgtaacgttaacgtaacggttaccggtaagttaccgacgttaacgtaacgggtaaacggtaggacggttactagttacgttctttacggtattacggtcgggtaaccgggtaaccgtaacgggtactacgggttcggg

SEQ ID NO: 115181 - DNA, 785 bp, Homo sapiens
  misc_feature: GYAE6OF02IDONL.15.86.H09.1.454.CMB.1.raw
  modified_base (138)..(138): a, c, t, g, unknown or other
  misc_feature (138)..(138): n is a, c, g, or t
  modified_base (204)..(204): a, c, t, g, unknown or other
  misc_feature (204)..(204): n is a, c, g, or t
tcagtctacgtagccacgaccggtgctcgatttagtgctatagacttgggtttgggggagaggagccccagccttgggatccccaagtgtttcattcagtgatcaggactgaacacagagactcacatggagtcgggntgagcgttggtttccttgctgctatacgttaaaggtcgtcagtgtgaagtcgagaggtggtacggngtcggtggggacgtccgtaggtaacggccggtggggttcctagacgtctcgtgtggtcgctacgtcgtattctactttacagtagtgtcgtgcgtaggtacggtcggtccgaccgtaggccgtacccgggtaggggtacgggtcggtaaggggtgggtttacggggttaaggttaaccggttaaaagtaaaaaggttaaaggtgttaaacggtagggtaaagtaaaagtaaacgttacggaacgttaacggtccggaaaccgacgggtaaaggaaacgtacggtaaacttaccgaacctaacgtaacgtaacggaaacgtaacgtacttaaagtaaaaccgtaacgggtaagttactttagtaacgtaataacgagaacgtacgaaacgaacggtaacgacgaaccacgtacgtcctaacttataccgttacagtaccaggttacgagtacggtacaggttaaccgtacgggaaacggtcgttaacgggtaacttaacccgtttgggttaaacctttcggtaaaggttccgtaaccggggtacccgggtacccggaaaacggtttcggacggtttcccggg

SEQ ID NO: 115182 - DNA, 775 bp, Homo sapiens
  misc_feature: GYAE6OF02HPTIW.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgtgggttttccttgctgctatacttaaaaggtgtccagtgtgaagtgcaggtggtggagtcgtggggagccgttaggtaaacgccggtgggggttcccttagagtctcctgtgtgcctcgtggtattctactttcgaagttaagtggcgtaggtagtggtaggttcgggtcccgccgacggtccgtaccggaaggggaacggggtcgtgggtacgggttggggttacggttaaccggttttaaacgtaaaaaagttaaaaacgttaggtaagtagggtaagtaaaaggtaaaaagtacggtaacgtaacggtcgaccgtaaacccggtaaggaaaaggaacgtataccaacgtactactacgaagtaagtaataagtaaaccgtaaaaacggtacggttagtaatttaggaactaaagtagaacgtacgaccgtaacggaaaaccgaggaacacgaacgtaccttacgttaacttaccgtactaccaacgtaacgtagttaacgaagtcgaacgtacgtaacggaacgggttaacgtagggtaacttagttacggttagtttaacgtaagtacggtttacgggacccggggttaaccccggaagggtaccttaacgggttccggg

SEQ ID NO: 115183 - DNA, 1037 bp, Homo sapiens
  misc_feature: GYAE6OF02JN4C9.15.86.H09.1.454.CMB.1.raw
tcagtctacgtagccacgaccggtgctcgatttagtgctatagacttggggtttggggggagaggagccccagccttgggatccccaagtgttttcattcagtgatcaggactgaacacagaggactcaccatggagttcgggctgagcgttgggttttccttgctgtctatacttaaaggtgtccagtgtagaagtgcgtagggtgggtggagtcggtgggggacgtccgttagggtaaacggtccggtgggggtacccttaggagttcctccgttggtcggtcggtccttcgtggtacttcctacgtttacgtaaggtaagtcgggtcgtaggtagttacgggtaggtttcgggggtccccgaccgtacgggccgtacccgggaacgggggtaaacggggtacggtaggggtaacgggttcgggggttacgggttaaaccggtttaaacgtaaaaaacggttaaaacggttaggtaacggttaggggtaagggtaaaaggtaaaaacggtaacggtaaccggttaacgggtccggtaacccgtaaacccgggtaagggtaaaaacggggtaacggttaaccgttaaccgtaacccgtaactttaacccgtaacgtaaacggtaacggtaaactttaaacgttaaaacccgggaaaaaaccgggttcgggttttaaacgtttacgtttaaaccgggaaacgttaaaaaacggtacggaaaaccttaacggggtaaccccttaaaaaggggtaaaaaccccggtacggaaaacccgttaccggtaaaccgggtaacccgttttaaccgttaaaagttaccccgttaacggtaaaccccggtaacggtaaacgggtttacccggttaaagggaacccgggttaacgaccggtttaaaacgggtaccgggtaaaccgggttaaaacgggacggttaccgtttaaaggtttccggtttaacgttttaaccgaaggttttaccggttcccggggtaccgggtaaccccgggttaaagggttacccttgggttaacccgggg

SEQ ID NO: 115184 - DNA, 815 bp, Homo sapiens
  misc_feature: GYAE6OF02FRWPD.15.86.H09.1.454.CMB.1.raw
  modified_base (735)..(735): a, c, t, g, unknown or other
  misc_feature (735)..(735): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtggggagccgttggtaaagccgtgggggtcccttagagtctcctgtgtcggtcctcgtggattctactttcgagtaatggctggatggtagttcgggccgccgacggcctccgaggggaagggtcgtgggaggtcggggttacggtacggtttaacgaaaaaacgttaaaagtaggtacgttaggtaggtaaggtaaaagttaggaaccgttaacgggtacgacccggtaacccggtaggtaaaacgggtaagtaacgttacctaaccgacgttaccgttaacgaaaggtaataaacgttaaacgttaaaccgaaaaaacgggtcggtttaaacgttaaggtttaacaacgtaaagttaacgaaaccgtaaacggtaccctaaacggtaaaaccggaacgtaaaccgaaccgtaaccggtcccgtttaaacgtactttaacccggttaacacccgtaaaccgtagggttacccgttaaagggacgtacgacgtaaccgtacggaacggttaaagggaacccggttnttaaaccgttccggttaacgttttacgtacgtaacgttccgggacccgggtaacccggaggttaaccgtacggttccggg

SEQ ID NO: 115185 - DNA, 913 bp, Homo sapiens
  misc_feature: GYAE6OF02IH8I2.15.86.H09.1.454.CMB.1.raw
  modified_base (320)..(320): a, c, t, g, unknown or other
  misc_feature (320)..(320): n is a, c, g, or t
  modified_base (846)..(846): a, c, t, g, unknown or other
  misc_feature (846)..(846): n is a, c, g, or t
  modified_base (887)..(887): a, c, t, g, unknown or other
  misc_feature (887)..(887): n is a, c, g, or t
tcagtctacgtagccacgaccggtgctcgatttagtgctatagacttgggtttggggggggagaggagcccccagccttgggatccccaagtgttttcattcagtgatcaggactgaacacagaggactcaccatggagttcggctgagctggtttccttgctgctatacgttaaaagtcgtccagtgtgtaaggtgcgtagggtggtgggtagtcggtagggggacggtccgtttagggtaaaacggtcccgggttcggggggttccccgtttaaggcggttccgttcccgtggttcggtcggtccgtacgtacgggtntttaccgtaacgtttccgtagtaagtggtacgtggtagttaggtacggttcgggttccggaccggtacggtccgtaccggagggggtaacggggtccggttagggtgggttagggtttacgggttaccgttttaaacgtaaaaaaggttaaaaagttaggtaaggttagggtaagtaaaggtaaaaacgtaacgtaaggttacgggtacgtaacccgtaaccggtaaacggtaaaaggtaacgtacgttaaccgaacctaacgttaccgtaacgtaaacggtaaagtaaacgttaaaacgtaaaacggtaaaacgggtaacggttaagttaacgtttacgaaacgtaaaagtacggtaaaacctaaggtaacccgtaaacggaaaaaccggacgtaaacgtaaccgaacgttaacccgtacgtttaacgttaaaccgtaaccgtaaccgtaagtaaccgtaacgttaggtaaaccgtagtagaccgttaaggtaaccgggtaaggtaaccggtcgttaaacggttnttacgtttaacgtacgttaggtacgtccccgggggttaaanacgggttaaccgtaggtttacccggg

SEQ ID NO: 115186 - DNA, 921 bp, Homo sapiens
  misc_feature: GYAE6OF02H2J4P.15.86.H09.1.454.CMB.1.raw
  modified_base (845)..(845): a, c, t, g, unknown or other
  misc_feature (845)..(845): n is a, c, g, or t
tcagtctacgtagccacgaccggtgctcgatttagtgctatagacttgggtttgggggggagaggagccccagccttggatccccaagtgtttcattcagtgatcgagactgaacaccagaggactcaccatggtagttcgggctagagcgttgggtttccttgctgctatacgttaaaggtgtacgagtgtagagtcgacgtaggtcgggtaggtacgtcgggtaggggacgtccgttagggaaacggtccgggtacgggggttaccgtaaggtcggttccttaccggtgttcggtaccggtccgttaggtaggtacttaccgttactttacggtaaggtaacgtgggtacgtaggtacgttagggtagggttcccgggaccccgtaccggacggtacccggtaacccgggtaagggggtaacgggtcggttaaacggggtggggtttaggggtttaaccggtaacccgtttaaaagtaaaaaccggtttaaaggttaggtaacggttagggttaaagaaacggttaaaagtaacgtaccgtacggtacccgtaccggttaaaccggtaaaggaaacggtttaacgtaacgttaacccgacttacgtacccgtaaagaaaccgtagttaaacgtttaaactaaaccggtaaacgttaggtaactttagtaaccgtaaactaaacgtacgaaccgtaacggtaaacccgtaaaccggaaacggacgtaaaccgtaacgttacccggtaaccgtaaccgtttaaacgttccgtaaaccgtaacctaacggttaagtacggttaacgaccggttaagaccgaaacggtttagaaacggggtaggttntttaaaccgtggtttacgtaggtaacgttcgtaccgggttcgaccgggttaaggacgttaccggtaggttacccgg

SEQ ID NO: 115187 - DNA, 764 bp, Homo sapiens
  misc_feature: GYAE6OF02FSZ0N.15.86.H09.1.454.CMB.1.raw
  modified_base (746)..(746): a, c, t, g, unknown or other
  misc_feature (746)..(746): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtgggggagccgttaggtaaggccgtgggggtcccttaggagtccttcctgtgtggccttcgtggtattctactttcagttaagtgggctaggagttggtaggttcgggggtccccgccgaacgggcccttcccggaagggggaacggggggtccgttaggggtaggggtttacggggggtttcggggtaaccggtttttaaccggaaaaaaaaggttaaaaaagtacgggtaagttaggggttaacggaaaggtaaaaagtacgaaaccgttaacgggtcgaccgtaccggtagaaaagggtaacgattaccacgtaatcctacgaaagagtaactaagtaacctaaaaacgggcgtttagttaacttagtaacgaaaattgaacgtagacctaaggaaaacgcggaacacgacgtccgtactagtttaacgcgtaaccagtaacgtagttacggaattcgactaagtaccggtaacggtaaaggcggtactagtacggttctttaagagttacggttcggacggggttacccgngggaacgtacggttccgg

SEQ ID NO: 115188 - DNA, 871 bp, Homo sapiens
  misc_feature: GYAE6OF02I7LVR.15.86.H09.1.454.CMB.1.raw
  modified_base (209)..(209): a, c, t, g, unknown or other
  misc_feature (209)..(209): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgctatacgttaaaggtgtccagtgtgaagtgcgaggtggtggngtgtggggagtccttggtaacgtcggtcggggtcctagaggtctcctggtgtacggtcctcgtggtattactactttacgagttaacgtcggcgttaggagttaggtaggttcgggacccgtacgcggtctaccgggaggggaacgggtcgtagggtaggtgggttacggtagttaactaaaaggtaaacgtgtagtggtaagtaagtaaaagtcgtaacgtacggtcgaccgtaccggtaaggtaaagagtacgttacgtaacgtagttacgaactaagtagtaactaacttaacggaaaacgtcggttaattacgtagaacaaagtccgaaacgttcgaaccggaacgtaaccgggaaacgttacgaccgtaacggttaccttaccggtttaaaacgtttccctaaccgggttaaaccgttaacccgaaaggttttaaccggggtaaccgggttttaacgacgggtaaccccttaaaaggggtttaacccccggaaacgggtttaaaaccggggaccggtttacccgtttaaaaggggttttcccgttaacgggtttttaaacccgttaggtttaaaaccccccgggggttcccggggttaaacccggggtaccccggggtaaaaagggtttaacccgtcccggggggttttaaacccgg

SEQ ID NO: 115189 - DNA, 771 bp, Homo sapiens
  misc_feature: GYAE6OF02JI8DD.15.86.H09.1.454.CMB.1.raw
tcagtctacgtagccacgaccggtgctcgatttagtgctatagacttgggtttggggggggagaggagccccgagccttgggatccccaagtgtttttcattcagtgatcaggactgaacacagaggactcaccatggagttcgggctgagctgggttttccttgctgctatcttaaaggtgtccagtgtgaagtgcaggtggtggagtcgtgggggagtccgttggtaaagccggtgggggtcccttagagtcctcctgtggtcggcctctggtattctactttcagtaatggtctgatgaggttgggccgtccgacggtctaccgaggggtaaggggcgtaggagggttgggttggtacgtttaacgaaaagttaaaatggagttaggtaggaaagtaaaagtaggaaccgttaggtacgactaagtaccggtaagaaaggaagtacttaacgacctaactacgtaagaagtacgtaaataaaccgttaaacgaaaaaccgggtagtttaacggtttaacgttacgactaaaacgtagtaaaccgacgtaaccgtaacggtaaaaacccgaggtaaccacgtaacggtaccgtacttaaacgttctaaccgttaacctaacggtaagtttacttaaccgggtaagtccgaacgttacgtacggtaacggttaacgggaacgttacgttaaagttccgtttagttttaacgtacgttaggttccccgggttaaaccggggtacccggttaaacgggtaccgtttaacggg

SEQ ID NO: 115190 - DNA, 796 bp, Homo sapiens
  misc_feature: GYAE6OF02FN3G6.15.86.H09.1.454.CMB.1.raw
  modified_base (248)..(248): a, c, t, g, unknown or other
  misc_feature (248)..(248): n is a, c, g, or t
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggtttttccttgctgctatcttaaaaggtgtccagtgtgaagtgcaggtggtggagtcgtgggggagccgttggtaaagccgtgggggtcccttagngtctcctgtgtcgcctctggtattctactttcagtaatgggctgggtatggtacggtttcgggtcccgccgaggtcctcccggaagggggaacgggggtcgtgggtacgggttggggtttacgggtaacggttttaacgaaaaaaggttaaaaagttagtagttagggttagaaagtaaaagtaggtaaccgtaacggtcgaccgtaaccggtaaggaaaaggtagtacttaccaaacctactactaacgaagtaagtaactaaacgtttaaccaaaaacgggtacggttagttaacgtttagaaacgaaaatacgtaaacacgtacccggtaagaaaacccggacggaaccaaccgtacggttacccgtactttaacgttacctaaccgtaccctaacgtaaggttacgttaccggtaaagttcaacgtacgtaacgtaacggggtaacggaggtaccttaagttaccggtttcgtttaacgtaagtttccggttaccggggtacccgggtaccccggtaaaggggttacccgtacggtttaccggg

SEQ ID NO: 115191 - DNA, 686 bp, Homo sapiens
  misc_feature: GYAE6OF02HXKGQ.15.86.H09.1.454.CMB.1.raw
  modified_base (376)..(376): a, c, t, g, unknown or other
  misc_feature (376)..(376): n is a, c, g, or t
  modified_base (414)..(414): a, c, t, g, unknown or other
  misc_feature (414)..(414): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcgaggtggtggagtcgtggggggagccgttaggtaaaagccgttggggggtcccttagacgtctcctagtggtcggccttcgtggacttcacctttgagctacgttattggattcgaactttggtcccgcctaggcctccgaagggaagggctggaggtggtggccaacgataacaaaaagntaggaagtgacacaactatgtagtaactgtgtgtacgngggacgtacttcgaccgtctaccgagacgaacgtaccgacaaacgaaactcaactactatccgtgaaccaaattacgaaactaaacccgtaggaaccgtagacccgggaaggtaccaacgggtcctaggttagttaacgtttacgttaggtaggtcggaagtagtacgttaggtttaccgtagggtccgggtttacgggggaacccgtaacggggtaaccccttcggggtacccgttacccccgttacgttaccccttacgacgtacccccg

SEQ ID NO: 115192 - DNA, 951 bp, Homo sapiens
  misc_feature: GYAE6OF02F2D0H.15.86.H09.1.454.CMB.1.raw
  modified_base (381)..(381): a, c, t, g, unknown or other
  misc_feature (381)..(381): n is a, c, g, or t
  modified_base (423)..(423): a, c, t, g, unknown or other
  misc_feature (423)..(423): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttcctgctgctatacttaaaggtgtccagtgtagaagtgcgaggtcggtggagttccgtagggggacgtccgttagggtaaacgcccggttggggggttacccctttaaggacgttccttcccgtggttcggttcggaccccttcgtagggtaacttcctaccgttttacaaggttaagtcggtaccgttagggtacgtagggttacggtttccgggggtacccncccggtagggtacccgtacccgggaaggggtaaccgggggtnttacggggtagggtttaccggggttaggttaaacccggttttacgaaaaaagggtttaaaagtcggtaaacggttcgggaataacggttaaaaactacgggtaaccttacgggtacgaccgtaacccgggtaaggaaacgggtaacgtacgtaccgaaccgtactacgtaacgtaacggtaatacgttaaactaacgtaaaaacggtcgttaagttagtttacgaactaaacgtctaaaccggacccgtaaccggtaacgttaaaccgggaacggtacccgtacggaaccttccggtttaaacgttccgtttaaccgtacggttaacctaacggttacggttaaccggtttaaccgggaacgtttacccggaacggttaaccgtttaccgggggaacgttaaccggacgggtttcccttaaacggtttacgggttacccggttttttaaccggaagtttttacccgggacccggtttaaaccggggggtacccctaaaccgggggttacgtaggttttaacccggggg

SEQ ID NO: 115193 - DNA, 757 bp, Homo sapiens
  misc_feature: GYAE6OF02HPWPU.15.86.H09.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (308)..(308): a, c, t, g, unknown or other
  misc_feature (308)..(308): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggttttccttgctgctatacgttaaaggtgtcctagtgtgaagtgngaggtggtggagtcgtggggagtcgttaggtaacgcggtcggggtccgtagtagtctccgtgtgtcgctntgtatctacttcgtagtagtgtgtgagtgtgtcggccacgngtcgtacggagggaggcgtggtaggtgggttacggtacgttaaagaaaagtaaagtacgtagttaggtacgaaagtaaagtacggtaacgtacggtcgtaccgtaaccggtaaggaaacggtaacgtacttaaccgaccgtacgttaacgacgtaacgtagtaaacgttaaacgtaaaccgaaaaccggtttaggtacgttttaagtagaaaccgtaaagttaacgggaaccctaggtaacccggtaaaagaaccccgggtacgtaaacctaccgggaccggtacccgtttattaacctttacggaaccgttaccgaacgtaggttacgaacgtaacgttccgattaacgggtaccggaaaggtacggtacgtacttaggttgtttcgttaaactagttcgggttaaccggaccggggtaacccctaaggtaccgttaacgttcccggg

SEQ ID NO: 115194 - DNA, 877 bp, Homo sapiens
  misc_feature: GYAE6OF02FNMOY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttagggtaaacgccgttggggggttccccttaggacgttccgtccgttgtggtcggccctcgtgggtacttcctaccttttcgaagttaagtcggcttagggagtcggtaggtttcgggtccccgaccgtaacgggtcccttacccgggagggggtaaacgggggagttaggggtacgggttagggggtttacgggtaacggttttaacgtaaaaaaaggttaaaaagttcggtaagttacgggtaagtaaaaggtaaaaagtacggtaaccgttaacggtacgtacccgtaacccggtaagggtaaaaggaaacggttacttaccgaaaccgtaacgttaccaaacgaaagtaacgtaaactaaacgttaaacccgaaaaaacgggtacgggttaagttaacgtttaacgaaacgtaaaagtacggtaaaaccgtacggtaacccttaaagggaaaaacccgaggtaaaccaccggtaacgtaccgtttaaccttacgttttaaccgacgttacccgaacgtaaggttaacgttaccgggaaagttcgaaccgtaacgtaccggtaaacgggtaacggaggtcgtaacgtttattacggtttagaactttacggtccggttaccggggacccgtaagggtacctaaggttccggg

SEQ ID NO: 115195 - DNA, 713 bp, Homo sapiens
  misc_feature: GYAE6OF02GV81N.15.86.H09.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtntccagtgtgaagtgnagggtggtggaggtcgtgggggatccgttggtaaagccgtgggggtccctagagtctcctgtggttggcctctggtattctactttcagtatgctggatggagttgggtccgcaggcctccgaggggacggggngtggnggttgggtggtacgtttaacgaaaagtaaagngtagtggtaagaagaaaagtagaacgtacggtgaccgtaaccggtaaggaaaggaagtactaccaactactctacaaaggataaacttaattaaaccgaaaaacggtcggttaattaacgtttaggaacctaaaatacggaaacgaaccgacggtaaacgaaaacggacgaaaccacgacgtacctacttaacgtccgttacgaccctaacgaagttaacggttaccggtaagtcgaaccgtaacgtaacggtaaccggtaaaggtaccgggtaataaggttacgttacgtttacgtaagttccggtcgggttaccgggaaccggtacggtactacggttaccggg

SEQ ID NO: 115196 - DNA, 700 bp, Homo sapiens
  misc_feature: GYAE6OF02HPEX7.15.86.H09.1.454.CMB.1.raw
  modified_base (249)..(249): a, c, t, g, unknown or other
  misc_feature (249)..(249): n is a, c, g, or t
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccttaggtaaacgccgtgggggtcccttagngtctcctgtgtggcctctggattctactttcaagtaagtggctaggatggaggttcgggtccgccgacggcctaccggaggggaaggggtcgtagggagggttggggttaggtacgtttaacgaaaaaggtaaaagtgagtaggtagaaagaaaataagacgtacggtcgaccgtaaccggtaggaaaaggagtacttaccactatactacgaagagtaataaacttaacgaaaaacggtcggttattaagttacgataaaagtacgtaaacgtaagaccgtaacggaaaaacccgagggaaccacgacgtacctacttaataccgtacgtaccaacgtaggttaacgttacgggaagtcgctaacgaaccggagggtaaagtaggtcttaagtcggttaagttttagaattcggtcggtacccggggaccgtaagggtacctagttcggg

SEQ ID NO: 115197 - DNA, 808 bp, Homo sapiens
  misc_feature: GYAE6OF02F3KGB.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaaggtgtccagtgtgaagtgcgaggtggtggagtcgtgggggagtccgttagggtaaagtccggtcggggggttccccttaggacgtcctccgtggttcgtcggtccttccgtggtactttcgtactttccagtaatggtcgtggtatggtaggttcgggtccgaccgacgggtcctaccggaagggggaacgggggtctgggtaggttggggttggtacgtttaacgtaaaaagtaaagtggtaagtaggtagaaagtaaaactagtaacgtacggtacgaccgtaaccggtaggaaaaggtagtaacttacgaacctactacgtacgaaagtaagaattaaacgtaaaccgaaaaacggtaggttacgttaatttacgaaactaaagtacgaaacgtaccggtaaccgtaaacggaaaaccggtacggaaccgacgtaaccggtacccgtttacgttaaactttaccgtaacgtaaccccgaacgtaacggttacggttaaccggtaagtacgacgtaacgtaacggtaacggttaaacgggaacggttaacgtaagttcggttaacgtttaaggtaacgttaccggttacgggaaccggggtacccgtaacggggtacctagggttaccggg

SEQ ID NO: 115198 - DNA, 805 bp, Homo sapiens
  misc_feature: GYAE6OF02GZVRV.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgacacagaggactcaccatggagttcgggctgagcttgggttttccttgctgctatcttaaaaggtgtccagtgtgaagtgcaggtggtgggagtcgtgggggtagccgttaggtaaaacgcccggttggggggtcccttaggacgtctccgttggtgtcggcctctggtattctacttcagtaatggctgatgaggttcgggtcccgcgaggccgtaccgacggggaagggggtctgggtacggttaggggttcggtaaccggttttaacgtaaaaaaggttaaaaatggtaacgtgggtaaggtaacgtaaaagtacggtaccgttacggtcgtaccgaacccggtaaggaaagggtaacgaacgtttaccgaacctagtacctaccgaaagacgtaacttaaacgttaaccaaaaacggggtccggttaagttaagtttacgaactaaaacgtacgtaaaccgaacgtcccgtaaaggaaaaaccccgtggaacctaacggaccggtacccttaacgttaacgttacctacgtaccaacgtacggggtaaacttacggggaacggcttacgtaacgtaaccgggtacggtaaaaggtccgggttactaacggttttacgtaacgttttttgaaagttccggttaccgggtccggggttaaacccgacgggtaccggtaagttcccgggg

SEQ ID NO: 115199 - DNA, 759 bp, Homo sapiens
  misc_feature: GYAE6OF02J11JC.15.86.H09.1.454.CMB.1.raw
  modified_base (272)..(272): a, c, t, g, unknown or other
  misc_feature (272)..(272): n is a, c, g, or t
  modified_base (389)..(389): a, c, t, g, unknown or other
  misc_feature (389)..(389): n is a, c, g, or t
  modified_base (754)..(754): a, c, t, g, unknown or other
  misc_feature (754)..(754): n is a, c, g, or t
tcagtctacgtagccacgaccggtgctcgatttagtgctatagacttgggtttggggggagaggagccccagccttgggatccccaagtgttttcattcagtgatcaggactgaacacagagactcaccatggtagttcggctgacgtcgttcggtttcgttgcgtgtccgtatacgttaaacggtgtccagtgtgtaggtgcgtagggtggtggtggtcgtggggacgtcgttaggtaaaggtccggttacggggtccttagacgtctcgngttcggtcgtcccgttcgttacgtacgtttccgtaccgtttagtacgttaacgtcggtacgttacggtacgtaggttaccggttgggtcccccgtccggacggtccggttacccggngggggtaaagggtcgggtcggttaggtcgggtttacggtaacgtttaaacgtaaaaaggttaaaaggtcgtaaggttaaggtaaagtaaggtaaaacgtcggtaacgtaccggtacgtaaccgaaccggtaaggaaaggtaacgtaccgttacgacccgtatacccgtaagtagtaagtacttaaaacgttaacgtaaaaggtccgttaagttactacggtacaagtaacgtacgacagtaaaccgacgagacaccgtacgtactctactacgagtaccaagttcgagttacgaagcgtagacctaaggacctaggtacgtatcgtacgtatagtccgtgttacggacctacggtagtaaccggnttcgg

SEQ ID NO: 115200 - DNA, 888 bp, Homo sapiens
  misc_feature: GYAE6OF02IVTJR.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccttggtaaagccgtgggggtccttagagtctcctgtgtggcctctggattctactttcagtaatggctggatgaggttcgggtccgccgacggctcgaaggggaaggggccgtgggaggttggggttcggtacggtttacgaaaaagtaaaagtgagttaggtagaaagtaaaaagtaggtaaccgttacgggtacgacccgtaacccgggtaaggaaaaacgggtaaacgtaacgtttaccgtaaaccctaacgttacctaacggaaacgtaacggaaactttaaagtttaacccgaaaaaaaacgggtttaccgggttaccgtttaaagtttttacgggaaacgttaaaaagtacggaaaaaccgtaaccggtacccgttaaaagggaaaaaaccccgggtaacgggaaaccgtaaacccggaacggttacccggggtttaaccccttaaagttttacccgttaacccggttacccgtaaacgttaaccgggtaacggtttaacccgggtaaagtccggtaaacgtaccgttaacccggggtaaacgttaaacgggggtaacggtaacgtttaccggttacgggtttactttttaacggggaatttaaccgggtttcccggtaacccggggggaacccgtaacgggggtaacccgtaacggttcccgggg

SEQ ID NO: 115201 - DNA, 894 bp, Homo sapiens
  misc_feature: GYAE6OF02HYLB9.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagctgggtttccttgctgctatcttaaaaggtgtccagtgtgaagtgcaggtggtggagtcgtgggggagtccttgggtaaacggccgtggggggtcccttaggacgttcctccgtggtggtcggccttcgtggtatttccgtacttttcgaagttaagtgggtctgggattggaggtttcggggtccccgccgtagggtcctacccggagggggtaaggggcgttggggtacgggttgggggtttacgggtaaccgttttaaccgaaaaaaggttaaaaaagtggtaaggttagggttaaggaaaggtaaaaagttacggaaaccggttacgggtcgaccgtaacccggttaggaaaacgggtaagtacgtttaaccaacccgtaacttccgtaacgaaaggtaacgtaaatttaaacgtttaaaccgaaaaaacgggttcgggtttaagttttaagtttacgaaacgttaaaacgtacgaaaaccgtacgtaacccggttaaaacggaaaaaccgggtaaggaacccgtaaccgaaccggtcccggttaaactttaaacgtttaacccgttaacgtaaaccccaaaggtacgtaacgtttaacccggggaaagtttacaaccgttacgggtaccgttaaaccgggtaaaggggacgttaacgttacggtttacgttaaccggtttttagaggtttacctacggggttaacccgggaccccggtaagggtacctaagggttaccccggg

SEQ ID NO: 115202 - DNA, 774 bp, Homo sapiens
  misc_feature: GYAE6OF02IK1XF.15.86.H09.1.454.CMB.1.raw
  modified_base (693)..(693): a, c, t, g, unknown or other
  misc_feature (693)..(693): n is a, c, g, or t
  modified_base (725)..(725): a, c, t, g, unknown or other
  misc_feature (725)..(725): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttagggtaaacgccggttcgggggtcccttaggagtcctccgttggtcgtcggccttcgtggtacttctactttcgagtagtggtcgtggagtggtaggttcgggtcccgcgacggtcgtaccggaggggacgggcgtgggtacgggttggggttacggtaacgtttaaacgaaaaggttaaaacgtggaggttagggtaagtaaaggtaaaacgttaaggtaccgttacggacgtaccgaaccggttaaggaaacggtaaagtacttacgaaccgtaatacctaacgtaaaggtaacttaacgtaaacgtttaaaccgaaaaacggtcgggtttaattacggtttaacgaactaaaagtacgaaaccgacgtaaccgtaaaccggaaaaccgtacgaaccgtaaccgtacgtactaccttacgtaacctacgtaaccgatacggtacgttaacggaagtcgtacgtanacggaacggtaagtcgaacgttagttaccgtnttttaggacttaggttccggaccgggtacgaacggtacgtaaggtccgg

SEQ ID NO: 115203 - DNA, 801 bp, Homo sapiens
  misc_feature: GYAE6OF02J0SYV.15.86.H09.1.454.CMB.1.raw
  modified_base (210)..(210): a, c, t, g, unknown or other
  misc_feature (210)..(210): n is a, c, g, or t
  modified_base (309)..(309): a, c, t, g, unknown or other
  misc_feature (309)..(309): n is a, c, g, or t
tcagtctacgtagccacgaccggtgctcgatttagtgctatagacttgggtttgggggagaggagccccagccttgggatccccaagtgttttcattcagtgatcaggactgaacacagaggactacaccatggagttcgggctgagctgggttttcctgctgctatacgttaaaaggtgtcctagtgtggagtgcgagggtggtacggnggtcgtggggacgccgttaggtaaggtccggtcgggggtccttagacgtcgtccgtgcgtcggtccgtgtggtattctacgtttcgagttacgtcggtntaggtatcggtacgttcgggtaccgctacgggtaccgtcggaacgggggtacgggtcgtaggggtacggttaggggttacggttacggtttaacgaaaaacgggttaaaagtggtaacgttgggtaaggtaagtaaacggtaggttaaccggttaaggttcgaaccggtaaccgggtaacgggtaaaaggtaacgtaacggtttacaaccgttggtaacctttaccggaaaggaagactttaaaacgttaaccgaaaacgggtccgttaaggttacgttaaggaactaagtaacgaacgtagaaccgtaaacggaaacggacgtaacgacgtactaccgtgttaacttgtaaccggactaacgaagttaccgttaacgtaacgtacggcgttaaaccgtaagtacgggtaaagttaccggacgttacttcgtaaacgtttacggtaattccggttaacgggtccgtaaccgggaagttaccgtaggttccgg

SEQ ID NO: 115204 - DNA, 963 bp, Homo sapiens
  misc_feature: GYAE6OF02H3Y67.15.86.H09.1.454.CMB.1.raw
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagcgttgggtttttccttgctgctatacttaaaaggtgtccagtgtgaagtgcgtaggtggtgggagtcggtgggggagtcccgttaggtaaacggtccggtcggggggttcccttaaggtacgttcctccgtggtcggtcgggtcccttcgtggtacttctacgtttactaagtaatggtctggattggtaggttccggggtcccgccgtagggcctaccggaagggggaacggggtctaggggtacgggttggggttacgggtaaaccggttttaaagtaaaaaaacggttaaaaagttcgggtaggttagggtaggtaaaaggtaaaaagttacggtaaaccggttaaccgggtacgaaccggtaacccgggttaaagggaaaaacggggttaactaacccgtttaacctaaaaccgtaattacccgttaaaccggaaaaggtaaacgtaaactttaaaacgtttaaaacccggaaaaaaccgggttcgggtttaaaggtttaattttacggaaaacttaaagtaacgaaaacctaaccggtaaacccgttaaaaccggaaaaccggtaacgaacctaccgaacgtaccgttaaacgttacttaaaccgtacgtaacccgtaataaacgggtaaccgtttaacgggaagtttaccgtaaccgtaagggttaacccggttaaacgggttaaacggggtacgtaacggtttacccgtttaggttttaaccggtttaagtttaacccggttaccggtttacggggtccccggggtaaaccccgggttaaggggtaaacgttcgggtttaccgggg

SEQ ID NO: 115205 - DNA, 720 bp, Homo sapiens
  misc_feature: GYAE6OF02GYPAS.15.86.H09.1.454.CMB.1.raw
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (442)..(442): a, c, t, g, unknown or other
  misc_feature (442)..(442): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
  modified_base (607)..(607): a, c, t, g, unknown or other
  misc_feature (607)..(607): n is a, c, g, or t
tcagtctacgtagccacgaccggtgctcgatttagtgctatagacttgggtttggggggggagaggagccccgagccttgggatccccaagtgttttcattcagtgatcaggactgaacacagaggactcaccatggagttcgggctgagcgttgggttttcctgctagctatacttaaaggtgtccagtgtgaagtgcagggtggtggagtcgtgggggatccgttaggtaaacgcggttgggggtcccttaagcggtctccgtgtacgtggcctgtggtattcactttgacggttaancggtctggagttggtacggttcgggcccnccgtaggcctacggaggggaacggggtcgtaggggtggttgggttacggtacgtttaacgaaaaaggttaaaagtgagttagggtagaaagtaaaactggtacgttaaccggngtaccgaccggtagaaaaggatactcaactatccacaagagtaataaacgttaacgaaaacgtgttagttacgtagtaacgtaanacgtaanacgtacgaacggaaacggacgtacgactcgaccgtctacgtactacgtaaccagtaacgttacgtaagtacgngtacgtaacggtacgttaacgggaacggttacgtacgttacgtacgtttacgttcgtaaacgttcggttccgggttaccggggaccctaagggtacccggtaggtttcccggg

SEQ ID NO: 115206 - DNA, 748 bp, Homo sapiens
  misc_feature: GYAE6OF02HOFKI.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgtctatacttaaaaggtgtccagtgtgaagtgcaggtggtggagtcgtgggggagccttaggtaaagccgttgggggtcccttaggagtctcctgtgtcgcctctggacttctactttcagtaatggactggatgtaggttcgggtcccgtcgacggtctacccgaaggggaacgggcgtagggtagggttgggttacggtaacggtttaacgaaaaaaggttaaaagtaggaaggttacgggtaagaaaaggtaaaaaacgttagaaacgttaacggtacgaccgtaaacccgggtaaggtaaaagggaaacgtaacttacaaaccgtaattacctaacgaaagaagtaaattaaactaaacgaaaaacggtaggttaagttaacgtttagaactaaaagtacgtaaacacggtactaacggaaaacgcggaacaacgaccgtacgtaactatactacgtaccaagtacgtacttacggaacgtacgatacgtaacggtaagtaacggtagtcttaacgtcgttaattttacgacttacgtacggacccgggtacccggtaaagggtaccgtaaggttccggg

SEQ ID NO: 115207 - DNA, 732 bp, Homo sapiens
  misc_feature: GYAE6OF02IX5VS.15.86.H09.1.454.CMB.1.raw
  modified_base (207)..(207): a, c, t, g, unknown or other
  misc_feature (207)..(207): n is a, c, g, or t
  modified_base (488)..(488): a, c, t, g, unknown or other
  misc_feature (488)..(488): n is a, c, g, or t
  modified_base (538)..(538): a, c, t, g, unknown or other
  misc_feature (538)..(538): n is a, c, g, or t
  modified_base (605)..(605): a, c, t, g, unknown or other
  misc_feature (605)..(605): n is a, c, g, or t
tcagtctacgtagccacgaccggtgctcgatttagtgctatagacttgggtttgggggggagaggagcccagccttgggatccccaagtgttttcattcagtgatcaggactgaacacagaggactcaccatggagttcgggctgagctagggttttccttgctgctatcttaaaaggtgtccagtgttgaagtgcaggtcggtggngtctgggggagccttggaagccgttgggggtccttagagtctctgtgtggcctcgtggatttcactttcgaagtaagttgcgttggagtggtaaggttgggtaccgccgaggtcctacccgaggggaacggggtcgtggacggttggggtagggtaccgtttacgaaaaagttaaaagttcggaattgggtaggtaaaacggtaaaagtaacggtaaccgttacggtcgaccgtaacccggttaaggaaacggttaaggaactttacgacctataccttanaaacgtaggattaaatttaacgaaaaacgtcgggttagtatttacggtanaagtaagaacactacggagaaaacccgaagacaacgtcgaccgtacttaagtacctagtacccgaanacggtaacttacgggtaagagtaccgtagtaacggtacgtaaagggttacgaacggttatttacggcgtttttaacggagttacttcgggtaccggggtaaccggtacgggcgttaacggttacggg

SEQ ID NO: 115208 - DNA, 981 bp, Homo sapiens
  misc_feature: GYAE6OF02HNFSD.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgtgggttttccttgtctgctatactaaaggtgtccagtgtgaagtgcgaggtggtggagtcggtagggggacgtccgttagggtaaacgtccggttacgggggtacccttaggagtccttccgtggtggtcggccttcgtcggtattaccttacttttaccgaagttaaacgttggtaccgttagggtacgttggttacgggtttacgggggtccccgtccggtaacgggacccttacccgggtaagggggtaaacggggggtccggttaagggggtacggggttggggggtttacgggttaaccggttttaaacgtaaaaaaaggtttaaaaacgttggtaaacggttagggtaaaggtaaaaggtaaaaacgtaggtaaaccggttaacgggtacgtaacgtaacccgggttaagaaaacggtaaacgtaacgtacgtaacctactacccgtaacaaacggtaaagtaacgtttaaaacgtaaccgaaaaaaccggttaggttaaacggttttaacgtttaacggaaaccttaaaggttaaccgaaaaccggtaacccgggtaaaaaccccggtaaaaacccgggaaacggtaaacccggacccgttaaaaccgggtcccgtttaaaccgtttaaacgttacccgttaaacgtaaaccccctaggtaaactaaggttaaccgggttacgaacccgtacgaaccgttaaccggggaaaagtaacggggactttaaccggttaagtcggttaacttttcgaaaggttttacccggtcgggtaaccccgggtaccggaagggggtttaaccacggggttaccggttccccgg

SEQ ID NO: 115209 - DNA, 588 bp, Homo sapiens
  misc_feature: GYAE6OF02HFKS7.15.86.H09.1.454.CMB.1.raw
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
  modified_base (529)..(529): a, c, t, g, unknown or other
  misc_feature (529)..(529): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttggtaaagccgtgggggtcccttagagtctcctgtgtggcctctggattcactttcagtaatggctggatgagttgggtccgccgaggcgtccagggaggggctggagtggtcggacgtttacaaaagtaaaatgagtggtagaagaaaatagactacggtagcaccgtagaaaggagatacgacatctacgaagagataatacaaaacgtggtattattganaatgaacngactagaaacgngaacagagcctatattacngtaccagtagtacgttgaagtgactagtaccgaggtaaggacggtntacgttgttaccgtttagagttacgtcggtaccgggtacccagggtacctaggttccgg

SEQ ID NO: 115210 - DNA, 692 bp, Homo sapiens
  misc_feature: GYAE6OF02I9C7J.15.86.H09.1.454.CMB.1.raw
  modified_base (181)..(181): a, c, t, g, unknown or other
  misc_feature (181)..(181): n is a, c, g, or t
  modified_base (319)..(319): a, c, t, g, unknown or other
  misc_feature (319)..(319): n is a, c, g, or t
  modified_base (639)..(639): a, c, t, g, unknown or other
  misc_feature (639)..(639): n is a, c, g, or t
tcagtctacgtagccacgaccggtgctcgatttagtgctatagacttgggtttgggggggggagaggagcccccagccttgggatccccaagtgttttcattcagtgatcaggactgaacacagaggactcaccatggagttcgggctgagcttggttttccttgctgctatctaaaggtntccagtgtgaagtgcgaggtgtggagtcgtggggatcgttgtaagccgtggggtcctagtagtctctgtgtcgtctctggattctcttcgagtatcgcgtgacgtgtagtggtacccgcgagtcgtcggagggacggngtggtacggtggttaaggtacgttaacgtaaaaggtaaacgtagagttaggtagtaaacgtaaagtacggtaacgtaaggttacgaaccgtacccggtaaaggaaagtaacgtacgttacaacgtactacacgaagtagaacttaaagtaaacgtaaacgtaggttagttacgttagtacgtaaagtacgaataccggtaacgtaacgaaacggtaacgacaagacgtacgtactacttacgacgttaacacgaagtacgtaacgggttaactgaacccgtgtaacccggtagaaacggtaccgtaagttctaacggttnttaacggtcgtacggtcggtaaccgggtaccgaacgggtacgtaccggttagg

SEQ ID NO: 115211 - DNA, 668 bp, Homo sapiens
  misc_feature: GYAE6OF02I941J.15.86.H09.1.454.CMB.1.raw
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
  modified_base (497)..(497): a, c, t, g, unknown or other
  misc_feature (497)..(497): n is a, c, g, or t
  modified_base (607)..(607): a, c, t, g, unknown or other
  misc_feature (607)..(607): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggtttccttgctgctatacttaaaggtgtccagtgtgaagtgcaggtggtggagtcgtggggagccgttggtaaacgcgtgggggtcccttaggtacgtctctgtggtcggcctcgtggtcttactcttcagttaactggtatcggtatggtagttcgggtcccncgacgggctccggaacggggaggggctggaggtgggtggtaccggtttaanaaaacggttaatagagtacggtggaacgtaaaatcgtaacttacggtcgacgaaccggtagaaacggagtacttcaaccgtntcaanagtagtaataacgactaaaacggngttaacgttgtaagactaanacgtaacacgtactaagaaaccggacgaacagaacgtactacgttattaaccgtctaccgaactacgtaagttctaaacggtgaccgaagtccggtaaggaggtaacggnttaaccgttgtactttaagtagtacgttagggaccggtccggacgggtactaggtaccggg

SEQ ID NO: 115212 - DNA, 1199 bp, Homo sapiens
  misc_feature: GYAE6OF02IJ7JP.15.86.H09.1.454.CMB.1.raw
tcagtctacgtagccacgaccggtgctcgatttagtgctatagacttgggtttgggggggggagaggagcccccagccttgggatcccccaagtgttttcattcagtgatcaggactgaacacagaggactcaccatggagttcggggctgagctgggttttccttgctgctatcttaaaaggtgtccagtgtagaagtgcaggtggtggagtcgtgggggagtccgttagggtaaacggccggttcggggggtccctttaaggacggttcttcccgttggttggttcggtcccgttacgttgggtaactttccgtaacctttttaccgaaggtttaaaagttgggtacccgttaggggtaaagttagggtaaggggttttccggggggttaccccccggtacccgaaacggggtccccgtaccccggggtaaaagggggggggtaacgggggggtaccgtttagggggggtaaaaccgggggttttggggggggttttacggggtttaaacccgggtttttaaaaccgaaaaaaaaaacgggttttaaaaaaaaacgttcgggtaaagggtttaagggggtaaacggtaaaaaggttaaaaaaaaggttacgggtaaacccggtttaaaccggggttacgggaaaccccgtaaacccccggggttaaagggaaaaaaggggtaaacggttaaccgtttaacccgaaaacctaccgttacccggttaaacaaaacggtaaaggttaaaaccttaaaaacgtttaaaacccggaaaaaaaacccgggttaaccggggtttaaggttttaaactttaaccgggtaaactaaaaacgttaaacgggaaaacccgtaaaggtaaccccggttaaaacgggaaaaaaaccccgggtaacggaaacccgtaaacgtacccgggttaaccccccggtttaagtttaaaaccgtttaaccggtttaaccgttaaaccccggaacttaaagggtttaaaccggttaaaccgggttaaaccggtacccgtaaacgtaaccgggtttaaaccgggtaaaaccgggggttaaaacgggttaaacggggtaccccgtttttaaaggttaaccggggtttttacggttttttaaacggtaacccgtttttaaacgggttaacccggggggttttccccccgggggaaaaccccgggtttaaacgggggaaacc

SEQ ID NO: 115213 - DNA, 931 bp, Homo sapiens
  misc_feature: GYAE6OF02H1Y55.15.86.H09.1.454.CMB.1.raw
tcagtctacgtagccacgaccggtgctcgatttagtgctatagacttgggtttggggggagaggagcccccagccttgggatccccaagtgttttcattcagtgatcaggactgaacacagaggactcaccatggagttcgggctgagctgggttttccttgctgctatacttaaaaggtgtcctagtgtgaagtgcgaggtggtggagtcgtgggggagccgttggtaaacgccgtcggggggttcccttaggacgtctccgtggtcggtcggtccttctggtattactaccttttacaaggttaaatcgggtctacggtagttggaggtttacggggtcccgtcccgaggtcccgttacccggaagggggaacgggggtccgttaggggtacgggttcggggttacgggttaaaccggttttaaccggaaaaaaagtttaaaaagtcggtaaagttcggggttaagaaaggtaaaaacgtacggtaaccggttaaacggtccggtaccgaaaccccggttaaagggaaaacgggtaaagtaacgttaccctaaaccgtaacgttaccgtaacgtaaacggtaaacgtaaacttaaaacgtttaaacgaaaaaaacccgggttcggttaaaggtttaagttttaacgaaacgttaaaacgtacggtaaacgtaaccggttaacccgtaaaacgggtaaaaaaccccggtacggaaaccgtaaccgaaaccgggtacccgtttaacgttaacgttttaacccggtaacttaaacccggaactaaacggttaacgttacgggtaagtaccggaaattaaccggtaacggtaacggtaaaggtacggtactaacggttacgttacgttttaaggtaacttaccggttcgggtaccgggggaaccccggtaaggtaccgggtaagttaccgggg

SEQ ID NO: 115214 - DNA, 759 bp, Homo sapiens
  misc_feature: GYAE6OF02JYLFL.15.86.H09.1.454.CMB.1.raw
  modified_base (212)..(212): a, c, t, g, unknown or other
  misc_feature (212)..(212): n is a, c, g, or t
  modified_base (291)..(291): a, c, t, g, unknown or other
  misc_feature (291)..(291): n is a, c, g, or t
  modified_base (691)..(691): a, c, t, g, unknown or other
  misc_feature (691)..(691): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttccttgctgctatcttaaaggtgtccagtgtgaagtgcaggtgtggagtctgggganccgttggtaaagccgtgggggtcctagagtctctagtgtggcctacgtggattcacttcgagtaatggcgtagataggngttcggtccgccgtaggtccgtaccgaagggggtaagggggtcgtacgggtaaggttggggttacgggacgtttaaacgaaaaagtaaaaagttggtaagtaggtagaacgtaaaaagtaagaacgtaacggtcgaccgtaacccggttaaggaaaaggaagtaactactaaccattaccgactaaagaacgtaataaacgtttaacgaaaaaccgtgggttaactttaaggttagtaaacgtaaacgtaccgtaaaagaaccggtacctaaacggttaaaccgaccgggtaaccacggaaccggtacccgtaacgttaacgttaacctttaccgaaccgtaacctagtaacgtttacggaaacgttaggacctaacggtaacgtacgtaaagggacgtnttaacggttagttcctttaaggatttacgtacgggaccgggtaacgtacggtacgtaaggttcccggg

SEQ ID NO: 115215 - DNA, 981 bp, Homo sapiens
  misc_feature: GYAE6OF02HSMJN.15.86.H09.1.454.CMB.1.raw
  modified_base (196)..(196): a, c, t, g, unknown or other
  misc_feature (196)..(196): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcggctgagcttgggttttcctgctgctatacttaaaggtgtctagtgtgaagtgngaggtggtggagtcgtgggggagtccgttaggtaaacggtccggttcgggggttcccttaggtacgttccgttccgtggttcggtcggtcccgttacgttcggtaactttcctaacttttacgtaacggttaaggtcggtaccgttgggtaagtttagggtacgggtttccgggggtccccggtacccggtaacggggtccgttaccccggggaaggggggtaaaccggggggttccggttggggggtaaggggtttcgggggttttaacggggttaaaccggtttttaaaccggaaaaaaagggtttaaaaagttgggttaaaggttacgggtaagggtaaaaaggtaaaaacggttaacggtaaaccgggttaccgggttaccgaaccggtaaacccgggtaaggtaaaacggggtaaacgtaacgtttaacccgaaccttaacgttaccgtaaaccggtaaaggtaaaagtttaaacgtttaaaaccgttaaaccgtaaaaaaccgggtgggttttaaacgtttaagtttaaacggaaccttaaaaaggtaacgaacgtaaccggtaacccgtaaaacggaaaacccggtaggaacccaagggaacccggttacctttaacgtaacgttacgtaaccgttaccaagtaacgttaccggttaagtaaccgcgaacgtaaccgtaggtaaacccgggtaaggagttaaccgtaggtttacgttaccgtttaaggacgtttccggccgggacggtaccccgggaaggtacccgtagggttccccg

SEQ ID NO: 115216 - DNA, 820 bp, Homo sapiens
  misc_feature: GYAE6OF02GVDBR.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgtggtttcctgactgctatactaaaggtgtccagtgtgaagtgcaggtggtggagtcgtgggggacgccgttaggtaaacgccgtgggggtcccttaggacgtctcctgtgtggcctcgtaggtattctactttcagtaatggcgtaggtatgtaggttcggtcccgtcgacggtcctacggtaacgggggaacggggtcgtgggtagggtttacggggttggtaaccggttttaacgaaaaaaggttaaaactagggtaacgtagggtaaggaaaacggtaaaaacgtaggtaaccgttaacgggtacgaaccgtaacccgggttaaggaaaaacgggtaacgtaccgttacgaacccttactaactaacgtaaacgtaacggtaaacttaaacgttaaccgaaaaaaccggtcggtaacgtttaagtttacgaaacgtaaacgtaggtaaaccacgttaacccggaaacggaaaaccggtaacggtaacctaacgaaccgtacgttaacgtaacttaccgtaacgtaacccgagtaacggttacgtaggtaaacgtaccgtagtacgtacggtaaccggtaaggacggtaccgttattaacgggttctttaggtaacttacgggtacccggtaacggtacccgggtaaggtaccgttacggttacggg

SEQ ID NO: 115217 - DNA, 891 bp, Homo sapiens
  misc_feature: GYAE6OF02FYM8B.15.86.H09.1.454.CMB.1.raw
  modified_base (577)..(577): a, c, t, g, unknown or other
  misc_feature (577)..(577): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggctgagctgggttttcctgctgctatcttaaaaggtgtaccagtgtgaacgtgcaggtaggtgggaggttcgtggggggaactccgttagggtaaaacgtccggttcggggggtaccctttaaggacgttccgtcccgtggttggtacgggtccttcgtgggtaactttcctacttttcaaggttaatgggcttagggtactggtaacgggtttcggggtacccgtccggacgggccgttaccccggaaggggggtaacggggggcttgggggaagggttacgggggtttaggtaaccggttttaaacgaaaaaaggttaaaacgttaggtaacgttaggggtaagtaaaggtaaaactaggtaaaccggttaggttacgaccgtaaccggtaagggaaaacggtaaagttactaaccgaactaacgtaccgtanaaaacggtactaagttaaaacttaacgtaaaaaacggttagggtaagtttaaacgtttaggaaacgtaaagtacggtaaaccgaacggtaaccgttaacggaaaaaccggtggaaacccgtaacgacgtacccttaggtaaacttacgtacgtaaacccgtacgtaactacggttaaggttaaccgaggtaccgtaacgttaccgggtaaacggtaaacgggtacgtacttaccgttaaggtttccgtttaagtacgtaacgttcccggggttaaccgggaccccgggttaaggtaccgttaagggtttaccgg

SEQ ID NO: 115218 - DNA, 971 bp, Homo sapiens
  misc_feature: GYAE6OF02GH74B.15.86.H09.1.454.CMB.1.raw
  modified_base (219)..(219): a, c, t, g, unknown or other
  misc_feature (219)..(219): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttccttggctgctatacttaaaaggtgtccagtgtgaagtgcgaggtggtggacgtcgtggggacnccgttaggtaaacgccgtgggggtcccttagacgtctcctgtcgtggcctgtggtattctactttacaggttaatcggtctggagttcggtaggttcgggtcccgcgtacggtccgtaaccggacgggggtaagggtccgtacggggtaggttcggggttcgggttaaccggttttaaacgaaaaaaggtttaaaaacgttaggtaaggttaagggtaaggtaaaaccggtaaaaaagttacgtaaaccgggttaaccggttacgaacccgttaaacccgggtaaagggaaaaacgggtaaacgttaacgtttaaccaaacccttaaagtacccgttaaacggaaacggtaaagttaaacttaaaaccggtttaaaaccgaaaaaaccgggttaggggttttacgtaaacgttttacggaaaaccgttaaaattccgggaaaacgtaacccggtacccggtaaaaccgggtaaaaacggaaccgggttaacccgaaacccgttccggtaaccggtttaaccttaacggtttaaccgaaccgttaacccgaacgtaaacggtttacgggttaacgggtaacgtaacggttaacctaaccgggtttaacccgggaaacggtttaaaacggggtccggttaacggtttttaacgtacccgggttttaagttttaaccggtaaggtttaccgggtttacccgggacccgggggttaaaccccggtaaggggttaaccgtgggttttaaccccgggg

SEQ ID NO: 115219 - DNA, 1021 bp, Homo sapiens
  misc_feature: GYAE6OF02HTHYH.15.86.H09.1.454.CMB.1.raw
  modified_base (199)..(199): a, c, t, g, unknown or other
  misc_feature (199)..(199): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttgggctgagcttgggtttttccttgctgtctatacgttaaaaggtgtccagtgtgaagtgnaggtggtggagtcgtgggggactccgttaggtaaacggtccggttacggggggttccctttaacggcgttccgttccgttggttaggttccggtcccgttacgttacggtacttttaccgtacctttttaccgtaaggttaaacgttgggtaccttaggggagttagggttacgggtttccggggggttacccgccccggtaacggggtccgttaacccggggaaggggggtaaacggggggtaccgttagggggttacgggggttacgggggttttacggggttaaaccggttttaaaagtaaaaaagggttaaaaaaagttgggtaaaggtagggttaaacgggaaaagttaaaaaacggttaacggtaaccgggttaaacccgggttacggaaaccccggtttaaccccgggtaaaagggtaaaaacgggttaaaacgtacggtttaaccctaaacccgtaacttaaccggttaaccgaaaggtaaaccgttaaaagtttaaacgttaaaaccggtaaaaaaccgggttaggtttaaacggttttaacgtttaaaccgaagttaaacgtaaagaaaccgtacggtaacctaaaacggaaaacccggtaaggaaccctaaccggtacgtacccgtacgttttaaacgtaccgttaccgtaaacgacgtaacgttaacggttacgaaaggttacgaacggtccttaaagggaacgggttaaacgggaccgttagttaaacggtttgttaagtttttacgaagtttaccgggttaacgggttacccgggacgggttaaacggtaccggttaacggttccggg

SEQ ID NO: 115220 - DNA, 810 bp, Homo sapiens
  misc_feature: GYAE6OF02IREUJ.15.86.H09.1.454.CMB.1.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (759)..(759): a, c, t, g, unknown or other
  misc_feature (759)..(759): n is a, c, g, or t
tcagtctacgtagccacgaccggtgctcgattttagtgctatagacttgggtttgggggggggagaggagccccagccttgggatccccaagtgttttcattcagtgatcaggactgaacacagaggactcaccatggagttcgggctgagcggtcggtttcgtgacgtgctatacgttaaagtgtcagtgtgagtgcgaggtggtggagtcgtggggngtccttaggaagcgtcgggggtcctagngtctcctgtgcggctcgtgtacttctcttcaagtagtggtcgtgtgtggtggttcgggtcccgtccgacggtacctccgggaaagggggaacgggggtcctagggggtgggttaggggttacggggttaccggtttaaagtaaaaaaaggttaaaacgtgttaaaggtggttaacggtaaagaaaagtaacgtagttaacggtacggtaccgtaaaccggttaaggaaaaggtaacgtacgtttaccaaacgtacgttacgtaacctaaaagtaagtaaattaaacgtaaacggttaaaaacgaacgtttacgttaacgtttgaaacttaagtacgtaaacgaccgtaaccgtaaaacgaaaccccgaggtaacccaacgtaaccggttcctaacttactttaaccgtaacccgttaaccacgtaaacgttaccgttaaacgggttaaccgcgtaaacgtacgttaaccggtaagggttaaccggaagttattaaccgttgtttaacggttnttaacggttcttacggggttaaccgtacggaacgggtacgttcggtaacgg

SEQ ID NO: 115221 - DNA, 841 bp, Homo sapiens
  misc_feature: GYAE6OF02GA71C.15.86.H09.1.454.CMB.1.raw
  modified_base (831)..(831): a, c, t, g, unknown or other
  misc_feature (831)..(831): n is a, c, g, or t
tcagtctacgtagccacgaccggtgctcgatttagtgctatagacttgggtttggggggggagaggagccccagccttgggatccccaagtgttttcattcagtgatcaggactggaacacagaggactcaccatggagttcgggctggagctgggttttccttgcttgctatacgttaaaaggtcgtccgtagtgtgtaagtcgcgtagggttggtcggagtcggtggggaggtccgttagggtaacgtccggtacgggggtcccttaaggcgttccgttccgttggtcggtcggtccgtcgtcggtacttcgtacctttgtaagtaacgtggtcgtaggagttaggtaggttcgggtaccccgtaccgtacgggtctaccgggaacggggtaacggggcggttagggtacgggttagggttacgggtaccgttttaaaaggtaaaaaggttaaaaagtacgtaaggttagggtacgaaaaggtaaagttacggtaaccgtaacggtgaccgtaaccggtaaggaaaagtaacggtacgttaccaacgtaagtccgtaacgaaagtaacgaattaaaccgttaacgtaaaacgggtacgttagtacttaggtactaaacgtacggaactacggaaaccgttaaccggaaaccggtacgaaacgtacccggacgtaaccggttacttaacgttaccgttaacgacccgtaaacgtagtaccggttaaagtaccgtacgtaccgtaagaccggttaacggaaacggtacgtcgtaacggttacgttctttaaggaactttacggtacccggtccgggtaacaccggggttanagtcccgggg

SEQ ID NO: 115222 - DNA, 860 bp, Homo sapiens
  misc_feature: GYAE6OF02J1ZOB.15.86.H09.1.454.CMB.1.raw
  modified_base (218)..(218): a, c, t, g, unknown or other
  misc_feature (218)..(218): n is a, c, g, or t
tcagtctacgtagccacgaccggtgctcgatttagtgctatagacttgggtttgggggggggagaggagccccagccttgggatccccaagtgttttcattcagtcgatcaggactgaacacagaggactcaccatggagttcgggactggagcgttcgggttttccttgctcgctatacgttaaaggtgtaccagtgtagaagtgcgaggtggtggnggtcggtagggggacgtaccgttagggtaacggtccgggttcgggggttaccctttagacggttccttccgtggttcgtacggtccttctggtacttctaccgtttacgaaggttactgggtcgtagggtattgggtacgggtttcgggacccggccgtacggccgtaccgggagggggacggggtgtaggggtacggttaggggttacggtacgtttaaacgtaaaagtaaagtgtacgtaggtaagaaaggtaaaacgtcggtaacgtacggtaccgaaccgtaccgggtaaaggaagtaacgtaccgtaacgacctacgtaacgtaacgaaggaacttaaacgttaacgtaaaccgtaaaacggtcggtttaacgttaagtaccgaattaaacgacgaacccgaacgtacccaaacgggttaaacccgacggaacccgtacgtaccggtttaaaccctgtttaaacccgttcgttaaaccgaacccgtttaaacgaacgggttaaccgttaagggttacccgtaacgtaaccggtacgttaaccgggaagacgggtttaactgttacggttagtttcgtttaagacggttacccgttaggggaaccccggacggtttaaggtaccggtaccggttccgg

SEQ ID NO: 115223 - DNA, 883 bp, Homo sapiens
  misc_feature: GYAE6OF02H6SFV.15.86.H09.1.454.CMB.1.raw
tcagtctacgtagccacgaccggtgctcgatttagtgctatagacttgggtttgggggggagaggagcccccagccttgggatccccaagtgttttcattcagtgatcaggactgaacacagaggactcaccatggagttcgggctgagctgggttttccttgctgctatacttaaaggtgtccagtgtgagtgcaggtggtggagtcgtggggagaccgttggtaaaggccgtgggggtacccttagacgtctcctgtgtcggcctgtggattcactttcgagttaagtggcttggagttgtaggttcgggtcccgtccgacggtccgtacccggaagggggaacggggtcgtagggtacgggttggggttacgggttacggttttaaacgaaaaaggttaaaaatggtaagtacgggtaagtaaacgaaaagtaggaaccgttacggtagaccgtaacgtaacggaaaaggaagtaacttacaaccgtaataccgttaagaaacgtaacgtaagttaaaaccgtttaaaccgaaaaaaccgggtagggtttaaacgttttaacgtttacggtaaacttaaaaggtaacgaaacccggtaagttaacccggtaaaacggaaaaacccgggtaacggaaaccgaaccggttaaaccgtacccggtttaacctttaacgtttaacccgttaaccgtacccgtaaaccgtaaggttaacggttaacgggtaaagttaccggtaaccgtaacgttaaccgggtaaacggttaaacgggggaaccgttaacggtttaagttaccggtttaacgttttaggtaacgtttacggtaccgggtacccggggaaccccggtaaaggggtaccggtaaagggtttcccgggg

SEQ ID NO: 115224 - DNA, 798 bp, Homo sapiens
  misc_feature: GYAE6OF02FIS3H.15.86.H09.1.454.CMB.1.raw
  modified_base (718)..(718): a, c, t, g, unknown or other
  misc_feature (718)..(718): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtgtccagtgtgaagtgcaggtggtggagtcgtgggggagccgttaggtaacgccgtcgggggtcccttagagtctccgtgtgtggcctcgtggacttctactttcagttaagtggtctggatggtaggttcgggtcccgccgtacggccgtaccggagggggacgggggtcgtaggggtagggttcggggttggtaaccggttttaacgtaaaaaaggttaaaaatagggtaagttacgggtaaggtaaaaggtaaaaagttaaggtaaccgttaacgggtaggtacccgtaaccggttaacggaaaagggtaaacggtaactttaccgaaaccctaacgttaccctaacgaaacggtaagtaaacttaaacgttaaaccgaaaaacgggtcggtttaagtttaacgtttaacggaacctaaaagttacgaaaccgtaacgtaacccgttaaaccgggaaaacccggtacggaaccgaaacgtacgtacccggtttaattacttaccgtaccgtaacctaacgagtacgttacgaagtnacgtataccggaagtaaggcgtcttagtacgttgttttacgagttcgtcggtacgggtacccgagggtacctaggtccgg

SEQ ID NO: 115225 - DNA, 656 bp, Homo sapiens
  misc_feature: GYAE6OF02I42E4.15.86.H09.1.454.CMB.1.raw
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
  modified_base (354)..(354): a, c, t, g, unknown or other
  misc_feature (354)..(354): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (459)..(459): a, c, t, g, unknown or other
  misc_feature (459)..(459): n is a, c, g, or t
  modified_base (493)..(493): a, c, t, g, unknown or other
  misc_feature (493)..(493): n is a, c, g, or t
  modified_base (536)..(536): a, c, t, g, unknown or other
  misc_feature (536)..(536): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggttttccttgctgcttatacgttaaaggtgtccagtgtgagtgcgaggtggtggagtcggtggggntcgttaggtaacgcgtcgggggtccttagagtcgtctgtgtgcctgtgtcttcncttacgattagtgtcgtgagtggtagtcggcgcgacggcgtacgagggaggtgtcggaggtggtcgtagtagaaagtaangagtggagaagtaagtacgacgtacggancgaacgtagaagagtacgtacacgntacgtacagtaatagtaactaacgaaagcgttagtactagagaatacgganacgtaactacgaacggtacagacgtacgaccttntacgtacgtacgtaccgtacgtacgttacgtaacgtaacggtntaccgaagtacgttaccgggtaagtaccgggtattaagtttacggttactttaacgggaacgtttacgggttaacccggtcgggtaaccccggttaaggttaacccggtagggttccggg

SEQ ID NO: 115226 - DNA, 830 bp, Homo sapiens
  misc_feature: GYAE6OF02GQGYF.15.86.H09.1.454.CMB.1.raw
  modified_base (573)..(573): a, c, t, g, unknown or other
  misc_feature (573)..(573): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgttgggtttttccttgcttgacttatacgttaaaaggtcgtaccagttgtgaagtcggacgtagggttggtggacgtcggtgggggacgtccgttagggtaaacgtccggttcgggggttcccttagtacgttcctccgttaggtcggttcggtcccgttcgttaggttactttaccgttacctttaacgtagttaaacgttggtactaggtaggttaggtaggttacgggtcccgaccgtacggccgtacggagggggtacggggtcgtaggggtaggttagggggttacgggttaacggtttaacgtaaaaaggttaaaacgtaggtaagttacggtaaggtaagaaaagtacggtaacgttacggtacggaccgtaccggtaagggaaaggaacgtacgttaccaacctatacctaggaanaggtaacttaataaaccgtaaaagtacggtagttagttacgtaagaagtacgaacgaccggtaccgtaacggaaaccgacgtacaacgtacgtaccttacttacgtaacttaccgtaaccaacgtacgtaacgttaacggagtacgtaaccgtagtaccgggtaacgtaaggtacggtaccttaaggttccgttacgttttacgtacgttaaccggtcgggttaccggggaccctaagggtacgtacgggttaccgg

SEQ ID NO: 115227 - DNA, 787 bp, Homo sapiens
  misc_feature: GYAE6OF02JGH6G.15.86.H09.1.454.CMB.1.raw
  modified_base (176)..(176): a, c, t, g, unknown or other
  misc_feature (176)..(176): n is a, c, g, or t
  modified_base (401)..(401): a, c, t, g, unknown or other
  misc_feature (401)..(401): n is a, c, g, or t
  modified_base (528)..(528): a, c, t, g, unknown or other
  misc_feature (528)..(528): n is a, c, g, or t
  modified_base (540)..(540): a, c, t, g, unknown or other
  misc_feature (540)..(540): n is a, c, g, or t
tcagtctacgtagccacgaccggtgctcgatttagtgctatagacttgggtttgggggggggaggaggagccccagccttgggatccccaagtgttttcgattcagtgatcaggactgaacacagacggactcgaccatcggagttcgggctgagctgggtttccttgctgctatnttaaaggtgtccagtgtgaagtgcaggtggtggtaggtcgtgggggaacgtccgtttaggggtaaaacggtcccgttacgggggggttcccctttaagggtaacggttcctcccgttgggttcgtccggggtaccttccgttgggtaacttccgttaccttttaccgtaggttaaacgttgggcgttacgggtattaggtcggttcgggtcccgtccgaggtacncccggtaggggaacgggtcgtagggcggttgggttcggtacgtttaacgaaaagttaaagtcggatggtagaagtaaaacgtagacgtacgtcgacgtaccgtaggaaacggatacgttcgaacgtntacaacgtaagntaacgtataaacaaacgtacgtagtaactgaactaagtaactagaaccacgtaaacgaacggaacgacacggtcgaaccgtcgttaacaccgttacgacctagtaacgtaaggttacgaaccgttaaggtaccgtaattaccgggaacggttaagggacggttacgttaggttaacccggtttggttacgttaacggttcgttaaccgggttccgggaacccgtagggttacgaccggttttcgggg

SEQ ID NO: 115228 - DNA, 756 bp, Homo sapiens
  misc_feature: GYAE6OF02F6GHF.15.86.H09.1.454.CMB.1.raw
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcggctgagctggttttccttggctgctatcttaaaaggtgtccagtgtgaagtgcaggtggtggagtcgngggggacnccgttaggtaaagccgtgggggtcccttagacgtctcctgtgtggccgtctggattcactttcgagtatggctggatggtagttgggtcccgcacggtcctaccggaaggggtaacggggctagggaggtcggggttggtaccgtttagaaaaacgttaaaactggtacgtaggtacggaaagtaaaagtacgaacggttacgggtacaccgtaacccggtaggaaaaaggtaagtaacgtttaccaccgtaactcgttaacaacggtaagtaaattacttaaacggaaaaaccgtaggtaacttagtttcggaaactaaatacggtaaacaacggcccgttaaacggaaaaccgacgttaacacgaagcccctttagtaacgttacgtaccgtaacgaaccgtagtaacgtttaccgtaaacgcggtaacttcgggataaccgggttaaagggcggttaactagttaccggtttgttttacgagttaaccgttcgggttacgggcccccgtaagggttaacccgaagtttcccgggg

SEQ ID NO: 115229 - DNA, 783 bp, Homo sapiens
  misc_feature: GYAE6OF02GP3RM.15.86.H09.1.454.CMB.1.raw
  modified_base (185)..(185): a, c, t, g, unknown or other
  misc_feature (185)..(185): n is a, c, g, or t
  modified_base (669)..(669): a, c, t, g, unknown or other
  misc_feature (669)..(669): n is a, c, g, or t
  modified_base (690)..(690): a, c, t, g, unknown or other
  misc_feature (690)..(690): n is a, c, g, or t
  modified_base (764)..(764): a, c, t, g, unknown or other
  misc_feature (764)..(764): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgttgggttttccttgctgctattcgttaaaaggtntccagtgtgaagtgcgaggtggtggagtcgttggggagtccgttaggtaaagccggtagggggtcccttaggacgtcctccgttggtcgtcggaccttcgtaggtactttactaccgttttcgaagttaaatcgggtacgtagggtataggtacgggtttacgggtaccccggacgacgggtaccgttacccggaaacgggggtaacgggccggttagggagggttacggggtttacggtaaccgggttttaaacgaaaaaaggtttaaaaagttcggtaaggttaggttaacggaaaagtaaaagtaacggtacgttaaccggttagacccgtaacccgggtaaggaaaaggaaacgttacgttaccgaacctacgttaccaaacgtaaagaacgtaaattaaacgtaacgaaaaacggtcgttaagttaagttacgaaactaaagtacgaactacgaccgtaagaaaccgtacgacagtacncgtattaactaccacacgtanacgtatacgtatcactagttacgaagtacgaggcttaagcggtttattacgaagttacgtaccggttaccgggnaacgggtacctaagtccgg

SEQ ID NO: 115230 - DNA, 708 bp, Homo sapiens
  misc_feature: GYAE6OF02G87NL.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatacttaaaaggtgtccagtgtgaagtgcaggtggtggagtcgtgggggagccgttggtaaagccgtgggggtcccttagacgtctcctgtgtggcctctggattctactttcagttaatggctggatgagttggtccgcaggcctcggaggggagggtctgggaggtgggttggacgtttaagaaaagttaaaagtgaagtggtagaagaaaagtagacgtacggtcgaccgaaccggtaggaaaggaagtacttacgaacctactacctagaaagtagtaataaacgtaacgaaaaacggtcggttagtttaattaggaactaaaagtgaaacgacgtaccgtaaacggaaaacccggtagaaacctacggaacgtcccgttaacgttaacgtttaaccgtacggtaaacccaagtaacggttaacgttaaccgggaagttccgtaactacggtaaccggaacggtaaaggacggtacttagtacgttacgtttagaacgttcgtcggtaacggggccctaaggggtacaggttcggg

SEQ ID NO: 115231 - DNA, 1083 bp, Homo sapiens
  misc_feature: GYAE6OF02GXSCY.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaacgtgcaggtggtgagtgtgggggagtccgttggaaacgccggtgggggtacccttaggacgttctccgttggtgtcggcccttacgtgggtacttccgacttttaccgaggttaaagttcgggtaccgttagggattagggttacgggtttacgggggttccccggacccggaacggggtcccggttacccgggaaacggggggtaaaccggggggtccggttaggggtaaccggggttggggggtttaacggggtttaacccgttttaaaacgggtaaaaaaacgttaaaaaacggttacggtaagttacgggttaaaggaaacggttaaaaaaggtaacggtaaaccggtttaaacccgggtaacggtaccccgggttaaaccggttaacggggaaaaaaggggttaaccggttaacttaaacccgggtaaaccccttaagttacgttaacccggtaaaagggaacgttaaacgtttaaaaccggttaaaaacccgttaaaaaacccgggtaccgggtttaaacgtttttaaagtttaccggggttaaactaaaaagggtttaaccccgggaaaaggtaacccgggttaacccgttaaaaccggaaaaaccgggaacccgggttaaaccgaaaccgaccgggttaccccgtttaaaacgttaacccggtttttactaaacccgggtttaaccccgaaaccgttaacggttaaacgtttccccggggaaagtttacccggtaaccgaaccgggtttaaccgaacgggtttaaaacgggaccggttaaggttaacgttccggtttaagttttacggttaaacggttccgtttaaccggggtaccgggtcccccgggtaaaagggtacccggtttagggtttacccccgggg

SEQ ID NO: 115232 - DNA, 952 bp, Homo sapiens
  misc_feature: GYAE6OF02IVS7D.15.86.H09.1.454.CMB.1.raw
  modified_base (117)..(117): a, c, t, g, unknown or other
  misc_feature (117)..(117): n is a, c, g, or t
  modified_base (178)..(178): a, c, t, g, unknown or other
  misc_feature (178)..(178): n is a, c, g, or t
  modified_base (210)..(210): a, c, t, g, unknown or other
  misc_feature (210)..(210): n is a, c, g, or t
tcagtctacgtagccacgaccggtgctcgatttagtgctatagacttgggtttggggggagaggagccccagccttgggatcccaagtgttttcattcagtgatcaggactgaacanagaggactcaccatggtagttcgggctggagtctgggttttcttgctgctatagttaaagngtcagtgtagactgcaggtggtggtacgtcgnggggtacgccgtttaggaaacgtccggttcgggggtcctttaacggacgtcgttcccttagtcggttcggtacctccggttaggtaacgtttctaaccgtttttccgaaaggtttaagccgggttactacgggttgttaccgttaagggttccggggttaccccggtacgtaacggggcccttacccggggtaaaaggggtaaaccggggggtccgttaggggttacgggggttaagggggttttcccgggtaaaccggtttttaaaaccggtaaaaaaacggggttaaaaacttttacggggaaacgttttacgggggttaaagttaaaacccggaaaaggttaagggtaaaacccggtttaggttaccggtaaacggtaacccggttaaaggggaaaaacggttaccggttaaacgtttaaacccgaacgggttaaacgtttaccggggaacgtaaaacggtaaggttaaacttttaaaaccgggtaaactaaaaacccgggtttaacgggttaattaaggtttaaccgttaaacgaaagttaaacgaaacgtaacgggaacgttaaccggaaaaaccgtaaagggaccaacgtaaccggacctaacggtacttaacgttaagttaaccgactaaacggtagtacgttaacgggcttaagaacgttacggagtaacgtagtaacgttacgtagttacgtatacgtaacgttcggacggacggtacggtacgaattccggg

SEQ ID NO: 115233 - DNA, 705 bp, Homo sapiens
  misc_feature: GYAE6OF02H6AR6.15.86.H09.1.454.CMB.1.raw
  modified_base (193)..(193): a, c, t, g, unknown or other
  misc_feature (193)..(193): n is a, c, g, or t
  modified_base (542)..(542): a, c, t, g, unknown or other
  misc_feature (542)..(542): n is a, c, g, or t
  modified_base (660)..(660): a, c, t, g, unknown or other
  misc_feature (660)..(660): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagtcggtcttgcttgggtttccttgctgctatcgttaaagtgtctagtgtgtagtgngtaggtggtggtagtcggtggggtagtccgttaggtaacgtccggtcggggtacctagtgtctccgtgtgtcgtcctcgtggtacttctactttacagtagtcggtcgtaggtacgtggtacggtcgggtcccgacggtacggaccgtacggaacggggtaaggtcggtaggtagggtgggtacggtacgttaacgtaaaagtaagtagtagtagtagtaaagaaagtcgtaagtacggacgcgtaaccgaggaaacggtagtacgttacgactacgttacacgtaaaggtaataactaacgttaaacgaaacggtacggtttataacgttacgataaaggtacgtaanacgtacgtaaacgtaaacggtacgaacacggactactagtactacgtacgaacctagtaaccgtgtacgtacgcacgtacgaacggtaagacgtacggtctaggttacttatacggtnttaaccggtggtacccgggtaggtaacggcgttacggtcgtccgg

SEQ ID NO: 115234 - DNA, 694 bp, Homo sapiens
  misc_feature: GYAE6OF02I163M.15.86.H09.1.454.CMB.1.raw
  modified_base (320)..(320): a, c, t, g, unknown or other
  misc_feature (320)..(320): n is a, c, g, or t
  modified_base (333)..(333): a, c, t, g, unknown or other
  misc_feature (333)..(333): n is a, c, g, or t
tcagtctacgtagccacgaccggtgctcgatttagtgctatagacttgggtttggggggggagaggagcccccagccttgggactccccaagtgttttcattcagtgatcaggactgaacacagaggactcaccatggagttcgggctgagcttgggttttccttgctgctatacgttaaaaggtcgtccagtgtgaagtgcgaggtggtggagtcgtggggagcgttaggtaagccggtcgggggtccttagacgtctctgtgtgcctgtgtacttctattcgatagtggtctgagtgtaggttcggtccgcaggtccncggaagggagggntgggtggtgggttaggtacttaaacgaaaagtaaatgagtaggtagaaagtaatacggtacgtacgtcgaaccgaccgtaaaggaaacggtagtacttacgaactacgttacgaacgaaagtaataacgtaaatttaaaacccgtaaaggtaacggtttagttaacttaaggaacttaaagaactaacgtaccgaaacgtaaacggaaacggtacgaaaccgtacaaccgtacgtaccttaagtttaccccgtagtaaccagttaacgtagtaacggtaatcgacgtacgttacggaaggacgagtgtcgtttaagtacgttcgtatacgtccgggtcggtaccgaggtacgtagttccgg

SEQ ID NO: 115235 - DNA, 759 bp, Homo sapiens
  misc_feature: GYAE6OF02JKD53.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagtcgggctgagctggttttccttgctgctatacgttaaaaggtcgtcctagtgtgaagtgcgtaggtggtggagtcgtggggagtccgttaggtaaacgccggtcgggggtcccttaggacgttcctccgtgtcgcgacgtccgtgtggtattcgttcgtttagcgacgtctagtcgccagtgtagtcggtggtcctcgaccgaggccgtaccggtaaggggaacgggcgtagggtacggttcgggtcttcgtcggtaccgttacgttccggtaggtacgtaggttggtagtagtaacgtacgtaaactacgtacgacgtaacgtaccgttcggacggtaccgggtccgttacgtacttttcggttacccgaaggtaactaaacgtaccgttaaccgaaacgtaaccgtacgtaactcggttacttaccgtaggtaccctaaaggtacgttacgaacccttaaggcccgtaaggtaccggacgggaaccggaaggtaacccggtacgtaccgtttaagacgttacgttacggtacgaacgtaaactccggttaaagtttaggttacgggttaaggttacgttttaacgttaccgtttgttaaccggttcgttacgggttaccggg

SEQ ID NO: 115236 - DNA, 690 bp, Homo sapiens
  misc_feature: GYAE6OF02FTIR4.15.86.H09.1.454.CMB.1.raw
  modified_base (214)..(214): a, c, t, g, unknown or other
  misc_feature (214)..(214): n is a, c, g, or t
  modified_base (359)..(359): a, c, t, g, unknown or other
  misc_feature (359)..(359): n is a, c, g, or t
  modified_base (543)..(543): a, c, t, g, unknown or other
  misc_feature (543)..(543): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaggtgtccagtgtgaagtgcaggtggtggagtcgtgggganccttggtaagccgtgggggtcccttagagtctcctgtgtggcctctggtattctactttcagtaatggctggatgtagttcgggtcccgcgaggcctaccggaggggaacggggcttagggaggttggggttggtaccgtttaanaaaaggttaaaatgagtgggtagaagaaaatacgaacttacggtgaccaccggtaggaaaggaactacgttccaacctattctacgaaagacgtaattaaactaacgaaaaacggtacggttagttaacgtttacgaacgtaaaagtacgtaaaccgacgtaccgttaaacggaaaaacccggnggtaaacctaacgacgtacccgttaacttacgttaacacgttaaccacgtacgtacttacgggaatcgtacaacgttcgtaaggtacggaggtactagtcgttactttgatacgttcggtacgggacccgagggtactaggttccgg

SEQ ID NO: 115237 - DNA, 837 bp, Homo sapiens
  misc_feature: GYAE6OF02HDICT.15.86.H09.1.454.CMB.1.raw
  modified_base (317)..(317): a, c, t, g, unknown or other
  misc_feature (317)..(317): n is a, c, g, or t
  modified_base (617)..(617): a, c, t, g, unknown or other
  misc_feature (617)..(617): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggctggagcgttgggtttttcctgtctgctatacgttaaaggtgtccgaggtgtaggaagtgacgagggtggtggaggtcggtgggggtacgtccggttaggtaaacggtccggttcgggggttcccgttaggacgttccgtccgttggtgtacggccgtcgtggtattctactttanacgtagtcggtacgtggagtaggttcggttccgggtccgtaccggtaggccgtaccgggaaggggtacggggtcggtgggtacgggttggggttaggttaacgtttaaacgtaaaagttaaaagtggtaagtagggtaagtaaagtaaagtacgtaacggtcggtacgaccgtaaccggtaaggaaagggtacgtaattaccgtacctacgtacgtagaaacgtacgtaaattaaccgggtaaaactaaaaggttacggtttacttaaacgtttcgaaattaaacggaaccgtaaaccgngtaaccgtaaacgggaaaccgacgtacgacgtccgtacgttattaacgttacccgtacgtaaccccgtaagaccgtttaaaggtcgggtaaatcggaccctttaaagggtaccggtaaagggtaaaccggtcggttattaaccgttggttaacttttacggtgttaccggtaccggggttacccgggacccgggtacggttagtacccgggttttcccgg

SEQ ID NO: 115238 - DNA, 737 bp, Homo sapiens
  misc_feature: GYAE6OF02F88MN.15.86.H09.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (411)..(411): a, c, t, g, unknown or other
  misc_feature (411)..(411): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcttaaaagtgtccagtgtgaagtgcgaggtggtggagtcgtgggggagtccgttaggtaaagccgtgggggtcccttagagtctcctgtgtgcctgtgnttcacttcagtanggctgatgagttgggtcccgcaggcctccgaggggaacggggcgtgggaggttggggttaggtacggtttaacgtaaaaagtaaaagtggtaagtgggtaagaaggtaaaaagtagaaccgtaacgggtnacccgtaacccgggtaggtaaaagggaagtaactttaccgaccaataacctagaaacgaagtataaaacttacgaaaaaacggtggtaacgttagtttacgaactaaaagtacggaaacacgtaacccgaagtaaaaacccgggtacggaaacaacccgaagttccccgaattaaccttaagtacgtaaccctacgaagttaacgttagaaggtcacgttaacgtacggaacgggtaaaggacggtcttaagtacgttaccggttttaagaccgtttaagccgggttaccgggtacccggaaacggggtacgtaggtttaccgggg

SEQ ID NO: 115239 - DNA, 691 bp, Homo sapiens
  misc_feature: GYAE6OF02FGU7Q.15.86.H09.1.454.CMB.1.raw
  modified_base (642)..(642): a, c, t, g, unknown or other
  misc_feature (642)..(642): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttccttgctgctatacttaaaaggtgtccagtgtgaagtgcaggtggtggagtctgggggatccgttaggtaagccgtgggggtcccttaggagtctcctggtcgtggcctctggtacttcgactttcagtaatggactggaatggtagttcgggtccgccgaggcctacgagggggaagggctagggaggtgggttagacgtttacgaaaaaaggttaaaatgaagttggtagaaaggtaaaactagaacctagggtactaccgacccggtagggaaaaacggtataacgttacaaccattacgtaacgaaagtagtaaataactttaaacgaaaaaaccggttaggttacgttaaatttcggaaactaaagtagaaaaccagacccgttaaaggaaaaccggacgtaacaccgagttacccgttaactactttacacgttaacaaccagtaacttcgggaaatggactagacgtaagaaggagtacngtaccgttctttggaattcgaccggttacggccgtaagacctaggtcgg

SEQ ID NO: 115240 - DNA, 904 bp, Homo sapiens
  misc_feature: GYAE6OF02IX7XH.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggtttccttgctgctatacttaaaggtgtccagtgtgaagtgcgaggtggtggagtggtggggagtccgttaggtaaacggccggtcgggggttacccttaggacgtccgtccgtggtcggtcgggccttacgtgggtacttacgtacctttacgaaggttaaacgtcgggtacgttaggacgttagggtaacggtttcgggggtaccccgtaccggacgggtaccgttacccgggaaggggggtaacggggtcggttacggggtacggggttacgggggtttacggtaaaccggttttaacgaaaaaaggttaaaacggtggttaaacggtaggtacggaaagtaaacgtaacggaacgtacggtacgaccgtaaccgggtaagtaaaacggataacgtacaacctataccgtaagaacgtaagtaacttaaacgttaaacgaaaacggttaggtacgttaagtttacggaataaagttaacgaacgtaacggtaaccgtaacgggaaaaccgtaaggaaccgtaacgtaaccggacccgtttaacgttaaaccggttaccgtaaccgttaacccgtaacgtaaacgggttaccggttaaacgggttaaactaccggttaacgtaaacgggttaaccgtaaagggtaaacggtaccgggttaacttaacgggtttacgtacggtttttaacgaacgtttacggtaccggggtaccggtaccgggtaaacggttaggttaaccggttcccggg

SEQ ID NO: 115241 - DNA, 710 bp, Homo sapiens
  misc_feature: GYAE6OF02G8GJ8.15.86.H09.1.454.CMB.1.raw
  modified_base (541)..(541): a, c, t, g, unknown or other
  misc_feature (541)..(541): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagtccgtttagggtaaacgtccggtggggggtcccttaaggacgttccttccgtggtggtcggccttcgtggacttcgtacttttcagttaatggcgtaggatgtaggttcgggtcccgccgaggcctacggaggggaggggcgtgggaggttggggttcggtacgtttacgaaaaaggtaaactgtaagtaggtagtaaagaaaagtcgacgttacggtacgaccgtaccggtaaggaaaacggagtaacgttaccaacgtaactctaacgaagtacgtaattaactaacgaaaaacggtgttagttattgaactaagtacgaacncgacgtaacgaaacgagacacgacgtacctattaactacgactacgtacgtagtacgtttacggagtcgactacgacgtaggtaaacgggcgtgttaacctggtttacgtttacgtaagtttgggtacccgggtacgggtacccgtaagggtactacggggtttaccgg

SEQ ID NO: 115242 - DNA, 1170 bp, Homo sapiens
  misc_feature: GYAE6OF02IPR0E.15.86.H09.1.454.CMB.1.raw
  modified_base (774)..(774): a, c, t, g, unknown or other
  misc_feature (774)..(774): n is a, c, g, or t
tcagtctacgtagccacgaccggtgctcgatttagtgctatagacttgggtttggggggagaggagccccagccttgggatccccaagtgttttcattcagtgacacgagtaactacgagagagtacgacctacacggagtcgggtaccgtcggtagtacggtggttttccgtttcgggtttcctcggagttacgtaaccgttaaggttaccgttaacggttcgtccgtaaggtagtacgtaaggtccggtagggtgggtacggttcgggtacgggttacggttcgggttaacggttaacccggttacggggttaacccggggttcccgggttttaacgggggtaacccctttcgggtaccgtttacggttcccggttacggttccgggttacggtaaccgttaccggttaccgtttactttaccgttacgttacggtaccggttacgtcgggtacgttaccggttaggttaccggttccgggacccgggtccgtaaccggtccggggtaaaccggtaccgggaggggtaacgggttcgggttaggtaccggtttacggttaaacggtttaaaaccgtttaagaaaaacgggtttacggggtaacgttaacggggttaaaaacgttaacgggaaaacgtttaaaccgggttcgttaaaacccccggggtttaaccgtacggggtaaaaaaccccggggtttacgttaaaaaccgggtttaaccccgggtaaaatttaaccgtttaacccggtaaaaccgtttaaaaccgggttnttaaaaaaacccggtacccgggtttttaaaaaacggaaaaaccggtttttacccggtttaaacggggttaacgtttaaacgggtttaaacccggttttaaacggttaaaccggttaaaacccggttaaccgttaaaccgggtaaacccggttaaaacccgggtaacgggtaaaaccccggttaaaacgttaacccggttaacccgggttaaccttaaccccgggtttaaccctaaccgggttaacgttaacccgtaccggttaacgtaccggttaacgttagaccggtaacgtaacggtacgtaacggtaccgggtacgttaacggttagtacgtttagtacgttagtacgttaggtccggaaccggtacggtaacgtaggttaccgtacgttacg

SEQ ID NO: 115243 - DNA, 855 bp, Homo sapiens
  misc_feature: GYAE6OF02ICHPI.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctggagctgggttttccttgctgctatacttaaaaggtgtccagtgtgaagtgcaggtggtggagtcgtggggagtccttaggtaaacgccgtcgggggtacccttaggagtcctcgtgtcgtggcctgtggattcactttacgagtaagtggtcgtcggagtcgtaggttgggtcccgacgagggtcctaccggaaggggtacggggcttagggacggttggggttacggtacggttttaacgtaaaaagttaaaacgtcggtaatacgggtagtaaagaaaacgttagaaccgtaacggtcgtcgaaacccggttagaaaaggtaacgtaacttaaccgaaccgttaaatccgttaacgaaaggactaaagttaacgttaaccgaaaaaaccggttaggttagttaaacgtttacgaaacgttaaaaactacggtaaaaccgtacggtaacccgttaaaccgggaaaaaccccgggtaaggtaaacccgtaacccggtaacggttaccccggttaaacttacggttttaaaaccggtacccgttaacctaaccgggtaaacgtacggtttaaaccgggtaagtacgaaacgttacgggttaacgtaaaacccgggttaaagggacgttacggtaagtacggtaccgtttacgttacggtaattccgggttacccggtacccgggggtacctaaaccgggggtataaccggg

SEQ ID NO: 115244 - DNA, 675 bp, Homo sapiens
  misc_feature: GYAE6OF02FQXIQ.15.86.H09.1.454.CMB.1.raw
  modified_base (249)..(249): a, c, t, g, unknown or other
  misc_feature (249)..(249): n is a, c, g, or t
  modified_base (422)..(422): a, c, t, g, unknown or other
  misc_feature (422)..(422): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagctgggtttttccttgctgctatcttaaaaggtgtccagtgtgaagtgcgaggtggtggagtcgtgggggagccttggtaaagccgtgggggtccctagngtctcctgtgtgcctctggtattcactttcagtaatggctggatgagttcgggtccgccgaggcgtcgaggggaggggcgtggagttgggttggtaacgttacgaaaaagtaaaagtgtagtggtagaagtaaaatagactaggcgtacgaccgtagaagaagatcactactntacaagagtataataacgaaaacgtcgtagttattagacaaatagaacgtacgactaaacgaaacccggaggaaaccacgacgtcccgtaacttaacgttaccgacgtaacccaataacggtagttaaccggaaagtccggtaactacgggtaacgtaacccgggtaaaggacggttactaaggttccgttactttttaggaaccgttagcccggtttaccggggaccgtaacggaaccggtagttaccgggg

SEQ ID NO: 115245 - DNA, 782 bp, Homo sapiens
  misc_feature: GYAE6OF02JBDQH.15.86.H09.1.454.CMB.1.raw
  modified_base (186)..(186): a, c, t, g, unknown or other
  misc_feature (186)..(186): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcatttctccacaggtctctgtgctctgcctgtgctgactcacgccccccgtntgcatctcgtccttgcgtgggacgcctcgatacaagcctccacctgacctaacccgtaagtagtgacgctaactaccgaaccctaccaccatacggtaagtaggtactaacgaacgaacgtacgaaccggaacgggtaacccgtacccccctagtaactaagtaaacgtagtaaaagttaaggaagtagtaagtcggacacgaccgaaccgaaccgggaacgggggaccggaccgacccgtacgtcgtacttacgtacgtcggactaccgtaggttaccggtcgggtcctacggtacccgtacctacccgtacctaacccgtaccgtaacccctaccccgtaacccttacccgtacgttaccgtaacggtacgtaaccggttggtaacgtccgttaaccggtagttaccgtaaccgttacggtagggttaccgaggaacgaaccgtaccctaacgtaacgttaaagttacggaacgtacccggtacgtaacgggttacggggtttcgggttacgggtaccggggtaaccgggaaccgggtaaccggtaacggttaccggtaccggtacccgtacggtaccggttaccgaacccggg

SEQ ID NO: 115246 - DNA, 984 bp, Homo sapiens
  misc_feature: GYAE6OF02IC9TR.15.86.H09.1.454.CMB.1.raw
  modified_base (177)..(177): a, c, t, g, unknown or other
  misc_feature (177)..(177): n is a, c, g, or t
tcagtctacgtagccacgaccggtgctcgatttagtgctatagacttgggtttgggggagagagccccagccttgggatccccaagtgttttcattcagtgatcaggactgaacacagaggactcaccatggagttcggctgagcgtggttttccttgctgactatacttaaaggtntccagtgtgaagtgacgaggtggtggagtcggtgggggacgtcgttaggtaaacggtccggttacgggggtacccttaaggacgttccgttacccgttggttacggttccgggtacccttcggttacggtaacttttaccgtaaccgtttttacggaaggtttaacgttacgggtaccgttagggtaagttcgggtttaacggggttttccgggggtacccccgaacccggttacgggtaccccggttaaccggggaacggggggtaaacggggggttccgtaggggggttttaacggggtttcggggggtttaacggtttaaacccggtttttaaaacggaaaaaaaggtttaaaaagttgggtaacgtaagggtaagtaaaaccgtaaaagtaacgtaaccggtaacggtaccgacgttaaaccgggtaaggaaaggtagttaacctaccgtaaccctaatacccggttaagaaacgtaagttaaacgttaaaccgttaaaacaaaacgggttacggttaaagtttaacgtaacgtaactaaaaggtagaaaccaacggtaaccgttaaaggaaaccggagaaaccctcgtaaacgtccgtaaaccttcgttaaaccttccggtaaaccttacgttaaacggttagtaaaccggtcgtacggaaccgttacggaacgggttaacgggaaaccgttggtaaccgtttaaggttaccggttttacccttttaaggaaccgttttacggggtacccggaaccccggggggttaaacccaggggtttaaccccggtgtttaccccgggg

SEQ ID NO: 115247 - DNA, 745 bp, Homo sapiens
  misc_feature: GYAE6OF02GITS2.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgctgctatcttaaaaggtgtccagtgtgaagtgtcgaggtggtggagtcgtggggatccgttggtaaagccgtcgggggtcccttagcgtcctccgtgtaggtcggtcctcgtggtattcgtactttcagttaacgtggtcgtggagtcggtacggttcggggtccctaccggaggtcccgtaccggaacgggggtaagggggccgtagggtaggttcggggttaggtaccggtttaacgaaaaaggttaaaacgtgtagtagggtagaaaggtaaataggacgtacggtcgaccgtaccggtagaaaggtaactacttaccaactagtactacgaagtataacgtaataacgaaaacggtcgttacgttagttacgaactaaagtacgaaactcgtacctaaggaaaaccggacgaccaacgtacgtaccgtttacttaacgttaccggtacaaccgagtagtaccgttaacgggatccgacgacgtttaacggaacggtaagggacgttactagggttacttagtttacgacgttaggtcccggtaaccgggaccccgtaaggtaccctaggttaccccgg

SEQ ID NO: 115248 - DNA, 738 bp, Homo sapiens
  misc_feature: GYAE6OF02FLWF6.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagtccgttggtaaacgccgtgggggtcccttagacgtctcctgtgtcgcctcgtggattcactttcagttatggcgtggatggtaggttcgggtccgccgacggtctccgaggggaagggtcgtaggtaggtgggtcggtacggttaacgaaaagtaaaagtgtagtaggtagaagtaaaagtagtacgtacggtgaccgtaccgtaggaaaacgggtagtaataccgactataccgtacgaaaggagttaactaaacgttaaccgaaaaacggtacggtttaacgttaagtttacgaacttaaagtagaaaccgtagaacccgtaaggaaaaccggacggaacccgaactacggtacccgtaacttaacttaccgtaactaacccgtacgaaagttacgttaaccggtaagtcggaactaagttaccgggtaaccggtaaagggtccgtaagttagtacgtttacgttttagtaacgttacgttccgggttaccggggaccgtaacgggacgttaaggtccggg

SEQ ID NO: 115249 - DNA, 758 bp, Homo sapiens
  misc_feature: GYAE6OF02GVCUA.15.86.H09.1.454.CMB.1.raw
  modified_base (540)..(540): a, c, t, g, unknown or other
  misc_feature (540)..(540): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgtggtttctgcgtgctatacttaaaggtgtccagtgtgaagtgcgaggtggtggagtcgtggggagtccgttaggtaaacgccggtcgggggtcccgttaggacgtcctccgtgtgtcggcctcgtggtattctaccttttacgaacgtaagtggtacgtaggtatacggtaggtttccgggcccgtaccggacggtccgtacccgggaagggggaacgggggtccggttaggggtaacgggttcgggggtttaacgggttaaccgtttaaaacggtaaaaaaacggtttaaaagttacggtagttagggtaagaaacggtaaaagtaacgtaacgtacggtacgaccgtaccggtaaggaaacgagtactacgactatacagaaagtanaattaacgtaaccggaaaacgtcggttaacgttagttacgtaacgtaaatacgaacacgtaccgaacgtaaacggagaaccacgtacgacttacgtacttcgaacgtacgacgtagtacgtaagtacgacgacgtacgaacgtacgaaggtacgtagtagttacgttacgttatacgttacggtacggttccggacggtaacggtacgaagttcccgg

SEQ ID NO: 115250 - DNA, 790 bp, Homo sapiens
  misc_feature: GYAE6OF02JP9ID.15.86.H09.1.454.CMB.1.raw
  modified_base (566)..(566): a, c, t, g, unknown or other
  misc_feature (566)..(566): n is a, c, g, or t
  modified_base (617)..(617): a, c, t, g, unknown or other
  misc_feature (617)..(617): n is a, c, g, or t
tcagtctacgtagccacgaccggtgctcgatttagtgctatagacttgggtttggggggaggaggagccccagccttgggatccccaagtgttttcattcagtgatcaggactgaacacagaggactcaccatggagttcgggctgagcgtggtttccgttgacgtgctatacgttaaaggtgtccagtggtgaagtgcgaggtggtggtacgtcgtaggggagtccgttagggtaaagccgtcgggggtccttagtacggtctccgtgtcggtcggtcctcgtacggtacgttacctacgtttaccgaggttaagtcggtgtggtagtacgtaggttcgggtaccggctaacggctcggtaacggggaggggacgggtaggttggggtacggtacggttaagaaaacgtaagtcgggtaagtggttaacgaaggtaaaacgtagtaacggtacggtcgtaaccggtaaccggaagggttaaaacgaggttaacgtaaccgtcggtaacgtcttaacgaaggtaagtaacgtaactaaccgaaacggtgtacgttagttaccgaanaacgtcggtaaacacggtacaaacgaacggaacgtgaaacgtgacccgttntaacgtttacgacgtttaacccacttaggtaacccgttaagggaccttaacgtcggaaactttaccggaaacgggttagtacccggtaggttaaccctaggtttaacccgttataaccggtacgtttcggaacgggggttaccggttacaaagggtttcggtccttcccgggg

SEQ ID NO: 115251 - DNA, 930 bp, Homo sapiens
  misc_feature: GYAE6OF02H4XHI.15.86.H09.1.454.CMB.1.raw
  modified_base (216)..(216): a, c, t, g, unknown or other
  misc_feature (216)..(216): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggttttccttgcgtgctatcttaaaaggtgtaccagtgtagaagtgcgaggtggtggagttcgnggggtagccgttaggaaacgtccggtcgggggttcccttagacgttcgtccgttggtggttcggccgttcgtaggtattccgtacgtttacctagttaagtggtcgtaggacgttggacggttcgggtacccgtcgtacggtccgtaccggtaaggggtaacgggggtccgttaggggtagggtttacggggttagggttaaccgttttaaaccggaaaaaaggttaaaaacgtggttaagtacgggttacggtaaagaaaacgtacggtaaccgttacggtaccgtaccgggtaaaccggttaacggaaacgggtaaagtaacgttaccgaaccgtaacgttaaccgtaacgaacgtaacgtaacttaaaacgttaaccgaaaaacgggttcggtttaacgtttaagttaacggaaactaaaacggtacgaaaccgtaaccggtaaccgtaaacggtaaaaccgggtaacgtaacccgtaaaccgtacccgttacggtaacctttaacgttaaccggtaacggttacccaacgttaaacggttacggttaacgaacggtacggtaccgttaacggtaaccgggttaaacgtaaacggggtcggttaacttaacggtttgttaacccggtttttaagggaaaccttttccggtccgggttaacccggggtaacccggtaaccggggtttaaacggtaccgtttaacccgggggg

SEQ ID NO: 115252 - DNA, 800 bp, Homo sapiens
  misc_feature: GYAE6OF02IZIKZ.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagagactcaccatcggagttcggctgagcgtggttttcctgcttgctatcttaaaggtcgtccagtgtgagtgcgtaggtggtcggagtcgtaggggacgtccgttaggtaacggtccggtacgggggtcccttaggtacgtcctaccgttgtaggtcggtccgtcgtgtacttcgtacctttacacgtaaagttcggtcctaggtacttagggtacggtttacggggcccccgtaaccggcggtaccgttcccggaaggggggtaacggggccgtttggggagggtttggggtttaacgggttaaccggtttaaaccggtaaaaaaggtttaaaacgtcgggtaaagttcggggttaaagaaaagtaaaacgtacggtaacgttaccggtacgtccccgaaacgggtgaaaacgggtaactacggttacctaacgtaacgtcgaacaaggtaacctaattaaaccgtaagtaaaacccggtagttacgttaagttacgtaacctaagtacgaaacgtacgtaaccgtacgaaaacgacgtaaccacgtacgtacctcttaactctaacgtaccagtaactacgtaacgtaagcgtacgaacgtacgaacggtaaggacgttaactagttcgttacgttgtacttcggttagtaccgggacggtaacgtacggtagtacgg

SEQ ID NO: 115253 - DNA, 729 bp, Homo sapiens
  misc_feature: GYAE6OF02GK2R6.15.86.H09.1.454.CMB.1.raw
  modified_base (164)..(164): a, c, t, g, unknown or other
  misc_feature (164)..(164): n is a, c, g, or t
  modified_base (262)..(262): a, c, t, g, unknown or other
  misc_feature (262)..(262): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgagcgtgggtttcgtgngtgctatactaaaaggtgtccagtgtgaagtgcaggtggtggagtcgtggggagccttggtaaacgccgtgggggtcccttagacgttctcctgttgnggcctcgtgatcacttcgtaagtactggctaggatggaggttgggtccgccgacggtctccggaagggaacggggtctagggagtggggttaggtacggtttaacaaaaagtaaaaagtgtaaggtaggttaaggaaagtaaaagtacgtaacgtaacggtacgaccgtaaccggtaaggaaaagggtaaagtacgttaacgacctatacctaagaaagacgtaaataacgttaaccgaaaaacgtacgtagttacgttagaaccgtaaagctaaatcgaacctaaggaaacccggagaaccgacgacgtacgtactaagttaccctagtaacccagtaacgtaagttaccgggtaataggtaaccaacggaccgttaaagggtaaacgggtaacgtacgttaagttcgttacgtttacggtaactggtaccccggtgggaaccccgtgggtaaacctaacggttcg

SEQ ID NO: 115254 - DNA, 825 bp, Homo sapiens
  misc_feature: GYAE6OF02F9TH9.15.86.H09.1.454.CMB.1.raw
  modified_base (748)..(748): a, c, t, g, unknown or other
  misc_feature (748)..(748): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgtgggttttccttgctgctatacgttaaaaggtgtccgtagtgtagaagtgcgagggtggtggagtcgtggggagtccgttaggtaaggccggtgggggttcccttaggagtcctccgtggtggtcggtcctcgtcggtacgttcctactttcgaagtaagtggtacgtggtacgtaggtacggtttcggggtcccgccgtacggtccgttacccggggaaggggtaacgggggtcggttaggggtaggtttaggggtacggttaacggtttaaagtaaaaaacgtaaaagtacggtagtaggttaggaaagtaaaagtcggtaaggtaccggtcgaaccgtaaccggtaaaggtaaaacggtaacgtaacttaccaaacgtactacgtaacgaaagtaagtaaagtaacgtaaacgaaaacgggtacgtaagttacgttaagtacgaaaagtcgtaaacgacgtacgtaaaccggaaaacggtaacgtaccacgtaacgtccgttaaacgtacttaacgaacgtaccgaagtacgttaacggttcggtaaagtcggaaaccttaaggtaccggaaacgggttaacggaacggggttnttacggttacggttactttaggaaccgttggttacccggttaacggggccggtaaacggtacgtaccgggttaacgg

SEQ ID NO: 115255 - DNA, 906 bp, Homo sapiens
  misc_feature: GYAE6OF02HHD8Z.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctggtttcctgctgactatttaaaggtgtccagtgtgaagtgcgaggtggtggaggtcgtggggagtccgttaggtaaacggccggttaggggggttcccctttaaggcgttccgtccgttggtcgtcgggtccttcgtagggtattacctacgttttaccgaagttaagtcggtcgtaggtagttaggtaacgggtttcggggtcccgtaccggacgggtaccgtaccgggaaacggggggtaacgggtccggttagggtacgggttacgggggtttacgggtaacccggttttaaaagaaaaaacggttaaaagtaggtaaggtaagggttaagtaaaggtaaaagtaggtaaccgggtaacggtacgtaacccggtaaccggtaaggaaaacggtacggtaccttaaccgtaacctaagtcctaaacgaagtacgtaaaattaaaccgttaaacgaaaaaccgggttggtttaacggttaattacggaaacttaaaaggtacgaaacctaacggaaccgtaaaaccggaaaccggaacggtaaccaacggtaccgtaccgttacgtacgttagtaccgtaacgttaacccgagtaaaccgggttacttaacgggtaaacgttcgaaacggttacgtaaccgggtaaacggttacgggtacggttaaccttagtacccggtttagtttaacgtacgtttaccggtaaccgggttaccgggtaccccggtaaagggttaacggtaaccgtttccgggg

SEQ ID NO: 115256 - DNA, 754 bp, Homo sapiens
  misc_feature: GYAE6OF02JMS82.15.86.H09.1.454.CMB.1.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
tcagtctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgacctcacgcccccgtctgcatctgccttgcgtgggacnccgtacgatcaagcttccaccttgaccaacccttaaggtagtgacgtcactaccgaacctaactaccatcggaactaggttactccaanagaacgaaccgacgggaaccgtccccccgaagtaataactaaactaggaaaacgttaaaggagttacgagttacggacgaacgtccgaaccgtaacccgggaaagggggtaccggtaccgtaccccgagttccggtactacgagtcgggtctacgtacggtttcggcggggtcgtaccgaacccgtcctaccgtacccaaccgtactcccgtaaccctaacccgttacccgcgttaccgtacggtaaccgtaggttacggtaacgggccgttaacgagttccgtaccgtacgttagggtacggtacggaacgaacctaccacgtaacctaattacggacgttaccggaccggtaacgggtacgggtttaacgggtcgggttacggggtaaccggggtacgggaaccgtacgggccgttaaccggtacccggttacgggtaccgacggtaacccggg

SEQ ID NO: 115257 - DNA, 741 bp, Homo sapiens
  misc_feature: GYAE6OF02IGTJ9.15.86.H09.1.454.CMB.1.raw
  modified_base (245)..(245): a, c, t, g, unknown or other
  misc_feature (245)..(245): n is a, c, g, or t
  modified_base (534)..(534): a, c, t, g, unknown or other
  misc_feature (534)..(534): n is a, c, g, or t
tcagtctacgtagccacgaccggtgctcgatttagtgctatagacttgggtttgggggggagaggagccccagcctttgggatccccaagtgttttcattcagtgatcaggactgaacacagaggactcaccatcggagttcgggctgagctgggttttccttgctgctatcttaaaaggtgtccagtgtgaagtgcaggtggtgagtcgtggggatccttaggaagccgtgggggtcccttagngtctcctatggtgcctctggattcacttcagtatggactggactgtacgttggtccgcaaggctaccgaagggagggtcgtaggacggtgggtacggtactttacgaaaagtaaagtcgtaagtggtagaagtaatacgtacgtacggtcgactacccggtagaaaggagtacgttacgacctatacgacgaagtaacgtactaacgtttaaccgaaaacggttccgggtattaacgtttacgaacgtaaattccggaaaacgttaccgtaccgtaaaccgggaaaacncggggtaaaaccaccggtaggtacccccttaattaacgttaccggtacggttacccaacgtaggtacgttaacccggaagttcgaaccttaacgtcggtaaccggtaaagcgggttaccttaaggttcgtttacgttttaaggaaccgttcggtttaaccgggcccccgggggaaacctcgggggtttaaaccaacgggtttccggg

SEQ ID NO: 115258 - DNA, 995 bp, Homo sapiens
  misc_feature: GYAE6OF02I7JVP.15.86.H09.1.454.CMB.1.raw
tcagtctacgtagccacgaccggtgctcgatttagtgctatagacttggtttggggggagaggagccccagccttgggatcccaagtgttttcattcagtgatcaggactgaacacagaggactcaccatggagttcggctcgagctgggtttacctgctgctatcttaaaaggtgtaccagtcgtgaagtgcaggtaggtggtagtcgtgggggtatccgttaggtaaacggccggtacggggggtccccttaggacgttccttaccgttcgtacgtacgggcccttacgtacggtacttactacgtttaccgaaggttaacgtaggtacgttaggaacttagggaggtttacgggcccgtaccgtaacgggtaccgtacccggtaagggggaaggggtccttaggggacggttaggggtttacgggtaaccgttttaacgaaaaacggttaaaaaactgggtaacgttaagggtttagaaacggtaaaaagtacgggaaccgttaacggtccgtaaaccgtaacccccggtaaggtaaaaaccggggtaagtaaccttaccgtaaacccgtaacgttaacccgtaaccgttaaaaaggacgtaaacgttaaaccttaaaccggtaaaaaaccgggtacgggtttacgttttaaacggttaaccgtaacgttaaaaactaccggtaaaaccgacgttaaaccggttaaccggtaaaaacccggtacggaacctaaccggtaagtaccccgttaacggttaaagtttaccccgtaagggtaacccctaacggtaaccggtaaggttttaaccggaaacggtttaccgggaacccttaacgtaaccggggtaacccgttaaaacggggtaaccgggttaaccggtttaaccgttaagggttaaccccgtttttaagggtaaccttttaacgggttacccgggttaaccccgggggacccgtttaaccgggggtaaacttaacggggtttaccgggg

SEQ ID NO: 115259 - DNA, 824 bp, Homo sapiens
  misc_feature: GYAE6OF02HWGO6.15.86.H09.1.454.CMB.1.raw
tcagtctacgtagccacgaccggtgctcgatttagtgctatagacttgggttgggggggagaggagccccagccttgggatccccaagtgttttcattcagtgatcaggactgaacacagaggactcaccatggagttcgggctgagcgttgggtttccttgctgtctagtacttaaaaggtgtccagtgtgaagtgcaggtggtggtagtcgtgggggtagtccgttaggtaaagccggtcgggggtacccgttaggagtcctccgtggtggtacggtcctcgtggtattacgtacgttttcaagttaacgtggtacgtggtagtgggtaggttcgggtcccgtccgacggtccgtaccgggtaagggggtaaggggtcggttacggggtaagggttcggggttacggttaaccggtttaaacggaaaaaaagttaaaagtggtaacgttagggtacgaaaggtaaaagtacgtacgtaacggtacgaccggtaaccggtaggaaaaggaagtactaacaccgtaatcgtaaacggaacgacgtaaagtaaccgttaaacgaaaaccggttaggtaaggtttaacgttacgtaaaccgtaaaaggtaaccgtaacggaaccgtacccggtaaacggaaaaaccgggactaacccgaaaccgtggttacccgaactttaacgttaacgtaccgtaaaccgaacgtaagttacgtaacggttaacgtagaacctaggtaccgtaaacggtaggacggtataacggttcgtaactttacggaattacgtaccgggacggttacccgaaggtacctaaggttcccgg

SEQ ID NO: 115260 - DNA, 939 bp, Homo sapiens
  misc_feature: GYAE6OF02G9B75.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagcttgggttttccttgctgctatacttaaaaggtcgtccagtgtagaagtgcgagggtggtggagtcgtgggggacgtccgttagggtaaacggtcccggtaggggggttacccttaggtacggttccttaccgtggttcggtacggtcccttcgtaggtactttccgtacctttttacgaacggttaagtcggtacgttagggtaagttacgggttaaggggtttccggggtccccggtacccggtaacgggtcccggtaacccgggtaagggggggtaacgggggtccggttacggggtaggggtttacgggggtttacggggtaaaccggtttttaaacggaaaaaaacgggtttaaaagtagggtaaggttagggttaaacggaaaggtaaaaacgttacgggtaacgttaccgggtacggtaacccgtaacccgggtaagggaaaaacggtaagtaacgttacccgaactaacgtacccgtaagaaaggtaacgtaacttaaacgtaaacgtaaaaccggttcggttaagttttaacgttaacgaaactaaatacggaaaccacggtaaacccgaaaaggaaacccggtaacgaacccgtaacgtaccgttacccggtttaacttacgttaacccgttacgaacccgtaaactaacgggttaacttaaccggtaagtccgaacgttaaccgacggtaacggtaaggtacggtacttacggttacggttctttaagacgtttacggtacccggtccgggtaaccggacgggttacgaccggtttaccgg

SEQ ID NO: 115261 - DNA, 985 bp, Homo sapiens
  misc_feature: GYAE6OF02H3P2T.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggacctcaccatgggagttcgggctgagcttgggttttccttgctgctatacttaaaaggtgttaccagtgtgtaagtgcgaggtggtgggagtcgtggggggtacgccgttagggtaaacgtcccggttgggggggtcccttaggtacgtccttccgtggtgtcggtcccttcgtggtactttctacttttacgagttaagtcggcttacggggattaggagggtttccggggtaccccggccgtacgggccttacccggaagggggtaacggggggtactcgggggttagggttgggggttacgggttaacgttttaaacgtaaaaaaggtttaaaactaggtaagttagggttaagaaggtaaaaattacggtaacgttacggtacgtaccgtaaccggtaaggaaaagggtaacgtacttaaccgaacctaagttactaaacgaaggtaacgtaaacgtttaaaactaaccgtaaaaaaaccggtaacgggtttaacggtttttaaactttacgggtaacgtaaaaacgtttaccggaaaaccggtacgggtaaaccccttaaaaccgggaaaaacccgggtaaacggaaacccgtaaaccgtaaccgggtacccgtttaaaccttaaacgttttaacccgttaaccgaaaacccgttaacgtaaacgttaacggtttaaccgggtaagtaccggtaacggtaacgtttaaaccgggaacgggtaaaacggggtttaacgaacggttttaaccgggtttactttcccggtttttaacggtttaacgttacgggtttcccgggttaaccggggggtacccccgggtaaaagggggttacccgttaaacggtttacccgggg

SEQ ID NO: 115262 - DNA, 753 bp, Homo sapiens
  misc_feature: GYAE6OF02GVUY3.15.86.H09.1.454.CMB.1.raw
  modified_base (661)..(661): a, c, t, g, unknown or other
  misc_feature (661)..(661): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaggtgtccagtgtgaagtgcaggtggtggagtcgtggggggagccgttaggtaaacggccggtcggggggttcccttaggacggttccttccgttggtggtcggtccgtcgttgggtacttcgtacctttcgagttaagtggtacgtggagttggtaggttcgggtccgccgtaggcctacggaggggagggtcgtgggtacggtgggttcggtacggtttaacgaaaaaggtaaagtggtaagtagggtagaaagtaaaagtacggtacgtacggtacgaccgtaccggtagaaaggagtaacgttacgaacctagtacctagaacgtaataagttaaagtaaccgaaaaacggtcggtttagttaagttcgaacgtaaaagtacgtaaaccgtacgtacccgtaaacggaaaacccggaggtaaccaaccggtagtacccgttataacttacgacgttaacccaagttaagtaccgttaaggacgnaacgtacaccggaggtaaaggtcgtaacgttacgttaggtactttagaacgttcgtcggtaaccgggtccgaagggttaacaggtttccggg

SEQ ID NO: 115263 - DNA, 794 bp, Homo sapiens
  misc_feature: GYAE6OF02JXMLW.15.86.H09.1.454.CMB.1.raw
  modified_base (120)..(120): a, c, t, g, unknown or other
  misc_feature (120)..(120): n is a, c, g, or t
  modified_base (194)..(194): a, c, t, g, unknown or other
  misc_feature (194)..(194): n is a, c, g, or t
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
  modified_base (405)..(405): a, c, t, g, unknown or other
  misc_feature (405)..(405): n is a, c, g, or t
  modified_base (785)..(785): a, c, t, g, unknown or other
  misc_feature (785)..(785): n is a, c, g, or t
tcagtctacgtagccacgaccggtgctcgatttagtgctatagacttgggtttggggtccactgggcagtctcgaatagagctcttggaagtccctccaaccatggcctgggtctccttntacctactcgcccttcattttctccactaggtctcgtgtcgtctctgcctgtcgcgtgacctcaccgccccgtntgccattctcgccttgcgtagggctccgttacgacttacaacgtcctaccgaaccgtcggtaccaaaccgttaaggtacgngacgtcgacttaccgaactaccactacctagaacngtaactacaacctaggaacgaccggtacggaaaccgtccccgtagttaacctaagtaaaagttaacggtaaaagtttaacggacttgggtaaacncggtaaccgaccgtaccgaccggaaaacgggttaaccggggaccggtacttaccccggagttacccgttcgttaacgcggttcgggccttacggtacggttcggaacgggttcctacggaccgttacccggcttaccgtacggactaaaccccgttccgtaaacctcctacggttacccgtggtaacgtaaccgggtgtacgacgggttactacggtaacctttaccggagttaccgtagggacgtacggttccgaccgttacgaaccgttaaagtcgtacgaaccggtcggtaacggttacggttaccggggttagtcccgggtacgggaaacgtccggtaacggaccgttaggttaccccggttaacgtaccgggttntaacccggg

SEQ ID NO: 115264 - DNA, 854 bp, Homo sapiens
  misc_feature: GYAE6OF02IS2AG.15.86.H09.1.454.CMB.1.raw
  modified_base (745)..(745): a, c, t, g, unknown or other
  misc_feature (745)..(745): n is a, c, g, or t
  modified_base (776)..(776): a, c, t, g, unknown or other
  misc_feature (776)..(776): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttaggtaaacggtccgttgggggttcccttaggacgttctccgttgtaggtcggcccttcgtcggtattacctaccgttttacaagttaaacgttgggtcgttacgggtaattaggttacggtttccggggtccccgaccgtacgggtcccgtaacccgggacgggggtaacggggggtacgttcgggggtaagggtttggggggttaacggttaaccggttttaaacgaaaaaaggttaaaacgtaggtaagttacggtaaggaaacgtaaaagtaacgtaacgttacggtcgtacccgtaaaccgggtaggtaaaaacgggtaacgtaacttaaccgaacgtaaccgttacgtaaccgaaagaagttaaacgttaaacgtaaaaccgaaaaccggtttacggttaagtttacttacgaaactaaagtacgaacctaggtacgtaaagaaacccgagaactaccgacgtccgtactagttacccgacgttaaccacgtaaacttcggttaacggtaacgtnaaccggtaacgtacgtaaagggttaaccggngttaaccgttacggttcgtttacgtttaaggcttacggtaccgggtccggtaaccggggtaatacggtacggtttcgg

SEQ ID NO: 115265 - DNA, 833 bp, Homo sapiens
  misc_feature: GYAE6OF02JNST0.15.86.H09.1.454.CMB.1.raw
  modified_base (219)..(219): a, c, t, g, unknown or other
  misc_feature (219)..(219): n is a, c, g, or t
  modified_base (345)..(345): a, c, t, g, unknown or other
  misc_feature (345)..(345): n is a, c, g, or t
tcagtctacgtagccacgaccggtgctcgatttagtgctatagacttgggtttgggggggggaggaggagccccagccttgggatccccaagtgttttcattcagtgatcaggactgaacacagaggactcaccatggagttgggctgagctgggttttccttgctgctatcttaaaaggtcgtccagtgtgaatgctaggtgtggagtcgtggggganccgttagggtaaacgccggtggggggtcccttaggacgtcctccgtggtgtcggccttgtggtacgttctactttcagtaagtggcgtggatggaggttcggtccgcgaggctccgagggacgggnacggtgtagggtggtacgttacgaaaagtaaatagtagtcggtaggaagtaaagtagtaacgtacgtggaccgtaacccggtaaggtaaaacggtaagtaagttacccacgtaaccgttacgaaccgtaaaggtaacggtaaatttaaaccgtaaaccggttaaaaaaccgggtacggttaacgggtttaacttttacgggaaaaccgtaaaattaacgggaaaaccgtaaccggttaaccggtaaaccgttaaaacgggaacggtaaacccgtaacggaacccgtttaccgtaccgttaacgttaaacccggttgaaacccgtaacgtaaagttacccgggttttaaaggggaccgtttaaccggaacgtagttaacccggtaaacgggtaaacgggtccggtacttaaagttcggttactttttaaacggagttacccggttacggggtaccgggaacccgttaacgggacgttaacggttcgggg

SEQ ID NO: 115266 - DNA, 714 bp, Homo sapiens
  misc_feature: GYAE6OF02GGZ4B.15.86.H09.1.454.CMB.1.raw
  modified_base (672)..(672): a, c, t, g, unknown or other
  misc_feature (672)..(672): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtggggagccgttggtaaacggccgtcgggggttcccttagagtctcctgtgtgcctcgtggattctacttcagttaagtggcgtggagtgtacggttgggtcccgccggacgccgtaccggaggggacgggtcggtgggtagggttcggggttacggttaacggtttaaacgtaaaaagttaaaaggtaggtaagttaggtaaggaaagtaaaagtacggtacgtacggtacgaccggaacgtaaggaaaggaagtactaccactactactaacgtaagaacgtaattaaacgtaaaccgaaaacggtggtttaacttagtacgaaactaagtacgaacgtacgtacgaaacgaaaccgagaccgagaccgttactacttattaccgagtaccaggtatacggttagacgtgaactacgttaaggaacggttaagcggttaattccggttacgttagtttaagngtaccgttcggggacccggtaccggaaggtcctagggttccg

SEQ ID NO: 115267 - DNA, 801 bp, Homo sapiens
  misc_feature: GYAE6OF02GHTBD.15.86.H09.1.454.CMB.1.raw
  modified_base (715)..(715): a, c, t, g, unknown or other
  misc_feature (715)..(715): n is a, c, g, or t
  modified_base (760)..(760): a, c, t, g, unknown or other
  misc_feature (760)..(760): n is a, c, g, or t
tcagtctacgtagccacgaccggtgctcgatttagtgctatagacttgggtttggggggagaggagcccagccttgggatccccaagtgttttcagttcagtgatcaggactgaacacagaggactcaccgatggagttcgggctgagctgggttttcctgctgctatacttaaaggtcgtaccagtgtgaacgtgcgaggtggtgtgtcgtggggacgtcgttaggtaaagccggtgggggttacccttaagcgttcctccgtggttgtcggtaccgttccgtaaggtactttacgtacttttaccgagggttaacgtccggtacgttagggtaacttacggtaacggtttcggggttaacccgccgtaacgggtcccgtaaccggaaggggtacgggtacgtacgggttagggtggtttaccggtagtttaaaccgaaaaagttaaacgaggtacgttagggtaacgaaagtaaaacgttacggaaccgttacggtacgtacccggtaaccgaaagggtaaacggtaaacgttcctaacgtaactacgtaccgaagtaacggtaataacgttaacgtaaaacgaaaaccggttggtaagttaacgttcggaaataaacgaaggaactaacggtaccaaacggtaaaccgaaggaccctaggaccgactttacgtaacgttacacgtaccgtaagattaccggtagacggttanacttacggaacttaaggacggaacgttctaagttccgtacgtttnaacgttcgacggttacgggacccttagggacttacgtcggg

SEQ ID NO: 115268 - DNA, 796 bp, Homo sapiens
  misc_feature: GYAE6OF02J2TKQ.15.86.H09.1.454.CMB.1.raw
  modified_base (191)..(191): a, c, t, g, unknown or other
  misc_feature (191)..(191): n is a, c, g, or t
  modified_base (591)..(591): a, c, t, g, unknown or other
  misc_feature (591)..(591): n is a, c, g, or t
  modified_base (696)..(696): a, c, t, g, unknown or other
  misc_feature (696)..(696): n is a, c, g, or t
tcagtctacgtagccacgaccggtgctcgatttagtgctatagacttgggtttggggggagaggagccccagccttgggatcccaagtgttttcattcagtgatcaggactgaacacagaggactcaccatggagttcggctgagcgttggtttctgctgctatcttaaaggtgtcgagtgtgaagtgcgnggtggtggagtcggtaggggacgtcgttacggtaacgtccggtcggggttaccgttaggacgttcctccgttggtcggtgtccctgttcggtattctaccgtttcgagttacgtggtcgtaggagttaggtacggttcggtcccgtaccgaccggtccgtaccgggaaggggacggggtcgtaggtaggttgggttacggttaacgttttaaacgaaaaggtttaaaacgtagggtaaggttaggtaaccggtaaagtaaacgtacggtaaacggtaccggtaccgtaccgtaaccgggtaaacgaaaccgggtaaagtacctaccgaacccgtagtaccgtacgaaagtaactaacgttaacgtaaaccgtaaaggtacgttaaggttactaacgtaanaaacgttacgaaaccgtccggaaagttaacccggaaacgtaacggaactacccgagtcccttacgttaacttacggacctaacccgaagtaccgtacgttacggngttaaccgctaacggtacggtaacgacggttagccgttaattccggagtttagtaacgttcggtaccggtacgggacccggttaacgggattggttacgg

SEQ ID NO: 115269 - DNA, 832 bp, Homo sapiens
  misc_feature: GYAE6OF02GCDYW.15.86.H09.1.454.CMB.1.raw
  modified_base (796)..(796): a, c, t, g, unknown or other
  misc_feature (796)..(796): n is a, c, g, or t
  modified_base (824)..(824): a, c, t, g, unknown or other
  misc_feature (824)..(824): n is a, c, g, or t
tcagtctacgtagccacgaccggtgctcgatttagtgctatagacttggggtttggggggggagaggagccccagccttgggatccccaagtgttttcattcagtgatcaggactgaacacagaggactcaccatggacgttcgggactggagcgttgggttttccttggctgtctaataccgttaaaaggtcgtccgagtgtagagtgcgtaggtggtaggagtcggtaggggagtaccgttaggaaacggtccggttagggggtacccttaggacgttccgtaccgtggttcgtcggccttcgtaggtactaccgtattacgaggttacgtggacgttaggacgtacggtaggttcggtacccgacgacggtaccgtacgggaagggggtaacgggtccggtagggtaggggttacggggttaacggtaaccggtttaaacggaaaaaagttaaaagtggtaaggtacggtaaagtaaacgtaaaacgttagggaccgttacggtacgtaaccgtaaaccggtaagggaaaaaggtacgttaaagttacccggtaactaacgtacgttaaacggaaacggtaacttaaagttaaaccttaaaggaaaacccggttggtactttaagttacgaaacgtaaataaccggtaacggaacgtaccggtaaacgaaaccgtaaggacccaacgtacgtacgttacctaaggttaccctaaggacccgttagtaagtacgggttaaccgagtacgtccaagtaacccgtaggaaacgcgttaatacgttagtaccttagngttacggttacgaccggacgtaacgggntagttcgg

SEQ ID NO: 115270 - DNA, 793 bp, Homo sapiens
  misc_feature: GYAE6OF02JVNW0.15.86.H09.1.454.CMB.1.raw
  modified_base (685)..(685): a, c, t, g, unknown or other
  misc_feature (685)..(685): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttcctgctgctatacgttaaaggtcgtaccagtgtaggaagtgcgtaggtggtaggaggtcgtgggggacgtccgttaggtaaacggtcccggttaggggggtaccccttaaggtcgtccgttcccgttggttcggtcggtcccttacggtgggtacttccgtactttcgaagttaagtggcgtggtactggtaggttcggtccgccgaggcgtaccggaggggaacgggtcgtgggaggtggggttacggtaacggtttaaacgaaaaaggtaaaattggaagttagggtaacgaaaggtaaaagtacgtaaccggtaacggtcgaaccgtaccggtaaggaaaaggtaactacgttacgaactagtaccaagtaaagagtaaataacgttaacgaaaacgtacggttagtttaattacgaaacgtaaacgtaagtaacccagttaaacccggaaaggaaaccggaaacgaacccgacgtacggtacccttattaacgtaccgtacgtaactacgagtagttaacggntacgataacggtaccgtacggtaaggtcggtaacttagttacgtttaacgttagtaacgttaccggttcggggtacccggtaaccggtaggtacgtaacgggttcggg

SEQ ID NO: 115271 - DNA, 924 bp, Homo sapiens
  misc_feature: GYAE6OF02IMUDM.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcacatggagttcgggctgagcttgggttttccttgctgctatacttaaaggtgtccagtgtgaagtgcgtaggtggtggaggttcggtgggggacgtaccgttagggtaaacggccggttcggggggttcccttaggacgttccttccgtgtggtcggtccgttcgtggtattcctacttttacaaggttaagttcggcgttaggtagttggtacggtttcggggtcccgccgtacgggtcccgtccggaagggggtacgggggcttagggggtagggttggggttgggtaaccgttttaagaaaaaggttaaaaagttcggtaaggttcggtaaaggaaagttaaaagtaacggtaacggttaacggtacgtaccgaaccggtaaggaaaacgggtaacgtatttaaccgaacctacgtactaacgaaacgtaagtaacttaaacgtaaacgaaaaccggtaggttacgtttaaacgttgaaaacgttaaactaggaacccgtaacgttcccgtaaaaagggaaacccgtaacggaaccgtaaaccgtccggttaaacccgttagtttaaacccggtttaccgttaaccgttaacccgtaagggttaaccggttaacggtaacggttaaaccggttacgtaaaccgttacgggtaacggttaaacgggaaacggttccggggtaatttaacccggttcgggttttaacggttttaccggttaaaacgttccccgggttagggttaaccccccggggttacggaaaccgggtttaacctagggggttttacccggg

SEQ ID NO: 115272 - DNA, 840 bp, Homo sapiens
  misc_feature: GYAE6OF02IA6OJ.15.86.H09.1.454.CMB.1.raw
tcagtctacgtagccacgaccggtgctcgatttagtgctatagacttgggtttgggggggagagagccccagccttgggatccccaagtgttttcattcagtgatcaggactgaacacagaggactcaccatggagttcgggctgagtacctgggttttccttgctgcttatactttaaaaggtgtcctagtgtagaagtgacgtagggtggtggtgtcgttgggggtacgtcctttaggggtaaacgtcccggttcggggggttccctttaaggtacggttccctccgttggttggtacggtcctcgttggtactttccgtaccttttacgaggttaagtggccgtggacgtggtacgttcggggtacccgcgtaacgggccgttacggaggggaacgggcgtgggtacggttaggggttaccgttacggttaacgaaaaaggttaaagttgaagttacggtagtaaagaaagttacgaacgttaggtacgccggtaaccgtaagaaaaggtacgtaattactacctaacgtcctagaaaggtaacgtaataaaccgttaaacgaaaacggttacggttagttaaacgttacgtaaacgttaaacgtaagtaaccctccgtaaacgtaaaccgggtaaacccgaaagtaacccgacctaagggtacccgtttaaagacttttaacggtaacccgacgtaaccgttaacggttaggttaaccggtaagcccttaaagtacccgtagggaacgttaagtaccggtaacctttagtcggtttatttaagtacgtacggttttcggacccggggactaaagggtacccgtagggttaacccgg

SEQ ID NO: 115273 - DNA, 879 bp, Homo sapiens
  misc_feature: GYAE6OF02GVOEJ.15.86.H09.1.454.CMB.1.raw
  modified_base (611)..(611): a, c, t, g, unknown or other
  misc_feature (611)..(611): n is a, c, g, or t
tcagtctacgtagccacgaccggtgctcgatttagtgctatagactttggggtttgggggggagaggagtcccagccttgggatccccaagtgttttcattcagtgatcaggactgaacacagaggactcaccagtggagttcgggctgagctgggttttccttgcgtgctactacttaaaaggtgtccaggtgtagaagtggcgagggtcggtggtagtcttcgggtaggacgtccgttaagggtaaacggtacccgggttggggggtttaccccttaggtacgttccttccggttggttacggtcggtcctccggtagtacgttccgtaacgtttccgaagttaagtcggtacgtggtagtacgtaacgggtttcgggcccggccgtaacggccggttacccggaaggggggtaaacggggtcggttagggtaacgggttcggttacgggttaacgttaaccgtaaaaaagtaaaagtacgtagttagggagtaaaaggtaaagtaaggtaaccgtacggtacgtaccggaaccgtaggtaaaggtaaggtacttacaaaccgtagtaccctaagtaaacgtagtaactaaacgtaaacgaaaaccggnggttagtaacgtttaagaacgtaaagacgtaaacgacgttaccgaaaacgaaaccggtaaggaacctacgaaccgggtacgttaacgtaaccttacggtaaaccctacgaaataacccgggtagttaaccggtacgtaacggtaccgtaagttacccggtaaacgggaagggtaacggtaaccttaacggtttacggttaactttaacgggttactaccccgggtttagggacccggggttaaccggtacggggttaaaaccctgggg

SEQ ID NO: 115274 - DNA, 603 bp, Homo sapiens
  misc_feature: GYAE6OF02FNEDY.15.86.H09.1.454.CMB.1.raw
  modified_base (484)..(484): a, c, t, g, unknown or other
  misc_feature (484)..(484): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtggggggtcccttagagtctcctgtgtggcctctggattcactttcagtaatggctggatgagttgggtccgccgaggctccaggggaaggggctggagtgggttggacgtttcaaaagtaaaatgagtggtagaagaaatagactacggtgacaccgtagaaaggagagttaccacctagtctacaaagagaataattacgaaaaacgtcggtagtatttgactaaatagaacctagacctaggaaaaccgnggacacgagccgtactattacagtaccagtagacttacggaatgactagtacggacgtaaaggcgtcctaagtcgtacttttagaattgtcggtcgggacccgaagggtactagtcggg

SEQ ID NO: 115275 - DNA, 657 bp, Homo sapiens
  misc_feature: GYAE6OF02GTZLT.15.86.H09.1.454.CMB.1.raw
  modified_base (432)..(432): a, c, t, g, unknown or other
  misc_feature (432)..(432): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatcttaaaaggtgtccagtgtgaagtgcaggtggtggagtcgtgggggagccttggtaaagccgtgggggtcccttagagtctcctgtgtggcctctggattctactttcagtaatggctggatggagttgggcccgcaggctaccgaggggaacggggctggaggttgggtaggtacgtttacgaaaaagtaaaatgagtggtagaagaaaatagactacggtgaccgaccggtagaaaaggaagacttacaaccgtatacgtanaaagagaattaactaacgaaaaaacggtcggttaagttaacgtttagaaccgtaaaatacgaaaccacgtaccctaacggaaaaccgtacggacaacgacgccgtactaattacgtacaacctacgaagtacgtacggtaagtcgactaacgtacggaacgtaaagggagtctaagtgttctttagagttacgtcggtcgggtacccgagggtactaggttcggg

SEQ ID NO: 115276 - DNA, 735 bp, Homo sapiens
  misc_feature: GYAE6OF02HTU9Z.15.86.H09.1.454.CMB.1.raw
  modified_base (559)..(559): a, c, t, g, unknown or other
  misc_feature (559)..(559): n is a, c, g, or t
  modified_base (596)..(596): a, c, t, g, unknown or other
  misc_feature (596)..(596): n is a, c, g, or t
tcagtctacgtagccacgaccggtgctcgatttagtgctatagacttgggtttggggggagaggagcccccagccttgggatccccaagtgttttcatttcagtgatcaggactgaacacgagaggactcacatggagttcgggctgagcgttcggttttccttgcttgctagttacttaaagggtcgtccgaagttcgtgaaggtgacgtagggttggtggaggttcggtggggggactccgtttagggtaaacggtccgggttcgggggtacccttaggaacggttccctcgttgtcggtacgtccgtgtggtacttccgtactttacgagttaagtgcgtgtagtgtaggttcggcccgacgcggtacctccgggaagggtacgggcgtgggtacgggttgggttacggtaacgttaaagaaaaagtaaactgtaggtgtaagaaacgtaaagacgtaacggtacggacgacggtaacccggaagaaaacggtagtaactaccaccgtattacgaacgagaaagtactaagtaaccgtaaacgtcgtattacgtanaacgtatacgaactagaaccgaacgacgtaacgaccncggactcgtactacgttacgactaacccgtgaaccttagtcgaacgttagaccgtacgtacgtagggtagaccgtagtcctttagtacgttagtaagttcggacccgggttaggacggtaacggtacgtagttcccggg

SEQ ID NO: 115277 - DNA, 883 bp, Homo sapiens
  misc_feature: GYAE6OF02H02DY.15.86.H09.1.454.CMB.1.raw
  modified_base (124)..(124): a, c, t, g, unknown or other
  misc_feature (124)..(124): n is a, c, g, or t
tcagtctacgtagccacgaccggtgctcgatttagtgctatagacttgggtttgggggagaggagcccagccttgggatcccaagtgttttcattcagtgatcaggactgaacacagaggactnaccatggagttcgggtctgacgcgttgggtttttccttgcctgcttagtacttaaaaacggtgttacccaaggtgtaggaaggtcgaccgagggttgggtaggacggttcggtacggggggaggtcccgtttgggtaaaacggtcccggttacgggggggttcccgttaagtacgttccgttcccgttggtcggttacgggtcccttgttagggactttacccgtacttttaccgaaggtttaaagttcggacgttacgggagttcggtacgggtttcggggtacccgtcccgacgggtaccgttaccgggaaggggaacggggtcgtaggggtacggttgggggttacggtaccgttttaagaaaaacggttaaaatggtacggtaggttaggaaacggtaaaacgttcgaacgttacggtcgacccgttaccggaaggtaaaggtaacgaacgttaacgtacctacgttacctaacgaaacgtaggtaaacttaaggtaaaccgtaaaaccgggttaggtttaaccggtttatttaaacggtacttaaaacgtacggttaaaccgaaccgtaacgtaaacgtaaacccggaaggtaacccgtaacgtaccggtaacccgtacttaaacgttaccgtacccgttaacaacggtaagtacgttaaagggcttacgtcaaagtcggtaaacgtaggtagtacgttacgtagtctttaagcgttaacggttcggaccggtaccgaggtacgtacggttcgg

SEQ ID NO: 115278 - DNA, 696 bp, Homo sapiens
  misc_feature: GYAE6OF02JL1WI.15.86.H09.1.454.CMB.1.raw
  modified_base (186)..(186): a, c, t, g, unknown or other
  misc_feature (186)..(186): n is a, c, g, or t
  modified_base (220)..(220): a, c, t, g, unknown or other
  misc_feature (220)..(220): n is a, c, g, or t
  modified_base (308)..(308): a, c, t, g, unknown or other
  misc_feature (308)..(308): n is a, c, g, or t
  modified_base (457)..(457): a, c, t, g, unknown or other
  misc_feature (457)..(457): n is a, c, g, or t
  modified_base (516)..(516): a, c, t, g, unknown or other
  misc_feature (516)..(516): n is a, c, g, or t
tcagtctacgtagccacgaccggtgctcgatttagtgctatagacttgggtttgggggggagaggagccccagccttggggatccccaagtgttttcattcagtgatcaggactgaacacagaggactccaccatggacgttcgggctgagcgtcggtttccttgcgtgctactacgttaaaggtntccgagtgtagtaagtgaccgtaggtgggtaggnggtcgtgggggactcgttaggtaacgccggtgggggtccctaaggcgtctccgtgtgtcgcctcgtggtactctacttcagtagtggntggatgtaggtcggtaccgccgacggtctacggacgggtaaggtctaggtggtcggttcgtaagtaacgtaaaagtaatgtcgtacgtaggaaacgaaacttagacgttaggacgaccgtacgaagaacggtacagtacccaatacgtntaaacgacgtaagaacttaacgaacgaaaacgttacggtaagtttgtacgtacgtaaanaagtaaaccgtaccaaccgtaaacgaaacccggtagaaccgactaacgcttactaacgtaaccgtactaccgacggtacgtaacgtaacgtcgtaacgcgtacgacggagtacgagggtctttacgacttacgttagaccgttacgtacggtaccgggtaccgaaggtcctaacggtcgg

SEQ ID NO: 115279 - DNA, 834 bp, Homo sapiens
  misc_feature: GYAE6OF02H9E8F.15.86.H09.1.454.CMB.1.raw
  modified_base (150)..(150): a, c, t, g, unknown or other
  misc_feature (150)..(150): n is a, c, g, or t
  modified_base (349)..(349): a, c, t, g, unknown or other
  misc_feature (349)..(349): n is a, c, g, or t
tcagtctacgtagccacgaccggtgctcgatttagtgctatagacttgggtttgggggggggagaggagccccagccttgggatccccaagtgttttcattcagtgatcaggactgaacacagaggactcaccatggagttcgggctgancgttgggttttccttgctgctatacgttaaaggtgtaccagtgtagagtgcgaggtggtgacgtcgtagggggagtaccgttaggtaacgtccgtcgggggttacccttaggacgttccgtccttggttggtcggccttcgtaggtactttcctacgttttcaagttagtcggcgtaggtacgtggtaggtcgggtccnccgtggtcgtaccggaagggacgggtctagggtaggttagggttacggtaacgtttaacgaaaaggttaaatggtaacgtagggtaagtaaagtaaacgtacggtaacgttaccggaccgtaccgtaaccgggtaaaggtaaacgggtaaattaccggtaacccgtacctaacgttaccgtaccggtaaaagtcggtttaaaaccttaaacgttaaaccggtaaaccgggttaacggtttaagtttaacgttaacgtaacgtaaacgtacgtaaaccgtacgtaaccgtcggtaaaaaaaaaaaaaccggcgaacgtaacgacgtaccgtacttacgttaccgtacgttaaccacgtaacgtacgttacggtacgtacgtacgtacgtacgtaacggtaacggtacggtacgtacgttacgttacgttacggttacgttacggttacggtaccgggtaccggtacggtaccgtaggttacccggg

SEQ ID NO: 115280 - DNA, 863 bp, Homo sapiens
  misc_feature: GYAE6OF02GOOOS.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgttgggttttccttgctgctattacgttaaaaggtcgtccagtgtgaagtgcgaggtggtggagtcgtggggagtccgttaggtaaacgtccggttcgggggttacccttaggacgttcctccgttggttggtcggtccctcgtggtacttacgtactttacgaagttaagtggacgtaggtatggtacggttcgggtaccccgaccgacggtacctaccgggtaaggggaacggggcggttagggtagggttggggtttaggtaacgtttaaacgaaaaaagttaaagtaggtaagttaggtaaagaaagtaaaagtaacgtacggtacggtacgaccgtaaccggaagaaaggtaacgtacttaccgaacctacgtacctaacgtaaagaacttaataaagttaacccgaaaaagtttacgtagtttacttaaggaactaaaggtagaaactacgaaccctaaaggaaaaccgtacgaaactaccgtaacgtacccgtagttaacctttaacggtaccttaacccgaaacgttacggtaccttaaacgggaactcgtaaccgttaacgaaccgggttaaacgggtaaacgggtaccggttaacgtttaggttaacccggttttacgttttaacggttaaaccggtttccgggtaccgggttaacccgggggaacccgtttaacggggttaacggtacccggtttaccgggg

SEQ ID NO: 115281 - DNA, 958 bp, Homo sapiens
  misc_feature: GYAE6OF02H26FN.15.86.H09.1.454.CMB.1.raw
  modified_base (855)..(855): a, c, t, g, unknown or other
  misc_feature (855)..(855): n is a, c, g, or t
  modified_base (947)..(947): a, c, t, g, unknown or other
  misc_feature (947)..(947): n is a, c, g, or t
tcagtctacgtagccacgaccggtgctcgatttagtgctatagacttgggtttgggggggagacggagccccagccttgggatccccaagtgtttcagttcagtgatcaggactgaacacagaggactcaccagtggacgttcgggctgacgcgttgggttttcctgtctgctatacgttaaaggtcgtcgagtgtagaagtgacgaggtggtaggtagtcggtggggacgtcgttaggtaacgccgggttcgggggttacccttagtacgttccttccgttggttcggtcgggtcctacggtcggttacgttaccctaaccgttttacgaaacggtttaacgttcggggtaccggttaggtaacggttaggttaaccggggttccggggttaccccggtaccggtacgggtacccggttaccggggaaacgggggtaacgggggttccgttaagggggtaccggggttttgggggttttaaacccgggttaaccgtttttaaaaccggaaaaaaacggtttaaaacgttcgggtaacggttaacggggtaaaggtaaacggtaaaaaccggttacggtaaccgttaaccgggtaccgaacccggtaaaccgggtaaagggaaaccgggtaaaagtacccggttaacccaacgtaacgttaacccgtaacgaaaggtaaccgttaaagtttaaacccgttaaacggaaaacgggttcggtaacttttaacgtacgggtaaactaaacgtaacgaccgtaacggtacctaaaacggaaacccggtaggaaaccctacgtaacggtccgtactttaactacccgtactaaacccgtgtaaccgttagttaaccgggntacggtaaccgttaggtaaccgagggttaacccggtgttaatccggttgtaaccgtttacggattcccggtaaccggtccggaacgtacggnttaggttccgg

SEQ ID NO: 115282 - DNA, 856 bp, Homo sapiens
  misc_feature: GYAE6OF02JLI40.15.86.H09.1.454.CMB.1.raw
  modified_base (180)..(180): a, c, t, g, unknown or other
  misc_feature (180)..(180): n is a, c, g, or t
tcagtctacgtagccacgaccggtgctcgatttagtgctatagacttgggtttgggggagaggagccccagccttgggatccccaagtgttttcattcagtgatcaggactgaacacagaggactcaccatggagttcgggactgagcttgggttttcctgtctgctatacttaaaggtntccagtgtgagtgcgtaggtggtggagtcgtaggggacgtccgttaggtaacgtaccggtcgggggttcccttaggacggttcctccttggtggtggtcccttgtaggtattacctacgtttaccgtagttaaggtcggtactaggtacttggtacgggtttacgggtcccgtacccggacggtccgtacccggtaagggggacggggtcggttcgggtagggtttacggggttacggttacggttttaaacgtaaaaaggttaaaacggttagtaacggtagggtacgtaagtaaaacgttacgtaaccgtaaccggtcgtacccgtaacggtaggtaaaacgggtaacgtaaccgttacgaaaccgtacttaccggtaacgtaaaggaccttaagttaaccgttaaacggaaaaaccggttcgggtaagttttaaaccgtttggaaacccttaaaggtacgtaaaccgtaccggtacgtaaaccggaaaacccgtccgggaaaacctccgaaccggtttaccctacccgttaacttaacgttaccgtaacccgtagtaacgtacgggtttaacgacgcgtaaatccggaccgttaaggtaagcgtaagttctaggttccttaaggtacgtacgttacgggtacccggtactaacggggtaccctagggttccgg

SEQ ID NO: 115283 - DNA, 791 bp, Homo sapiens
  misc_feature: GYAE6OF02FW4TC.15.86.H09.1.454.CMB.1.raw
  modified_base (704)..(704): a, c, t, g, unknown or other
  misc_feature (704)..(704): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccttaggtaaagtccgtgggggtcccttagagtctcctgtgtggcctcgtggtattctactttcaagtatggctggtatggtagttcgggtccgcgtacggtcctccgagggtagtgggggtcgtgggtaggttggggttcggtaacgtttacgaaaaagttaaaagtgtagtagggtagaagaaaagtagaacgtagggtcgacgtaacccggtagaaaggtaagtacgtaccaacctaataccgtaacgaaagtagtaattaacgttaaaacgaaaaaccgggtcgggttaagtttaagtttacggaaacttaaaacggtacgaaacgaccggtaaccgtaaacggaaaacccggacgggaaacctacggaaccggttaccgttaaccgttaaacgttacccgtacggtaaacccaacggtaacgttaacggtttaacggaaacggttcgaaccgtaaggttacccgggaaaagggtaaaccgggnggttaccttaaggtttccggtttaaccttttaggaactttacggtaccgggttaccggggaaccccgtaggggtaacccttaacggg

SEQ ID NO: 115284 - DNA, 964 bp, Homo sapiens
  misc_feature: GYAE6OF02HM2DM.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagtcgttcgggttttccttgctgtctattaacgttaaaggtgtcctagtgtagtaagtgtgtagggtggtggtagtcggtgggggagtcgttagggtaaacgccggttccgggggtaccttaggtgtccgtcgtgttgtcgtcctcgtggtactccgtacttcgtaagtaacgtggtactggtagtagttacgggttcggtcccgccgtaacgggtccttaccggggaagggggtaacgggcgttaggggtaggttacgggtttaggttaacccgtttaaaagtaaaaaaacggttaaaagtaggtaaggttacgggtaagtaaaaacggtaaaagttacggttaaccgttaacgggccgtaaacccggaaccgggttaaagggaaaaaggtaaccgtaacgttaaccgaccttacgtttaaccgaaccgaaagttaaacgtaaacgttaaacgtaaacggtaaaaaccggtttacggttagtttaaacgttacctaaagtaaacgtacgtaaaaccggaacgtaaacccgtaaaggaaaacccggaaacgggtaaccaccgtacggtaccgttttaaactaaacgttacccgttaaataccccgaaaggttaacgggttaaggttaaacccgggaggttaaaccctaacgggttaaacgtaaaaccgggggttaaccggtaaaaagggttccgggtttaaaccctggttttaaccggttaaacgtttttacggggaaactttacggttttaaccccgggggacccggggtaaacccggtttaaacccggggtaaggttaaccgggtttacccgggg

SEQ ID NO: 115285 - DNA, 725 bp, Homo sapiens
  misc_feature: GYAE6OF02HB87Y.15.86.H09.1.454.CMB.1.raw
  modified_base (547)..(547): a, c, t, g, unknown or other
  misc_feature (547)..(547): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggtttcctgctgctatcttaaaaggtgtccagtgtgaagtgcaggtggtggagtcgtgggggagccttgggtaaagccgtgggggtcccttagagtcctcctgtgtggcctctggtattcactttcagtatggcttggatgagttgggtccgcgaggccgtacgaggggaagggtcgtaggtagggtgggttggacgtttaacgaaaaaggttaaaaatggtaagtgggtagaaacgtaaaagtagaacgttacggtgaccgtaaccggtaggaaaaggtaacgtacgttccaacgtatcgtaacaagagtaattaacgtaaccgaaaacggtggttagttaatttacgaaccgtaaaattacggaaaccgtagacccgtaaacggtaaaaccggngtaaacccacggtaccgtaccggtttaaccttaagttaaccgttacggaaccaagtaccggtaaatttaccgggaaggttcacgtaacgtccggtaacggtaaggtcggtaactaggttcggtacttttgaacgttacggtccggtacgggacccggaagggtacctagggttccggg

SEQ ID NO: 115286 - DNA, 767 bp, Homo sapiens
  misc_feature: GYAE6OF02FGIIJ.15.86.H09.1.454.CMB.1.raw
  modified_base (266)..(266): a, c, t, g, unknown or other
  misc_feature (266)..(266): n is a, c, g, or t
  modified_base (440)..(440): a, c, t, g, unknown or other
  misc_feature (440)..(440): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtcgtgggggagccgttagggtaaagccgtgggggtccccttagagtctcctgtgtggcctntggtattctactttcagtaatggctggatagtaggttgggtccgccgtaggcctccgaggggaggggtcgtgggaggttgggttggacgtttacaaaaggttaaaatgagtaggtgaagtaaaataggactacggtgaccaccgggtagaaagggtaagaacttacgaaccctnttacctagaaaaggagtaaattaacgttaacgaaaaacggtcggttaagttaagtttacgaacgtaaacgtacgtaaacacggtaccgttaaacgggaaaaacccggacggtaaacgaaacccgaacgtaccggttaaccgttaactttaacccgtaggtaaaccaacggtaaggttaacgtttacggggaaattacggaccgttaacgaccgggttaaacggtaaaggggacggttaacgttaacgtttacggttccgtttttaagaaggtttaactccggggttaccgggggaaccccggtaaggtaccggttaagttcccgggg

SEQ ID NO: 115287 - DNA, 765 bp, Homo sapiens
  misc_feature: GYAE6OF02IHAXS.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtggtttccttgacgtgctatacgttaaaaggtgtccagtgtagaagtgacgaggtggtggaggtcgtgggggacgtccttaggtaaagcccgtgggggtacccttaggagtcctcctgtgtcgtcctcgtgtattctactttacagtaatggcgtggagtgtacggttcgggtcccgccgacggtccgtaccggaaggggaacgggggtcgtaggggtagggttggggttaggtacgttttaaacgaaaaagttaaaagttgaagttagggtagaaagtaaaagtacgtaaacgtaggtacgaccgaccggttaaggaaaagtaacgattaccgacctaagtccgtaagaacgtaagtaacttaaaacgtaaccgtaaaaaccggtaacggttaagtttaatttaacggaactaaaagtacgaaacaggtaaaccctaacggaaaacccggtaggaaccaaccgtacgtaaccgtacttaacgttactactaccgaagtaacggtactacgggtaagtgacctaagtcgggtaaacgtaacggtacgtacgttacgttacgttattttacgagtttacgcgggtacccgggaccggtacgggacgttaggtccgg

SEQ ID NO: 115288 - DNA, 751 bp, Homo sapiens
  misc_feature: GYAE6OF02H41EB.15.86.H09.1.454.CMB.1.raw
  modified_base (319)..(319): a, c, t, g, unknown or other
  misc_feature (319)..(319): n is a, c, g, or t
  modified_base (480)..(480): a, c, t, g, unknown or other
  misc_feature (480)..(480): n is a, c, g, or t
  modified_base (537)..(537): a, c, t, g, unknown or other
  misc_feature (537)..(537): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcggctgagctgggttttccttgctgctatcgttaaaaggtgtccagtgtgaagtgcaggtggtggagtcgtgggggagtccgttaggtaaagtccgtcggggggttcccttagagtcttccgtgtagtcggtccctctggattctactttacagtaatggactggatggagttgggtaccncgaggtcgtaccgaggggaacggggtctagggaggttgggttacggacggttttaaacgaaaaagttaaaaagtggtaagtagggtagaaaggaaaaataggaaccgttaggacgaccgtaacccgtaggaaaagaagtacttaccgaactaacgtctaanaaaggagtaacttaaagtaacgaaaaacgtacggtagttaatttacgaactaaaagngtaaacacggtacctaaacggaaaaacccgagggaaacccaaccgacgtaccgtaaccttaacttaccgtacgtaaccctacgaagttaacgttacgggtaaacgtgtaaccgtaacgtacgtaacgggtaaacggagggttactaagtgttaacgttttacgaacgttacgtccggttaaccgggaccccggtaggtaaccgtaggtaccggg

SEQ ID NO: 115289 - DNA, 767 bp, Homo sapiens
  misc_feature: GYAE6OF02JRAHH.15.86.H09.1.454.CMB.1.raw
  modified_base (197)..(197): a, c, t, g, unknown or other
  misc_feature (197)..(197): n is a, c, g, or t
  modified_base (709)..(709): a, c, t, g, unknown or other
  misc_feature (709)..(709): n is a, c, g, or t
tcagtctacgtagccacgaccggtgctcgatttagtgctatagacttgggtttgggggggagaggagcccccagccttgggatcccccaagtgttttcattcagtgatcaggactgaacacagaggactcaccatggagttcgggctgagctggtttccttgctgctatacttaaaggtgtccagtgtgaagtgacnggtggtaggagtcgtggggacgtccgttggtaaacgccggttcgggggtacccttacggagttcccgtccgtgtgtcggaccccttcgtaggtacttccgtaccgtttacgtaagttaacgtggtaccgtggagttggtacggtttcgggcccgtacgacggtccgtaccggaaggggtacggggtcgtacgggtacgggttggggttacggtaaccggtttaagaaaaaaggttaaagtggtaaggttaggtaagtaaacgaaaaggttacggaaccggttcggacgaaccggtaccggtaaggaaaacggtaagtacgtaccgtacgtatacgaacgtaagaacgtaattaaacgtaacgaaaacgtacggttagtttacgttagtaagtaaactacgaaccgtacgaaccgttaacgaaacgacggaaccacggtacgtacgtaacttacgttacgtacgaacacgaacgtaacgtacgtaagcgacgtaagacgtacggagtaaccgntacggtagttcgttagtaacgtcgtacggtccgggtaacacgggtacgtacgttccgg

SEQ ID NO: 115290 - DNA, 844 bp, Homo sapiens
  misc_feature: GYAE6OF02FJA8H.15.86.H09.1.454.CMB.1.raw
tcagtctacgtagccacgaccggtgctcgatttagtgctatagacttgggtttggggggggagaggagccccagcctttgggatcccccaagtgtttttcattcagtgatcaggactgaacacagaggactcaccatggagttcgggctgagctggttttccttgctgctatacttaaaaggtgtcctagtcgtgaagttgacgtaggtggtggaggttcgtggggggagtccgtttagggtaaacggtcccgggttggggggtacccctttaggacgttcccgttcccgttaggtcggttcggtacccttcgtcgggtaactttaccgtaccgttttaccaaggttaacgtcgggtaccgttagggtagtacggttagggtttccgggtacccggccgtaacgggtcctacccgggaagggggtaacgggggtcgttaggggaggggttagggtttacggggtaccgttttaacggaaaaaaggtttaaaagtcgggtaagttcggggtaaggtaaaggtaaaacgttaggtaaccggttaacggtacgacccgtaaccgtaagggaaaaggacgtacttaccgacctagtctagaagtagaaatactaacgtaaaacggtcgtaagttacgttagtaacgtaaactacggaataccggtacgtaacgaaaccggtaggaacccgacctaacggtaccgttaccgtaacgttacgtaccggttaactacgaggtagttaccgggaacttcggactagtaccggtagaagggtacgacgttaagttccggtattttaccggagttccgtaggtacccgggtacgagggtacctagggttcccgg

SEQ ID NO: 115291 - DNA, 827 bp, Homo sapiens
  misc_feature: GYAE6OF02HHFD8.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgttcgggttttcctgcgtgcttatacgttaaaggtctccgagtgtgaagtgcgtagggtggtggagtcgtgggggactccgttagggtaaacgtccggtcgggggttacccttaggacgttacctccgtggtgtcggtccttcgtggtactttcctacgtttacgtaaggtaacgtggtcgttaggtacgttgggtaggttccgggtaccgcgtacgtccgtaccggaggggtaacggggtcgtaggtagggttcgggttaacggttaacgttaaacgtaaaaaggttaaagtaggtagttacggtaagaaaggtaaaacgtaacgtacggttaaccggtcgacggtaccgaaggtaaacgtagtacttaccgaactactactaacgaagtaagtaacttaaacgtaacgtaaacggtacggttagttaacgttacgaactaaagtacgtaaaccgtacgtaaccggtaaacgaacggtaaacgtacccgaactaacgggtccttaaccgttaacctcgttaacccgaacgtaactaagggttaccgtaaggtaaacgtcgaacgttaacggtaaccggtaacgggtaaggtaccggtaatttaccctaggtttaccctttaaggacctttaacgggccggtacgggtaacccggtagtaaccggttcggttaccgg

SEQ ID NO: 115292 - DNA, 817 bp, Homo sapiens
  misc_feature: GYAE6OF02GV3K4.15.86.H09.1.454.CMB.1.raw
tcagtctacgtagccacgaccggtgctcgatttagtgctatagacttgggtttggggggggagaggagccccagccttgggatccccaagtgttttcattcagtgatcaggactgaacacagaggactcaccatggagttcggctgagctgggtttcctgctgctatcttaaaggtgtcagtgtgagtgcgaggtggtggagtcgtgggggacgtccgttagggtaaacgccgtcggggggtcccttaggagttcctcctggtggtcgggtaccttcgtggtaactttctacctttacgaagttaatggcgtggacgttaggtacggttcggggtccccgaccgtaggcccgtaccggaagggggaaggggtcgtgggtaggttggggttacggtaacgtttaacgtaaaaagttaaaagtggtaagttgggaaggtaaagtaaaagtaggaaccgttacggtacaaccggtacccggttaaaggaaacgggtaacgtacgtaaccgaacgtactaccgtagaaacggtaagtaacttaaacgtaacggtaaaaaacggtcggtttaagttaagtttacgaaacgttaaagtaacggaacgaccgtaacgtaaacgaaaacccggaggaaacccagaccgttacgttacttaacgtacttaaccgtaaccgaacgtaacggtaacgttaccggtaaggtaccgaacgttaaccgaacgggttaaacggttaagggaacggttattacgggttaacttcgtttaagtacgttaccggtttacgggcccgggtaacggtaacggtagtacggttaccgg

SEQ ID NO: 115293 - DNA, 776 bp, Homo sapiens
  misc_feature: GYAE6OF02HONN8.15.86.H09.1.454.CMB.1.raw
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (592)..(592): a, c, t, g, unknown or other
  misc_feature (592)..(592): n is a, c, g, or t
tcagtctacgtagccacgaccggtgctcgatttagtgctatagacttgggttgggggagaggagccccagccttgggatccccaagtgttttcattcagtgatcaggactgaacacagaggactcacatggagttcgggctggagcgttgggttttcctgcgtagtctattacgttaaaaggtcgtaccaggtagtggtaagtcgcgtagggtggtgggagtcggtagggggacgtaccgttagggtaaacgtccgggtcgggggttacccgttaaggtacggtccgttccgtggttcggtcgggtccccttacgttacgggtactttcctacgttttacggtaagtagtcggtcggtaggtacggttaggtacgggttccggaccggtacggtaccgtaccggtacgggggaacggggtacgggtgggtacggggtggggttacgggtaacggttaacgtaaaagtaaaaggtaagtagtaggtaaggtaaagtaaacgtaaagtaccgtagtacggtaccaacggtacggaaagaagtactacacntanctaagagaatataacgtaaagtaagtacgtatagacgtaanaacgtaacgagaaccgtaacgaaaccgtaacggacgaactacgacgtactacggttaacttaccgaactacgagttacgtacggttacgaacgtcgtacacgtacgaaaggtcgaacgtcgtaagttcgtaacttaggttaccgtagttccgggaaccggtacggtaacgtacgttccgggtcg

SEQ ID NO: 115294 - DNA, 920 bp, Homo sapiens
  misc_feature: GYAE6OF02IEXMB.15.86.H09.1.454.CMB.1.raw
tcagtctacgtagccacgaccggtgctcgatttagtgctatagacttgggtttgggggggagaggagccccagcccttgggatccccaagtgttttcattcagtgatcaggactgaacacagaggactcaccatggagttcgggctgagcgtgggttttcctgctgcgtatacgttaaaaggtgtccagtgtgtaagtgcgtaggtggtggtaggtcggtgggggacgtccgtttaagggtaaacgtccggtcgggggttaccctttaggacgttcgttccgtgtggttcggcctgtcggtattcctactttcaagtagtcggtacgtagtagtggtacggttccgggtcccgacggtaccggtaccgtaacggggaacggggggtacggggtacggttagggggttacggggtttaggggttaacggttaaaccggttttaaaacggtaaaaaaaggtttaaaaaggttagggttaaaggttaacgggttaaaggtaaaaacgtaaaacggttaacggtaaccggttacggtaaccggtacccgtaaaccgggtaaaggtaaaaaggtacgtaacgtacctaacctacgtacgtaacgaaagtaagttaacgttaaaacgtaaaaccggtaaacggttaacgttagttaagttaacgtaaacgtaaacgaacgtaaaccgacgggtaaaccgtaaacggtaaaacggaacggtaaccgtaaccgtaaccggtaccttaacttaacgttaaccgtaacccgtaaccaacgttaacggtacggttaacgtaaacgtcgtaaccgtaacggtaacggtaaacgggttaaacggtacgtacgttaaccgttcgttacgttaaacggttaagttaccgggtaccgggtaccgggaccggttaaacgggtacgttacgggtacgg

SEQ ID NO: 115295 - DNA, 916 bp, Homo sapiens
  misc_feature: GYAE6OF02F1883.15.86.H09.1.454.CMB.1.raw
tcagtctacgtagccacgaccggtgctcgatttagtgctatagacttgggtttggggggggagaggagccccagccttgggatccccaagtgttttccattcagtgatcaggactgaacacagaggacctcaccatggagttcggctgagctgggttttcctgctgctatacttaaaaggtcgtccacgttgtgaagtcgcgaggtggtggagtccgtgggggacgccgttagggtaaaacggcccggtacggggggttccccttaaggacgttcctccgttggttcgtcggccttcgtcggatttcctactttccgaagtaaactggtcgttacggagttgacggtttcgggacccggtcccgacggtacccgtacccggaagggggtaaacgggggcgttcgggtaagggttggggggttttaacgggtaaccggtttttaaacgtaaaaaaaacggtttaaaaacgtaggtaaagttaggggttaaagaaaagggtaaaaaactaacgggtaaacccgttaacgggtacgtacccgtaaccccgggttaagggtaaaaaacggtaacggtaaactttcccgaaaccgtaaacgttctaaccgaaaggtaacgtaaagttaaacgtaaaccgtaaaaaaaccgggttccggtttaaaggtttaacttttacgaagttaaaaacgtacggtaaaaccgaaccggtaacccggtaaaaccggtaaaaaccggccggaaaacttaccgaaccgttaccggtactttaacgttaacgtccgttaacccaacgttaagtacgttacgggaacgtacggactaaacgtccggtaacgtaaaggcgtaacgttcgtacgttcgttttacgtaagttcggttccgggtaccgggacccctagggaacgtacggttacccggg

SEQ ID NO: 115296 - DNA, 976 bp, Homo sapiens
  misc_feature: GYAE6OF02I4TYC.15.86.H09.1.454.CMB.1.raw
tcagtctacgtagccacgaccggtgctcgatttagtgctatagacttgggtttgggggggagacggagccccagccttgggatccccaagtgttttcattcagtgatcaggactgaacacagagactcaccatggagttcggctgagcttgggttttcctgctgactatacgttaaaaggtgtaccagtgtagaagtgcgtaggtggtggagtcgtggggacgtccgttaggtaaacggccggttcgggggttacccttagacgttccgttccttggttggtcggtccgttcgtaggtactttccgtaccttttcgtaacggttaagttacgggtcgttagggtacgttaggtacggtttaccggggttccccggacccggtaacgggtcccgtaacccgggtaacgggggtaaacggggggtcgttagggggtaacggggtttacgggggtttaacgggttaaccggttttaaaaccggtaaaaaaaggtttaaaaacggttaggtaaggttagggttaaggaaaaggttaaaaaacgttaaacggtaaccgttaacccgggttacggtaaccccggtaaccccggggtaaagggtaaaaaacgggtaaacgttaaccggttaacccgtaaaccgtaactttaacccgtaacgtaaaacgggtaacgttaaacgtttaaaacgttaaacccggtaaaaaaaccgggtacgggttttaacgttaaagttttaacggtaaaccttaaaaaggtacggtaaaccgtaacgtaacccgttaaacggaaaacccggtaacggaacccaacggtaaccgtaccccgtaacttaacgttacgttaccctaacgtaaccgtacggttaacgtacggtaagtaccgaacgtaagtaaccggtaacgtaacggagtaacgttaagttacgttgttaacgtagttacggtaccggtacgggtaccgtaacgggtacgtaggttcgg

SEQ ID NO: 115297 - DNA, 697 bp, Homo sapiens
  misc_feature: GYAE6OF02FGYQT.15.86.H09.1.454.CMB.1.raw
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatcttaaaaggtcgtccagtgtgaagtgcaggtggtggagttcgtggggggagccgtttaggtaaacgcccgtgggggggttcccctttagacgtccttccgtgttggtacggccttcgtggattctactttcagtaatggctaggntggtagttgggccgcaggctccagggaagggcnggagtgggttggacgtttanaaaagtaaaatgataggtagaagaaaatgacgttacggtgaccgaccggtagaaagggagtaagttccaaccgtatcctaacgaaagagtaactaacttaaccgaaaacggacggttagtattttacgacgtaaagtgaaactacggtaccgtaagaaaccggagaaccgacgtacgccgttaactacgttaccgtacgtaaccgaccgtaagtacgttaggtaaacgtcgacgtagtaccgggtaacgtaacgggagttccgtaaggtacttcgtttagtaacgttacgttaccggtacggggacccgtaacgggacgttaggttaccgg

SEQ ID NO: 115298 - DNA, 748 bp, Homo sapiens
  misc_feature: GYAE6OF02GKPHA.15.86.H09.1.454.CMB.1.raw
tcagtctacgtagccacgaccggtgctcgatttagtgctatagacttgggtttgggggagaggagccccagccttgggatccccaagtgttttcattcagtgatcaggactgaacacagaggactcaccatggagttcgggctgagcgtgggttttcctgacgtggctattacgttaaaggtgtaccgtagtgtgaagtgacgtaggtgggtggtagtcgtggggagtcgttacggtaaagtccggttgggggtcccttagcgttcgttccgtgtcgtaggtcctacgtggtacgttactactttacgagtaagttggactggattggacggttggccgtacgacggtccgtacggtaggggacggtcggtggtacggttgggttacgttaacgtaacgtaaaaagtaaagtggtaagtggtaagaacgtaaaataggtacgtacgtagacgaccgtaggaaaacggtaagtacgttacgaactcgtaattaaccggatagtaaacttaacgtaaacgtaaaacggtcggttattaggttacgaactaaagtaacgaaactagtaccgtaaacggaaaacgtacggactaaccgtacgtaccggttacttaacggttaacctacgtaccaacgacgtagtaacgtacgtagaccgtagtacggtaaggttaacggaccggttaattaccgttacgttacgtttagagttacgttacggccgggaacgacgggtacttaccggtacggg

SEQ ID NO: 115299 - DNA, 821 bp, Homo sapiens
  misc_feature: GYAE6OF02H5GE8.15.86.H09.1.454.CMB.1.raw
  modified_base (133)..(133): a, c, t, g, unknown or other
  misc_feature (133)..(133): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccanggagttcgggctgagcttgggttttccttgctgctatacttaaaggtcgtacagtgtagaagtgcgaggtgggtggagtcggtgggggagtccgttaggtaaacggtccggtcgggggttaccttaggacgttcctcttggtcgtcggtcctcgtggtacttaccttacttcgtaagttaatcgggtcgttaggagtaggtacggttcgggtacccggtcgcggccgtaccggaaggggacggggtcggtaggggttacgggttaggggtttacgggttaacggtttaaacggaaaaaggttaaaacgttagggtaacggtggggttaaagaaaggttaaaaacgtacggtaacggttaaccggggtacgtacccggttaaaccgggaaacgggtaaaacgggtaacgttaaccgttaaccgaaccttaacgttaccgtaacgaaagtacgtaaactttaaacgttaaacgtaaaaccgggtatttaggtttaattacgaaacgttaaacgtaacgaactcggtaaacctaaggaaaccgtacgaaacgacgccgtacgtacttactacgtaacgtacctagtaacgagttacgagtacgaacgacgtaacgtacggaagtacgtctagttcgttaacgtttagtacgtcggttaccggtacggcccggttagacgttacggttccgg

SEQ ID NO: 115300 - DNA, 838 bp, Homo sapiens
  misc_feature: GYAE6OF02J0658.15.86.H09.1.454.CMB.1.raw
tcagtctacgtagccacgaccggtgctcgatttagtgctatagacttgggtttggggggagaggagccccagccttgggatcccaagtgtttcattcagtgatcaggactgaacacagaggactcaccatggagtcggctgagctggttctgctgctatcttaaaggtgtcctagtgtgaagtcgcgaggtggtggtacgtggtggggagtccgttaggtaaacggccggttcgggggttccttaggtcgttccgtcgttggtacggtcggtcccgttgttaggtaccgtttaccgtactttaccggaagttaacggtcggtaccgtggtactaggtaggttccgggtcccgacgtacccggtcgtaaccggacggggtagggaccgttgggtacgggttggggttaccgtaacggtttaaaccgtaaaaagtaagtaggttacggtaaggttagaaagtaaaggtaacgtaacgtcggttacgacccgaaccggtagtaaaacggtagtaacggtacctaacgtagtaaccgtaacgtaaacgtaattaagtaaaaccgttaaacgggaaaacccgttaggttaacgttaacgttaacctaccgtaaagttaacgtaaacgtaccgtaaccgaaacggtaaacggaccgtaaacgccggtaccgtacgtacccgttacgtaccgtaaccgtaaccacgtaaagttccggtaacgtaacgtcgtaccgaaacgttaaccggagtaacggttacggtaacgttcgtaagttcgttaacggttaacgtaccggttacgggtaacccgggttaggtaacggttaacgtcggtttaacccgg

SEQ ID NO: 115301 - DNA, 902 bp, Homo sapiens
  misc_feature: GYAE6OF02F7XJO.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttcctgctgctatcttaaaggtgtccagtgtgaagtgctaggtggtggagtcgtgggggactccgttaggtaaacgtccggttcggggggttacccttaaggacgttccttcccgttggtggtcggtcctcgtagggtactttcctacttttcgaagttaacgtcggtacgtaggtagttaggtacggtttaccggggtacccgtacccgaacgggtcccgttaccggaacggggggtaacgggggtccggtggggtaacgggtttagggggttaacggttaaccggtttaaacgaaaaaaggtttaaaagttggtaaggttaggtaaggtaaaacgtaaaagttacggtaaccgttacggtacgaaccgtacccggtaaggaaaacggtaacgtacgttaccgaacctacgtactacgtaacgtaagtaactttaaacggtaacgtaaaaaccggtggttacgttaacgttacggtaataaagtacgtaaacgtaccgaaccgtaacggtaaaacccgacggaaccaaccggtaccgtaccgtttaacgttaaccgttaaccgttaccgaacccttaaacggtaacgttaccgggttaacgttaggaccggttaacctaacgggtaccggttaaccgggtaaacggtacggttaccgttacgttaacggttttactttacggaaccgttttacgggacccggggtttaacggaccccggaacggggttactaacggggtttccggg

SEQ ID NO: 115302 - DNA, 1033 bp, Homo sapiens
  misc_feature: GYAE6OF02F0B48.15.86.H09.1.454.CMB.1.raw
tcagtctacgtagccacgaccggtgctcgatttagtgctatagacttgggtttggggggagaggagccccagccttgggaatccccaagtgttttcattcagtgatcaggactgaacactagaggactcaccatggacttcgggctagacgcgttggttttccttgctgctattacgttaaaggtcgtcctagtgtcggaagtcgtcgagggtgggtggagtcggtgggggactccggtttaggtaaaacggtccggttagggggtacccctttaaggacggttccttaccgttggttacggttcggtccttccgttagggtaactttaccgtaaccttttacggtaaggttaaaacgttcgggtaccttaggggtaacgttagggttaaacggtttcgggggttaccccggaccggttaaccgggtaaccgttacccggggtaaacggggggtaaacgggggtccggttagggggtacgggtttagggggtttaccggttaaacgggttttaaaccgtaaaaaaacggtttaaaaacggttacggttaaggtttacgggtaaaggttaaacggttaaaaaacttaacgggtaaccggttaaccggttcggaacccgtaaccccggggttaaaggaaaaacggggttaacggtaacgttttaacccgaacccggttaagttaaccgtaaaccggtaaacgagggtttaaaccttaaaaacgttaacccgaaaaacggtttaaccgggtaagttaacgtttaacggtaaccgtaaaagtaaccggtaaacgtaacccgggacccgttaaaaggaaaccggtaaccgggttaaccaaccggtaacggttacccgtttagttaaaccgtttcgtaaccgtacccgtaaacgtaacgtaacgttaaccgggaagtaccggtactaacgtacggaaacggttagggtaaccggtactacgttaggtaacggtttttaccgaaggttaccgtttacgggacccgggtacggtaaccggtaaccgttacgggtttaccgg

SEQ ID NO: 115303 - DNA, 989 bp, Homo sapiens
  misc_feature: GYAE6OF02FS2EN.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaggtgtccagtgtgaagtgcagggtggtggagtcgtgggggagccgttaggtaaagccgtagggggtcccttagacggttctcccgtgtgtggacccttcgtaggtacgttctaccgtttacgaagttaagtcggtacgtagggtaagttggtaacggtttcgggtacccgaccgtacgggtacccgttacccggaaggggggaacgggggtcgttaacggggtaacggggttcgggggtttacgggttaaccggttttaacggaaaaaaaacggtttaaaaacgttaggtaaaggtttacggggtaaggtaaaacggggtaaaaaacgttaacgggaaaccggttaacgggttacggtaacccgtaaaccccggggttaagggaaaaacgggtaaagttaccgttaaacccgtaaccgttaaacgttacccgtaaccgaaaacggttaacgtaaacgtttaaacgtaaaaccgttaaaaaaccgggtacgggttttaagtaaacgttttacggaaaaccgttaaaaagttacccggaaaacgtaccggtaaaacccggttaaacggaaaacccggtacgggaaaccctaaccggtaacggttaccccgtttaaaggttaccttttaaaccggaccggtttaaaccgaccggtttaaagtacggtttaacggaaagtccggtaacgtaaaccggttaccggtaaacgggtaaacggtacggtttaacctaaagggtttcgtttaaccgttttaaggtacgtttaccggttacgggtcccgggggaacccgttaagggtaccttaagggttcccgg

SEQ ID NO: 115304 - DNA, 778 bp, Homo sapiens
  misc_feature: GYAE6OF02HYQGS.15.86.H09.1.454.CMB.1.raw
  modified_base (760)..(760): a, c, t, g, unknown or other
  misc_feature (760)..(760): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagcgtgggtttttccttgctgctatacttaaaaggtgtccagtgtgagtgcgaggtggtggaggtgtgggggagtccgttaggtaacggccgtcggggggttacccttaggacgttacgtccgtgtggttcggccttcgtggtacttcctacgttttcgagttaaacgtggtaccgttgggaagttggaagtttcggggtacccgtccgaggtaccgtacccggtaaggggaaacggggtcgtagggtacgggttggggttacggtaacgtttaacgaaaaaggttaaaaagtaggtaaggttgggtaacggaaaggtaaagtaggtaaccgttaacggtacgactaacccggtagaaacggaagtacgtacgacctagtactacaagtagtaacgttaaactaacgtaaaacgtaggtagtttaacgttacgaataaagtacgaaactacgaacgtaaacggaaacggagaaccaaccgtacgcgttacgtaatacgttaacggaacctacgagttaacgtaacggtaagtcgaactaaggtaccggaggtaaacggacggtcgttaagttccgttaggtttagtacgttaagtcccggtacggggaacccgnggttaaccgagttacggg

SEQ ID NO: 115305 - DNA, 665 bp, Homo sapiens
  misc_feature: GYAE6OF02HBEAE.15.86.H09.1.454.CMB.1.raw
  modified_base (215)..(215): a, c, t, g, unknown or other
  misc_feature (215)..(215): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (473)..(473): a, c, t, g, unknown or other
  misc_feature (473)..(473): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggagttcgggctgagctgggttttccttgctgctatcgtaaagtgtctagtgtgaagtgcaggtggtggagtcgtggggganccgttaggaacgccggtcgggggtcccttagcggtctccgtggtgtggcctgtggattctacttcagtanggtcnggatgnggttcggcgacnggctcgagggaggcgtggtacggtgggttcggtacgtttaagaaaagtaaaagtggagtaggtacgaaagtaaaagtgacgtaggtcgaccgaccggtagaaacggaagtacttacgactaatctaacgaagagtataaactaacggaaacgtaggtacggttanaggtaacaagttacaacgagtacaacgaaacgacgaacncacgtacgtnttaactacgactacacgtaagtactagtactacgaacgcgtaacggaacgttaaagggcccgttaagttaccgttaacgttaggtttacctaggttacggtaccccggtagggaacccggttaggtaaccttaagggtccggg

SEQ ID NO: 115306 - DNA, 762 bp, Homo sapiens
  misc_feature: GYAE6OF02JCCLW.15.86.H09.1.454.CMB.1.raw
  modified_base (378)..(378): a, c, t, g, unknown or other
  misc_feature (378)..(378): n is a, c, g, or t
  modified_base (624)..(624): a, c, t, g, unknown or other
  misc_feature (624)..(624): n is a, c, g, or t
  modified_base (669)..(669): a, c, t, g, unknown or other
  misc_feature (669)..(669): n is a, c, g, or t
tcagtctacgtagccacgaccggtgctcgatttagtgctatagacttgggtttggggggggagagggagccccagccttgggatccccaagtgtttcattcagtgatcaggactgaacacagaggactcacatggagtcggctgagctgggtttccttgctgctatacttaaaggtcgtcctaggtgtagtagtgcgtaggtgggtggtagtcggtgggggacgtaccgttagggtaaacggtccgggtccggggggttaccccttagggtaccgttccgttccgttggttacgggttccggacccgtgttcggttacttaccgttacgtttacgaaggttaagtcggtcgtagtagtggtaggttccggtaccgcgnggtaccgtacggaggggtacgggcgtggtaggtcgggtaggtaacgttaacgtaaaagtaaagtgtacggtagtacgaaagtaaaagtacggtaacgtacgtacgtaccgtaacggtaagaaacgggtactaactaccgtacgtaacttcgtaacgaaagtataaagttaacctaaacggtaaaacggtgttacgtaagtacgaagtaaataggtaacacgttaaccggaacgaaacgtacgaacnccgaggtactactagtaacctgtaaccagtactacggtacgtaancgtaacagtaccgaagggtaacgtgtacgttaacttgtactttaacggttctaacggttcggaacccggagggtaacctaggtaccggttcgg

SEQ ID NO: 115307 - DNA, 842 bp, Homo sapiens
  misc_feature: GYAE6OF02GDR8X.15.86.H09.1.454.CMB.1.raw
tcagtctacgtagccacgaccggtgctcgatttagtgctatagacttgggtttgggggggagaggagcccccagccttgggatcccccaagtgttttcattcagtgatcaggactgaacacagagactcaccatggagttcgggctgagcgtgggtttttccttgctgctatacttaaaggtgtacctagtgtagaagtgcgagggtgggtggtaggtcggtgggggacgtccgttagggtaaacgtccgggttgggggtccccgttaggtacgttccgtccgttggtggtcgggtcctcgtaggtactttaccgtacctttacgtagtaacggtggccgttgggagttggttacggttcgggtcccgtaccgacggtccgtaccgggagggggaacggggtcgtggggtaggttggggttacggtaacgtttaaacgtaaaaaggttaaaacgtggagttagggtaagtaaaggtaaaactaggtaacggttaccggtagtaccggaaaccggtaagggtaaaacgggtaactacgttaaccacgtacgtacctaacgaaagtagtaaacttaaaggtaaccgtaaaaacggtacggttagtttaagttaacgtaagtaaaagtacgaaacctacgtaccgtaaacggaaaccgaacggtaaaccgaccgaccgtaccggttaccttaacttaccgtaaccgttaaccgaacgttacggtacgttaacggtagtacgtaccgtacgaaccggtaggtaaggtaccggtagttaacgtcgttaacgtttgacgtttacggtacgggtaccgggtacccggtacggtaaccgtaggttaccgg

SEQ ID NO: 115308 - DNA, 744 bp, Homo sapiens
  misc_feature: GYAE6OF02HKETX.15.86.H09.1.454.CMB.1.raw
  modified_base (696)..(696): a, c, t, g, unknown or other
  misc_feature (696)..(696): n is a, c, g, or t
  modified_base (701)..(701): a, c, t, g, unknown or other
  misc_feature (701)..(701): n is a, c, g, or t
tcagtctacgtagccacgaccggtgctcgatttagtgctatagacttgggtttgggggggagaggagccccaagccttgggatccccaagtgttttcattcagtgatcaggactgaacacagaggactcaccatggagttcgggctgagctgggttttccttgcgtgctatcttaaaaggtgtccagtgtgaagtgcagggtggtggagtctggggagaccttggaaagccgtgggggtcccttagagtctcctgtgtcggcctcgtggattcactttacagtaagtggacgtggaatggtaggttggccgcgtacggccgtacccgaggggaaggggccgtagggtaggttgggttaggtacgtttaacgaaaaggttaaaaagtcgtaagtaggtaacgaaagtaaaagtacggtaacgtaacggtcgaccgacccggtaaggaaacgggtaaacgaacgtttaccaacccgtagtacccgttaacaaacggtacgtaaacgttaaaacgtaaccggaaaaaaccggtaccgggtttaagttaacgttttaacgaaaccgtaaaacgttaggaaaacccgttaagaacccgtaaacggtaaaaacccggggacgaaccgtaaaccgacgtaccgttactaacttaacgaccgtaaccaagtacgtactaccggaatggacagtacgagtaaggngtaanttgtgtttagaattcgacggtccggacgtacggactaagtcgg

SEQ ID NO: 115309 - DNA, 963 bp, Homo sapiens
  misc_feature: GYAE6OF02JAMWN.15.86.H09.1.454.CMB.1.raw
tcagtctacgtagccacgaccggtgctcgatttagtgctatagacttgggtttgggggagaggagccccagccttgggatcccaagtgttttcattcagtgatcaggactgaacacagaggactcaccatggagttcgggctgagctgggtttccttgctgctatcttaaaaggtgtccagtgtgaagtgcaggtggtggagtcgtgggggagccgttaggtaaacgccgttcgggggtacccttaggagttccgtccgttggtggtcggtcctcgtcggtacttctactttcaagttaagtcggacgtggtatagtacggttcgggtacccgtccgtaggtcgtacccggaagggggtaacgggggtccgtgggtacgggttacggggttcggggttaaaccgtttaaggaaaaaacgttaaaaacgttagggtaagttaggggtaaagtaaaaggtaaaaagtacgtaaaccggttaacggtggtaacccgtaacccggttaaggaaaaacgggtaacgtaacgttaccgtaaccgtaagtccgtaacgaaagtaaggtaaactttaaacgttaaaccgtaaaaaaccggtagggtttaacgtttaaacggttttaagaaaccgttaaaacgttaacggaaacccttacgggtaaaacccctaaacgggttaaaaaaccccggaacggttaaaacccgaacccgggttaacggtaaccccgggtttaaacttaaaccggttttaaccgtaacccggtaaacctaacggttaaacggttaacggtttaaccggtaacggttaccgtaccgtaaaaccgttaaccggggtaaacggttaaaggggtaaccgttacggttaaacgttttaccgggttacggtttttaacgtaacggttaacggtttaaccccgggccggggttaaaccccggtaacgggttaacccgtaacgggttttccgggg

SEQ ID NO: 115310 - DNA, 930 bp, Homo sapiens
  misc_feature: GYAE6OF02GV4WF.15.86.H09.1.454.CMB.1.raw
  modified_base (197)..(197): a, c, t, g, unknown or other
  misc_feature (197)..(197): n is a, c, g, or t
  modified_base (851)..(851): a, c, t, g, unknown or other
  misc_feature (851)..(851): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagcgttgggttttccttgctgctatacttaaaggtgtcagtgtgaagtgngaggtggtggaggtcgtgggggagtccgttagggtaaacggtccggttcgggggtacccttaaggtacgttccgttccgttggttacggtcggtccgttcgtggtacttccgttaactttacgtaagttaagtcggtcgtacggagttaggtacgggtttccgggtacccgaccgtacgggtaccgtaccgggaacgggggaacgggggttccggtaggggtacggggttacggggtttacgggttaaaccggttttaaaacgaaaaaaggtttaaaaagtcgggtaaaggttacggggtaagtaaaaggtaaaaacgttacggtaaccgtacggtaccgaaccgtaaaccggtaaggaaaaacgggtaataacgtaccaaccgtagtaaccgtaaacgaaagggtaataaaacgttaaacgtaaaaccggtaaaaacggttcggtttaagtttaagtttaaccggaaagttaaacgaacgtaaacgaacggttaacccgtaaacgggaaaaacccggaggtaaacccgaaccgttaccggtacctttaacgttaacgttaccctacggtaaccctaacgtaacgggttaaccgttaacggtaacgtacgtaaccgtaaggttacccgggaaacgggttaaggaaccgggtttnttaaccgtttagggtttccgttaaagtacgttacggttcccgggaccgggtaccctaagggtaccgttaacggttcggg

SEQ ID NO: 115311 - DNA, 1016 bp, Homo sapiens
  misc_feature: GYAE6OF02H2994.15.86.H09.1.454.CMB.1.raw
tcagtctacgtagccacgaccggtgctcgatttagtgctatagacttgggttgggggagaggagccccagccttgggatccccaagtgttttcattcagtgatcaggactgaacacagaggactcaccatggagttcggctggagctggttttccttgctgctatacttaaagtgtaccagtgtgagtgacgaggtggtggtagtcgtggggtagtccgttaggtaacgcggtcgggggtaccttaggacgtccttccgtggtcggtcggtaccgttcgtggtactttacctacgttttcgaaggtttaacgtcggtaccgttagggacgttaggtagggtttccgggtccccggtaccggtaacggtcccgtaccggaacgggggtaacgggggtccggttaggggtagggttttacggggttaaccggggttaaccggttttaaaccggtaaaaaaaacggttttaaaaacggttagggttaaacggttagggttaacggaaaaaggtaaaaacgttaacggtaaccgttaacgggtaccggtaacccgaaacccgggttaaagggaaaacgggtaaacgtaccgttaacccgtaaacctacgttacccaaaccgtaaacgtaaggtaaactttaaaaccggtaaataaaaaacccggggttgggtttaaacgtttaagttttacggaaataaaagggttaacgaaactacggttaaacccgtaaaacgggaaaaccggaacggaaaccgttaaacctacccggtcgttaaacgtttacccgtttaaaccgtaaccgttaaacccgaacgggttaacgtaacgggtttaaccggggtaagccggttaaaaccgttagtaaacccgggggtttaaaagaacccggggttaacggtcccttttaaaaaggtccccgtttttagttttaaaggaaccgttttaaccgggttccggggggtttaaacccccgaaccggggttaaaacgggttacccggtaaggtttttaaccccgggg

SEQ ID NO: 115312 - DNA, 899 bp, Homo sapiens
  misc_feature: GYAE6OF02GG5B6.15.86.H09.1.454.CMB.1.raw
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgctgctatacttaaaaggtgtccagtgtgaagtgcagggtggtggagtcgtgggggagccgttagggtaaacggtccgtacgggggtcccttaggacgttcctccgtgtggtcggtccctcgtggtacttcctaactttcgaagtaagtggtacgttggagtggttacggttcgggtacccgaccgtacggtcccgtacccggaagggggaaaccgggggcgttaggggtacgggttaggggttacgggttaaaccggttttaaacgaaaaaaaggttaaaaaggtaggtaaagttacgggtaaggtaaaaggtaaaaagttacggtaaaccggttaacgggtacgtacccgtaaacccgggtaaggtaaaaacgggtaaacgttaacgttaaccgaaccgtaattaccgtaacgaaacgtaagtaacttaaacgttaaaccgaaaaaacggttcgggttaagttaagtttacgaaacgtaaagttacgaaacctacggtaacccgtaaaccgggaaaacccgtaaggaacccgaacgaccgttaccgttaaccgttaacttaaccgttaacgtaacccgaaacgtacggttacgttaacgggaccgtacgtaaccgtaacggtaccgggtaaggtaaccgggtacggtaaccgtttaaaggttccgttaagttttacgtaacttacgggtttcccgggaaacccgggttacggaaccggttacgaaccggttcccggg

SEQ ID NO: 115313 - DNA, 781 bp, Homo sapiens
  misc_feature: GYAE6OF02HBZ20.15.86.H09.1.454.CMB.1.raw
  modified_base (216)..(216): a, c, t, g, unknown or other
  misc_feature (216)..(216): n is a, c, g, or t
  modified_base (565)..(565): a, c, t, g, unknown or other
  misc_feature (565)..(565): n is a, c, g, or t
  modified_base (656)..(656): a, c, t, g, unknown or other
  misc_feature (656)..(656): n is a, c, g, or t
  modified_base (707)..(707): a, c, t, g, unknown or other
  misc_feature (707)..(707): n is a, c, g, or t
  modified_base (739)..(739): a, c, t, g, unknown or other
  misc_feature (739)..(739): n is a, c, g, or t
tcagtctacgtagccacgaccggtgctcgatttagtgctatagacttgggtttgggggggagaggagccccagccttgggatccccaagtgttttcattcagtgatcaggactgaacacagaggactcaccatggaggttcgggctgagcttgggttttccttgctgcctatactttaaaacggtgtccagtgtgaagtgcaggtggtggagtcgnggggagtccgttagggtaacgccggtcgggggttcccttagacggtccttccgttgtcggttcggccttccgttgggtactttaccgtccttttacgtagtaagtcgggtccttacgggagtgtacggtttacgggggtccccggtaccgacgggtccccgtaccgggaagggggaaacgggggttcggtacggggaggttgggggttacggttaacggtttaaacgtaaaaaaccgttaaaaagtacggtaagtacggtaacggtaagtaaaagtaacgttaaccgtacggtacgtaccgacggttaaaggaaaggtaagtagtaccaaccgtacgtactaacggtanaacgtaataacgtttaacgaaaacggtcgttagttaagtcgtaaacgtaaagtcggtaaacacgggtacctaaacggaaaccggtgaaccncgaacggtccttattacgtactcgtacaccgtagttcgtacgagtacgacncgttaaggaacgaaggaggtactgtacggttntttcgtaacgtgaccggttccgggacacgggtatagggtccg

SEQ ID NO: 115314 - DNA, 853 bp, Homo sapiens
  misc_feature: GYAE6OF02HI54Q.15.86.H09.1.454.CMB.1.raw
tcagtctacgtagccacgaccggtgctcgatttagtgctatagacttgggtttggggggagaggagcccccagccttgggatcccccaagtgttttcattcagtgatcaggactgaacacagaggactcaccatggagttcggctgagcgttggttttccttgctgtctatacgttaaaggtcgtaccgagtgtagagtgcgaggtggtggagtcggtggggacgtacgttaggtaaacggtccggtacgggggtacccttagacgttccttccgttggtcggtcggtccgttacgtggtattcctactttacgaagttaacgtggtacgtaggtagttggtacggttccgggtcccgaccgtacggtcccgtacgggagggggtaacggggtcggtacgggtagggtttacggggtttacgggttaacccgtttaaaagtaaaaaagttaaacgtagtaaggttagggaagtaaaggtaaaagtaacggtacggttaacggtacgaccgtaaccggtaaaggaaaacggtataacgttacccgtaactacgtaccgtaataaacgtaacgtaaagtttaaacgtaaaccgggaaaaccgttagggtttaacgtttaagttacggtaaactaaaagttacgaaaacggtaaccgtaacccggaaaacggtaaacccgaaggtaaccgtaccgaaacgttccgttaaactagtttaacccgacgtacgaaccgtagttacgtaacggtaactgtactagtaaccgggacgtaacgggtacgtactaggttaccgttagtacgttacgtacggtacccgggtacggtacccggtaaggtcccgtaaggtccccgg

SEQ ID NO: 115315 - DNA, 727 bp, Homo sapiens
  misc_feature: GYAE6OF02I6255.15.86.H09.1.454.CMB.1.raw
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
  modified_base (510)..(510): a, c, t, g, unknown or other
  misc_feature (510)..(510): n is a, c, g, or t
  modified_base (538)..(538): a, c, t, g, unknown or other
  misc_feature (538)..(538): n is a, c, g, or t
tcagtctacgtagccacgaccggtgctcgatttagtgctatagacttgggtttggggggggagaggagccccagccttgggatccccaagtgttttcattcagtgatcaggactgaacacagaggactcaccatggagttcgggctgagctgggttttccttgctgtctatcgttaaaggtgtccagtgtgaagtgacaggtggtcggagtcgtgggggtagtccttaggtaaacggtccgtgggggtcccttagacgttcctccgtgtggtcggctcgtaggnttctacttcagtaatggtctgtatgaggttcggtcgcgngctaccgagggacgggcgtggnggtggttggtacgttaacgaaaggtaaatgagtaggtagtaagaaatagtagtacggtagtaccaccggtaagaaaggtatacttacgacctagtacacgtaaagtacgtaataaacgtaacaaaacggtacggttaattacgttagaactaacgataaccgganaccgtaaacgaacgacgtacgtaaaccnccggttaccttacgtaccttaccgtacggtaaccctaccgtaagtaccggttaacggtaacgacgtaccgtaaccgtacgggtacgtaacgggtaaccggtacttagttaaccggtttaacgttacggaaccgtttaggttacccgggtagggtaaccccgggttaccggggtaatacccgggttcggg

SEQ ID NO: 115316 - DNA, 812 bp, Homo sapiens
  misc_feature: GYAE6OF02G75AV.15.86.H09.1.454.CMB.1.raw
  modified_base (133)..(133): a, c, t, g, unknown or other
  misc_feature (133)..(133): n is a, c, g, or t
  modified_base (531)..(531): a, c, t, g, unknown or other
  misc_feature (531)..(531): n is a, c, g, or t
  modified_base (772)..(772): a, c, t, g, unknown or other
  misc_feature (772)..(772): n is a, c, g, or t
  modified_base (802)..(802): a, c, t, g, unknown or other
  misc_feature (802)..(802): n is a, c, g, or t
tcagtctacgtagccacgaccggtgctcgatttagtgctatagacttgggtttggggggggagaggagccccagccttgggatccccaagtgttttcattcagtgatcaggactgaacacagagactacacanggagtcggctgagtcgttcgggttttccttgcgtcgacgtactaacgttaaaggtcgtacagtgtagaagtcgacgtaggtggtagtggtcggtggggacgtccggttaggtaacggtccggtcgggggtaccttaggtacgttccgtcgtaggtggtcgtccgtcgttggtcttctacgtttactaagttaagtcggtacgtgggtagttggtcggttcggcccgtccgacggtccgacgggtaaggggacgggtacgtagggacgggttgggttaccgttaacggttaaacgaaaaagttaaaggtaggagttaaggacgaaaagtaaacgtaagtacgtaacggtcgaaccaacgggtaagtaaggaacgtattaccgaactactagacgtaaanacgttaagtaaaccgtaacctaaaacgggtacgttaaggtagttaacgtaaccgtaagtaacctaaacgtaccgaaaccgaaaccggtaaaacggtacccgaacgtaccgcgggttaaacttaccgttaaacgtaaccgtaccgttaaccgataaacggtcgtaaaccggggtatccgtaacgtaacgtaaccgtacggtaaacgacgttattaaccggttagttcccgttaagtaacggngttacccggacggttaaccggacggttaancgggtaaccg

SEQ ID NO: 115317 - DNA, 806 bp, Homo sapiens
  misc_feature: GYAE6OF02FZ1WK.15.86.H09.1.454.CMB.1.raw
  modified_base (449)..(449): a, c, t, g, unknown or other
  misc_feature (449)..(449): n is a, c, g, or t
  modified_base (748)..(748): a, c, t, g, unknown or other
  misc_feature (748)..(748): n is a, c, g, or t
tcagtctacgtagccacgaccggtgctcgatttagtgctatagacttgggtttggggggagaggagccccagccttgggatccccaagtgttttcattcagtgatcaggactgaacacagaggactcaccatggagttcgggctgagctgggttttccttgcgtgctatacttaaaaggtgtcctagtgtgaacgtgcaggtggtggagtcgtaggggagccttaggaagtccggtcgggggtcccttagcgtctccgtgtcgtcggcctcgtggtacttcgtaaccttttcgagttaacgtggtcgtaggtagtagtacggttcgggtacccgcaggtccctaccggaggggtaaggggtcgtagggacggttggggttacggtacgtttaacgaaaaggtaaaatgtagtcgggttaagaaagtaaacgtaggtaaccgtacggtanaccgtaacggtacgaaaagggtagtaacgttaccaccgtattaccgagtaaacgaagtaactaaacgtacgtaaaaaccggtggtttcttaacgtttagaactaaacggtacgaaacctacggtaaacgttaaaccggaaaacccggttggaaaccccagtttaaccgggccctttaacttacgttaacggttaccggtaaacctagaacggtacgtttaacgggaagtcccgtaacgtaacgtttcccgggaaggttaaacgggcgggttacccttaaggttccgttaacggttttanaaccggttaagtttcccgggaccggggttacccaagggttaccccgtaggttacccgg

SEQ ID NO: 115318 - DNA, 1041 bp, Homo sapiens
  misc_feature: GYAE6OF02JD57G.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctgggttttccttgctgctatacttaaaggtgtccagtgtgaagtgacgaggtggtggtagtcggtagggggacgtaccgttaggtaaacgtccgggtcgggggttacccgttaggtagttccttccgttggtcggtcggtcccttcgtggtacttcgtacctttacgaagttaacgtaggtcggttggtagttaggtaggttcggggtcccgtaccgtaccgggtaccgttacccggtaacgggggtaacgggggtcgttaaggggtcgggttacggggtttacgggtaaccggtttaaaggtaaaaaacggttaaaagttaggtaacggttagggtaaggtaaaccgtaaaaggttaacggtaacccggttaacggtaccgaacgtaaacccgggtaaaggaaaacgggtaaacgtaacggtttaacccaaccgttaacgttacgtaaacccggtaaggtaaacgtaaactttaaacggtaaaacccggtaaaaaacgggttaccggttttaaagttaacgggtttttaacaaaaccggtaaaacgttaaccgtaaaccgggttaaccgtaaccgggttaaaaccggtaaacccgggaaacggttaaacccgaaaccggttccgtaacccggtttttaacgttaaacccgtttacccggtaaaccgttaaccccgttaaagggtaaaccggttttaaacgttaaccggggttaacgcgggtttaaaaccctaggttaaaacccggggttaaagggtaaacccggttacgggttccgttttaaacgggttagtttaaacccgggtttttacgaaaacgtttcccggggtttaacggggttaccccccggggtaacggtaacgggggtaaacccttaccgggggttttcccggg

SEQ ID NO: 115319 - DNA, 985 bp, Homo sapiens
  misc_feature: GYAE6OF02JNGTL.15.86.H09.1.454.CMB.1.raw
tcagtctacgtagccacgaccggtgctcgatttagtgctatagacttgggtttgggggggagaggagccccagccttgggatccccaagtgttttcattcagtgatcaggactgaacacagaggactcaccatggagttcggctgagctcgggttttccttgctagcttatacgttaaaggtcgtccgagtgtagaagtcgcagggtggtggtacgtcgtagggggacgtccgtttagggaaacgtcccgggttggggggtcccttaggcggttcctccgttggtggtcggccgttcgttcggacttcgtaccttttcaaggttaacgtgggtccttgggtaagttcggtaacggggtttccggggttaccccggccgtacggggttacccgtccgggtaaacgggggggacgggggtacgtggggtaaccgggttagggggttacgggtaaccggtttaacggtaaaaaaggttaaaacggttgggaaggtttccgggttaaggtaaacggtaaaaaggttaacggaaccggttaaaccgggtcggtaacccgtaaaccggggtaaggaaaaaccggggtaacgtaacgttacccgtaaccgacccgtttataaacccgaaagttaaggtaaacgtttaaacggtaaaacccgtaaaaacggggtaggtttaacttacggttttaaaacgaaaccggtaaattaaccgggtaaacgtaaccgtaacccgttaaacggggaaacccggtaaccgaaacgtaccggaaccgttaccggtttaacccgtaacgttaacccggtaagttaccccgtaaacggtaacggttacgggttaaccggtaaacggccgtaaacgggtaccgttaaccgggtaaggggttaaccgggaacggttagtttacggtaccttaaggttaccgttaaggttcggttaccccgggaccggggttaggggaaaccccgggttagttaaccggttccgggg

SEQ ID NO: 115320 - DNA, 847 bp, Homo sapiens
  misc_feature: GYAE6OF02H9WMJ.15.86.H09.1.454.CMB.1.raw
tcagtctacgtagccacgaccggtgctcgatttagtgctatagacttgggttgggggggagaggagccccagccttgggatccccaagtgttttcattcagtgatcaggactgaacacagaggactcaccatggagttcgggctgagctgggttttccttgctgctatacttaaaaggtgtccagtgtgaagtgcgaggtggtggagtcgtgggggagtccgttaggtaaagtccggtacggggggttccccttaggacgtccttccgtggtggtcggtcctcgtgggtattcgtacttttcgagttaagtggtactggtaagtggtaggttcgggtcccgaccgaggtccgtaccggaagggggtaacggggtccgtaggggtacggttggggttagggtaacgttttaacgaaaaagttaaaaatggtaagtaggtaaggtaaagtaaaagtacggtaacgttacggtacgacccgtaaccggtaaggaaaaggtaacgtacgttaaccaactaacgttacctaacgaaagtaaagtaacttaaaacgtttaaccgtaaaaaacggtacggttaagttaagttaacggtaactaaacgtaacgaaacgtacgaaaccgtaaacggaaaaaccggtaacggaacaccgtacggtaccgtaccgttaacgtttaacccttacggtaaccctaacgttaacgtaaccggtttacggaacggtacgtaacgtaacgttaaccggaacgggtaaaggtaccggtaacgttaacgtttgttaacccgttttagacggtttaacggttcggtaacccggggttaccggtaacggtaaccggtagttaccggg

SEQ ID NO: 115321 - DNA, 296 bp, Homo sapiens
  misc_feature: GYAE6OF01CFZWL.37.34.D01.1.454.CMB.1.raw
  modified_base (293)..(296): a, c, t, g, unknown or other
  misc_feature (293)..(296): n is a, c, g, or t
tcagtagtgtagatcacgaccggtgctcgatttagatcgtctgtgttgggtttgggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnn

SEQ ID NO: 115322 - DNA, 298 bp, Homo sapiens
  misc_feature: GYAE6OF01BSBG7.37.34.D01.1.454.CMB.1.raw
  modified_base (294)..(298): a, c, t, g, unknown or other
  misc_feature (294)..(298): n is a, c, g, or t
tcagtagtgtagatcacgaccggtgctcgatttagatcgtctgtgttgggtttggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnn

SEQ ID NO: 115323 - DNA, 296 bp, Homo sapiens
  misc_feature: GYAE6OF01CF8F5.37.34.D01.1.454.CMB.1.raw
  modified_base (294)..(296): a, c, t, g, unknown or other
  misc_feature (294)..(296): n is a, c, g, or t
tcagtagtgtagatcacgaccggtgctcgatttagatcgtctgtgttgggtttggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 115324 - DNA, 295 bp, Homo sapiens
  misc_feature: GYAE6OF01AYGU9.37.34.D01.1.454.CMB.1.raw
  modified_base (293)..(295): a, c, t, g, unknown or other
  misc_feature (293)..(295): n is a, c, g, or t
tcagtagtgtagatcacgaccggtgctcgatttagatcgtctgtgttgggtttggggaagaggaagactgacggtcctgccacaggtggtgctgaggaagagatggaggtggacgtgtcagcacccagctgggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 115325 - DNA, 296 bp, Homo sapiens
  misc_feature: GYAE6OF01CSC1Q.37.34.D01.1.454.CMB.1.raw
  modified_base (296)..(296): a, c, t, g, unknown or other
  misc_feature (296)..(296): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagn

SEQ ID NO: 115326 - DNA, 297 bp, Homo sapiens
  misc_feature: GYAE6OF01C2WE8.37.34.D01.1.454.CMB.1.raw
  modified_base (288)..(288): a, c, t, g, unknown or other
  misc_feature (288)..(288): n is a, c, g, or t
  modified_base (293)..(297): a, c, t, g, unknown or other
  misc_feature (293)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcaccagctggggcctgtccctggtcaccgtctcctcagcctccaccaagggcccatcggtcttcccctggcgccctgctccaggagcacctccgagagcacagcggcctgggctgcctggtcaaggactacttccatctacactactgagcgggctggcaaggcgnatagnnnnn

SEQ ID NO: 115327 - DNA, 525 bp, Homo sapiens
  misc_feature: GYAE6OF01B0IVD.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgtggtttcctgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctgggagtgggtggccaacagtacaggggaggtggtggtaacgaaaaactagtgtgaactctgtggcggggccattcaccatctccagagacaacgacccaaaaactcactgtatctgcaaatggacgcctgagatccgaggacacggctgtgtattattgtgcgagagtatttagactacaaagtttcgagtgactggtatgatg

SEQ ID NO: 115328 - DNA, 515 bp, Homo sapiens
  misc_feature: GYAE6OF01EFZ1E.37.34.D01.1.454.CMB.1.raw
  modified_base (225)..(225): a, c, t, g, unknown or other
  misc_feature (225)..(225): n is a, c, g, or t
  modified_base (395)..(395): a, c, t, g, unknown or other
  misc_feature (395)..(395): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtagagacagagtcatcatcacttgccgggnaagtcaggcattagaaatgatttaggctggtatcagcagaaaccagggaagcccctaagctcctcatctatggtgcatccagtttacaaacgtgggtacccattaagattcagcggcagtgatctggcacagtatttcactctcaccatcagcagcctgcagcctgaatntttgctaacttattactgtactacaagtattactaacttacccgtcgtaccgttcggacccgtaagggacccgtaaagggtcggaacgttacaaacgtaactggtaggctggctaacccg

SEQ ID NO: 115329 - DNA, 494 bp, Homo sapiens
  misc_feature: GYAE6OF01CHDLA.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaactgggtcccattaagattcagcggcagtggatctggcacagatttcactctcaccatcagcagcctgcagcctgaagtattttgctaacttattactgtctacaagtattacaattaccctcgtacgttcggcctaagggaccaaggtggaagtcaaacgactgaggctgctaccg

SEQ ID NO: 115330 - DNA, 503 bp, Homo sapiens
  misc_feature: GYAE6OF01CHBZW.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcaggcattagaaatgatttaggctggtatcagcagaaaccagggaaagcccctaagctcctgatctatgatgcctcactttggaaacgcgggtcccatcgaaggttcagcggcagtgtatctgggacagattcactctcacatcagtagcctgcagcctgattgtattttgactaactttattactgtactagctaactataagtgggaagtagtcgggaccggagggacctaggggttgaagatacgaaacgtacgtgtaggctgctaaccg

SEQ ID NO: 115331 - DNA, 293 bp, Homo sapiens
  misc_feature: GYAE6OF01AVRM2.37.34.D01.1.454.CMB.1.raw
  modified_base (291)..(293): a, c, t, g, unknown or other
  misc_feature (291)..(293): n is a, c, g, or t
tcagtagtgtagatcacgaccggtgctcgatttagatcgtctgtgttgggtttggggaagaggaagactgacggtcctgccacaggtggtgctgaggaagagatggaggtggacgtgtcagcaccagctgggcctgtccctggtcaccgtctcctcagcctccaccaagggcccatcggtcttcccctggcgccctgctccaggagcacctccgagagcacagcggcctgggctgcctggtcaaggactacttccatctacactactgagcgggctggcaaggcgcatagnnn

SEQ ID NO: 115332 - DNA, 298 bp, Homo sapiens
  misc_feature: GYAE6OF01A84KS.37.34.D01.1.454.CMB.1.raw
  modified_base (296)..(298): a, c, t, g, unknown or other
  misc_feature (296)..(298): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnn

SEQ ID NO: 115333 - DNA, 297 bp, Homo sapiens
  misc_feature: GYAE6OF01BPPQI.37.34.D01.1.454.CMB.1.raw
  modified_base (294)..(297): a, c, t, g, unknown or other
  misc_feature (294)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctgggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnn

SEQ ID NO: 115334 - DNA, 315 bp, Homo sapiens
  misc_feature: GYAE6OF01BZCJ6.37.34.D01.1.454.CMB.1.raw
  modified_base (296)..(315): a, c, t, g, unknown or other
  misc_feature (296)..(315): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnnnnnnnnnnnnnnn

SEQ ID NO: 115335 - DNA, 297 bp, Homo sapiens
  misc_feature: GYAE6OF01DT6DM.37.34.D01.1.454.CMB.1.raw
  modified_base (296)..(297): a, c, t, g, unknown or other
  misc_feature (296)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnn

SEQ ID NO: 115336 - DNA, 520 bp, Homo sapiens
  misc_feature: GYAE6OF01DXNEF.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaggggctggagtgggtggccaacatacaggggaggtggtggtaacgaaaaactatgtggactctgtgcggggccattcaccatctccagagacaacgaccaaaaactcactgtatctgcaaatggacgctgagatccgaggacacggctgtgtattattgtgcgagagtatttagacttacaaagttcgagtgactggtatgatg

SEQ ID NO: 115337 - DNA, 298 bp, Homo sapiens
  misc_feature: GYAE6OF01DARCG.37.34.D01.1.454.CMB.1.raw
  modified_base (289)..(289): a, c, t, g, unknown or other
  misc_feature (289)..(289): n is a, c, g, or t
  modified_base (295)..(298): a, c, t, g, unknown or other
  misc_feature (295)..(298): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcncatagnnnn

SEQ ID NO: 115338 - DNA, 490 bp, Homo sapiens
  misc_feature: GYAE6OF01EW4N7.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaccagggaaagcccctaagctcctcatctatgtgcatccagtttacaaactgggtccattaagattcagcggcagtggatctggcacagtattcactctcaccatcagcagcctgcagcctgaagtattttgctaacttatactgtactacaagtattacaattaccctcgttacgtcggaccgaagggaccaagggtgaagtcaaacgactgtagctgctac

SEQ ID NO: 115339 - DNA, 298 bp, Homo sapiens
  misc_feature: GYAE6OF01B3JEV.37.34.D01.1.454.CMB.1.raw
  modified_base (296)..(298): a, c, t, g, unknown or other
  misc_feature (296)..(298): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 115340 - DNA, 346 bp, Homo sapiens
  misc_feature: GYAE6OF01B6CAP.37.34.D01.1.454.CMB.1.raw
  modified_base (199)..(199): a, c, t, g, unknown or other
  misc_feature (199)..(199): n is a, c, g, or t
  modified_base (336)..(346): a, c, t, g, unknown or other
  misc_feature (336)..(346): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctagctccaccaacggaccgctcgtcgttccctccgcgcctcncgtccacgagcacctccgacgagcgacacgcggcccgtccggcggtcgtccgtcggtcgaacggaacgtacctttacctactacttacctaactaaccttcgaggcgggccggtcgcgaacggacggccataagtgnnnnnnnnnnn

SEQ ID NO: 115341 - DNA, 173 bp, Homo sapiens
  misc_feature: GYAE6OF01B5FVM.37.34.D01.1.454.CMB.1.raw
  modified_base (173)..(173): a, c, t, g, unknown or other
  misc_feature (173)..(173): n is a, c, g, or t
tcagtagtgtagatcacgaccggtgctcgatttagatcgtctgtgttgggtttgggggaagaggaagactgacggtcccccaggagttcaggtgctgggcacagcggccctgggctgcctggtcaaggactacttccatctacactactgagcgggctggcaaggcgcatagn

SEQ ID NO: 115342 - DNA, 542 bp, Homo sapiens
  misc_feature: GYAE6OF01A8VTC.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgagttcaccgatctccagagacaacgccaaaaactcaactgtatctgcaaatggacggcctgagatccgaggacacggctgtgtattattgtgcgagagatttagactacaaagtttcgagtgactggtatgatgcttatgatacctggggccaagggaccagtggcaccgtctcttcagcctccacaagggcccagtcggtcttcccccgtggccgccctgcctcccgaggacgccaccctccgagacgcacgacgg

SEQ ID NO: 115343 - DNA, 297 bp, Homo sapiens; identical to SEQ ID NO: 115335
  misc_feature: GYAE6OF01EP82O.37.34.D01.1.454.CMB.1.raw
  modified_base (296)..(297): a, c, t, g, unknown or other
  misc_feature (296)..(297): n is a, c, g, or t

SEQ ID NO: 115344 - DNA, 299 bp, Homo sapiens
  misc_feature: GYAE6OF01CQWMI.37.34.D01.1.454.CMB.1.raw
  modified_base (296)..(299): a, c, t, g, unknown or other
  misc_feature (296)..(299): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaagggactacttccatctacactactgagcgggctggcaaggcgcatagnnnn

SEQ ID NO: 115345 - DNA, 543 bp, Homo sapiens
  misc_feature: GYAE6OF01CZGQ2.37.34.D01.1.454.CMB.1.raw
  modified_base (371)..(371): a, c, t, g, unknown or other
  misc_feature (371)..(371): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctgggagtggggtggccaacatacaggggagtggtggtaacgaaaaactntgtggactctggtgcggggccgattccacatctccagagacaacgaccaaaactcaactgtatctgacaaatggacggcctgagactccggaggacacggcttggtgtattagttgtgcgagagtatttagaacttaacgaaagtttcgaggttgacgtggttatgattcgg

SEQ ID NO: 115346 - DNA, 300 bp, Homo sapiens
  misc_feature: GYAE6OF01EIKMI.37.34.D01.1.454.CMB.1.raw
  modified_base (295)..(300): a, c, t, g, unknown or other
  misc_feature (295)..(300): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnn

SEQ ID NO: 115347 - DNA, 566 bp, Homo sapiens
  misc_feature: GYAE6OF01CTRPQ.37.34.D01.1.454.CMB.1.raw
  modified_base (336)..(336): a, c, t, g, unknown or other
  misc_feature (336)..(336): n is a, c, g, or t
  modified_base (451)..(451): a, c, t, g, unknown or other
  misc_feature (451)..(451): n is a, c, g, or t
  modified_base (531)..(531): a, c, t, g, unknown or other
  misc_feature (531)..(531): n is a, c, g, or t
  modified_base (542)..(542): a, c, t, g, unknown or other
  misc_feature (542)..(542): n is a, c, g, or t
  modified_base (559)..(559): a, c, t, g, unknown or other
  misc_feature (559)..(559): n is a, c, g, or t
tcagtagtgtagatcacgaccggtgctcgatttagatcgtctgtgttgggttttccttgttgctattttagaaggtgtccagtgtgacgtgcaactggtggagtcgtggggggaggcttggtccagccgtggggggtccctgagactctcctgtgcagcctctggattcaactttggtagctattggatggactgggtccgccagtctccgaggggaaggggctgggagtgggtggccaaacatacgaggggaggtgggtaggtaaacgaaaaactgtggtggacttcgtggtggcggggccgattcaccatctccagagacaacgaccaaaaacncactgtatctgacaaagtggacgcctgagagtccggaggacacggctgtgtattagtgtgacgagtagtatttagaactaagtaaagtttcgagtgagtggtatgatgcttaagngacgtaccggtggggaccaagggaccagtcggtaccaccgtctctcacgtccaccacgacggccacgtcgtcctccccgngccgcctgccncgagcacaccgcgagcncgagcgg

SEQ ID NO: 115348 - DNA, 298 bp, Homo sapiens
  misc_feature: GYAE6OF01BYCMK.37.34.D01.1.454.CMB.1.raw
  modified_base (298)..(298): a, c, t, g, unknown or other
  misc_feature (298)..(298): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtccttccccctggccgccctgctccaggagcacctccgagagcacagcggccctgggctgcctggtcaaggactacttccatctacactactgagcgggctggcaaggcgcatagn

SEQ ID NO: 115349 - DNA, 302 bp, Homo sapiens
  misc_feature: GYAE6OF01CZIEW.37.34.D01.1.454.CMB.1.raw
  modified_base (296)..(302): a, c, t, g, unknown or other
  misc_feature (296)..(302): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtccttcccctggccgccctgctccaggagcacctccgagagcacagcggccctgggctgcctggtcaaggactactccatctacactactgagcgggctggcaaggcgcatagnnnnnnn

SEQ ID NO: 115350 - DNA, 308 bp, Homo sapiens
  misc_feature: GYAE6OF01B0059.37.34.D01.1.454.CMB.1.raw
  modified_base (297)..(308): a, c, t, g, unknown or other
  misc_feature (297)..(308): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacaggccggccctgggctgcctggtcaaggactacttccatctacactactgagcgggctggcaaggcgcatagnnnnnnnnnnnn

SEQ ID NO: 115351 - DNA, 531 bp, Homo sapiens
  misc_feature: GYAE6OF01AN76Y.37.34.D01.1.454.CMB.1.raw
  modified_base (371)..(371): a, c, t, g, unknown or other
  misc_feature (371)..(371): n is a, c, g, or t
  modified_base (529)..(529): a, c, t, g, unknown or other
  misc_feature (529)..(529): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactggggtccgccagtctccagggaaggggctggagtgggtggccaacatacaggggaggtggtggtaacgaaaaactntgtggactcgtgtgcggggccgattcaccatctccagacgacaacgacccaaaactcactgtatctgcaaatggacggcctgagatccggaggacacggctgtgtattagttgtgcgagagtatttagactacaaagtttcgagtgacttaggtatgntg

SEQ ID NO: 115352 - DNA, 566 bp, Homo sapiens
  misc_feature: GYAE6OF01CKHJG.37.34.D01.1.454.CMB.1.raw
  modified_base (539)..(539): a, c, t, g, unknown or other
  misc_feature (539)..(539): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctgggagtgggtggccaacatacaggggaggtggtggtaacgaaaaactatgtggactctgtgcggggccgattcaccatctccagagacaacgaccaaaaaactcaactgtaatctgacaaatggacgcctgagatccgaggacacggctgtgtattatgtgcgagagtatttagactacaaagtttcgagtgactggtatgatgcttatgataccgtggggaccaagggaccagtggtactaccgtctcttacacgtcctaccacgaacgggcccagtccggtccttccccgtggccgccccgtgccctcccgagggacnccgtaccctacgagacgccacgacggg

SEQ ID NO: 115353 - DNA, 302 bp, Homo sapiens
  misc_feature: GYAE6OF01DPIJW.37.34.D01.1.454.CMB.1.raw
  modified_base (297)..(302): a, c, t, g, unknown or other
  misc_feature (297)..(302): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnn

SEQ ID NO: 115354 - DNA, 529 bp, Homo sapiens
  misc_feature: GYAE6OF01BA8E6.37.34.D01.1.454.CMB.1.raw
  modified_base (454)..(454): a, c, t, g, unknown or other
  misc_feature (454)..(454): n is a, c, g, or t
  modified_base (526)..(526): a, c, t, g, unknown or other
  misc_feature (526)..(526): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgagggaagggctggagtgggtggccaacatacgagggaggtggtaggtaacgaaaaactgtgtggactctggtgcggggccgattcaccatctccagagacaacgaccaaaactcactgtatctgacaagtggacgcctgagngtaccgaggacgacggctgtgtattagttgtgcgagagtattagactactaagttcgagtgacgtggtatgngtg

SEQ ID NO: 115355 - DNA, 564 bp, Homo sapiens
  misc_feature: GYAE6OF01CFJJQ.37.34.D01.1.454.CMB.1.raw
  modified_base (536)..(536): a, c, t, g, unknown or other
  misc_feature (536)..(536): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacaggggaggtggtggtaacgaaaaactatgtggactctgtgcggggccgattcaccatctccagagacaacgccaaaaactcactgtatctgacaaatggacggcctgagatccgaggacacggctgtgtattatgtgcgagagatttagactacaagtttcgagtgactggtatgatgcttatgataccgtggggaccaaggggaccagtggtccaccgtctcttcagtccctccaccaacgggcccagtccgggtccttccccccgtggcccgtccccgtgccgtcccaagggacnccgaccctccggagacgccacgaccggg

SEQ ID NO: 115356 - DNA, 589 bp, Homo sapiens
  misc_feature: GYAE6OF01BZN19.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtggggggtccctgagactctcctgtgcagcctctggattcaactttggtagcttattggatggactgggtccgccagtctccgagggagggctggagtgggtgccaacagtacgagggaggtggtaggtaacgaaaaactgtgtggactcgtggtggccggggccgtattccgacctatcctaccagaagaaccaacgacccaaaaactccaactagtactctagacaaagtcggacgctagacgacgtccgaaggaccgacggccgttgtagttattagttggtagacgtaggtagtagtttagaacgttaacgtaaaggtttacgagttacgtacgttagttacgtgtagttcg

SEQ ID NO: 115357 - DNA, 528 bp, Homo sapiens
  misc_feature: GYAE6OF01A8MQT.37.34.D01.1.454.CMB.1.raw
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (497)..(497): a, c, t, g, unknown or other
  misc_feature (497)..(497): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccncagtctccgagggagggctgggagtgggtggccaacatacgagggaggtggtaggtaacgaaaaacgtntggtggactcgtggtggcggggccgtattcaccatctccagagacaacgaccaaaactcactagtactctagacaaagtggacgctgagataccgaggacacggctgtagtatatgtgcgagagtnttagactagaagttgagtgactggtatgatg

SEQ ID NO: 115358 - DNA, 540 bp, Homo sapiens
  misc_feature: GYAE6OF01BVHNC.37.34.D01.1.454.CMB.1.raw
  modified_base (523)..(523): a, c, t, g, unknown or other
  misc_feature (523)..(523): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtacctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaatggacggcctgagatccgaggacacggctgtgtattattgtgcgagagatttagactataagttcgagtgactggtatgatgcttatgataccgtggggccaagggaccagtggtcaccgtctcttcagcctccaccgacggcccagtccggtccttccccgtggccgccctgcctcccaggacgccaccnccgagacgccacgacgg

SEQ ID NO: 115359 - DNA, 297 bp, Homo sapiens
  misc_feature: GYAE6OF01AJC9J.37.34.D01.1.454.CMB.1.raw
  modified_base (293)..(297): a, c, t, g, unknown or other
  misc_feature (293)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctcgagagcacagcggccctgggctgcctggtcaaggctacttccatctacactactgagcgggctggcaaggcgcatagnnnnn

SEQ ID NO: 115360 - DNA, 550 bp, Homo sapiens
  misc_feature: GYAE6OF01BBZTN.37.34.D01.1.454.CMB.1.raw
  modified_base (393)..(393): a, c, t, g, unknown or other
  misc_feature (393)..(393): n is a, c, g, or t
  modified_base (529)..(529): a, c, t, g, unknown or other
  misc_feature (529)..(529): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccaggggaaggggctggagtgggtggccaacatacaggggaggtggtggtacgaaaaactatgtggactctgtgcggggcgattcaccatctccagagacaacgccaaaaactcactgtatctgcaaatggacggcctgagatccgaggacacggctgtgtattattgtgcgagagtatttagactanaaagtttcgagtgactggtatgatgcttatgataccgtggggaccaagggaccagtcggtcacgtctctcacgtcctccaccgaagggccccagtccggtccttcccccgtggcccgtcccgtgcctccgaggacnccacctccgagcgcacgacgg

SEQ ID NO: 115361 - DNA, 300 bp, Homo sapiens
  misc_feature: GYAE6OF01BFX8Y.37.34.D01.1.454.CMB.1.raw
  modified_base (296)..(300): a, c, t, g, unknown or other
  misc_feature (296)..(300): n is a, c, g, or t
tcagtagtgtagatcacgaccggtgctcgatttagatcgtctgtgttgggtttgggggaagaggaagactgacggtcctgccacaggtggtgctgagaaagagatggaggtggacgtgtcagcacccagctggggcctgtccctggtcaccgtctcctcagcctccaccaagggcccatcggtcttcccctggcgccctgctccaggagcacctccgagagcacagccggccctgggctgcctggtcaaggactacttccatctacactactgagcgggctggcaaggcgcatagnnnnn

SEQ ID NO: 115362 - DNA, 488 bp, Homo sapiens
  misc_feature: GYAE6OF01A3BQY.37.34.D01.1.454.CMB.1.raw
  modified_base (430)..(430): a, c, t, g, unknown or other
  misc_feature (430)..(430): n is a, c, g, or t
  modified_base (470)..(470): a, c, t, g, unknown or other
  misc_feature (470)..(470): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctcactttggaaagcggggtccatcaaggttcagcggcagtgtatctggacagaattcactctcaccatcagtagcctgcagcctgatgatttgctaattattactgtcagcaactataatggganagttcggccgagggaccagggttgaagagtacaagactgnggctgcacatctgtcttc

SEQ ID NO: 115363 - DNA, 550 bp, Homo sapiens
  misc_feature: GYAE6OF01D7OMD.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgcagtctccagggaaggggctggagtgggtggccaacatacagggaggtggtggtaacgaaaaactatgtggactctgtgcggggccgattcaccatctccagagacaacgaccaaaaaactcactgtatctgacaaatggacggcctgagatccgaggacacggctgtgtattattgtgcgagagatttagactaacaaagtttcgagtgacgtggtatgatgcttatgataccgtgggccaagggaccagtggtcacgtctcttcacgcctccaccgaacgggcccagtccggtccttcccccgtggcccgcccctgcctccgaggacgccaccctcgagacgcacgacgg

SEQ ID NO: 115364 - DNA, 297 bp, Homo sapiens
  misc_feature: GYAE6OF01CS91B.37.34.D01.1.454.CMB.1.raw
  modified_base (295)..(297): a, c, t, g, unknown or other
  misc_feature (295)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnn

SEQ ID NO: 115365 - DNA, 296 bp, Homo sapiens
  misc_feature: GYAE6OF01AQCEJ.37.34.D01.1.454.CMB.1.raw
  modified_base (294)..(296): a, c, t, g, unknown or other
  misc_feature (294)..(296): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctgggcctgtccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnn

SEQ ID NO: 115366 - DNA, 547 bp, Homo sapiens
  misc_feature: GYAE6OF01ENNAI.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtcctccatcctccctgtctgcatctgtaggagacagagtcatcatcacttggccgggcaagtcgaggcattagaaatgatttaggctggtatcagcaagaaaccgagggaaacgcccctaagcctcctcatctatggtgcatcctagttacaacgtcgggtaccagttaagattcgagcggcagtggatcgtggacacagtacttcactctcacatcagcacgctgacacgtcctagaattatttgactaactttattactgtactaactaagtaacttaactaacttacccgtacgttaccgttacgaaccggtaacgggaaccgtaagggtacggaaacgtacgaaacgtacgtacggtacggctcgcctaaccg

SEQ ID NO: 115367 - DNA, 537 bp, Homo sapiens
  misc_feature: GYAE6OF01BVN98.37.34.D01.1.454.CMB.1.raw
  modified_base (337)..(337): a, c, t, g, unknown or other
  misc_feature (337)..(337): n is a, c, g, or t
  modified_base (493)..(493): a, c, t, g, unknown or other
  misc_feature (493)..(493): n is a, c, g, or t
  modified_base (533)..(533): a, c, t, g, unknown or other
  misc_feature (533)..(533): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctggttttccttgttgctattttagaggtgtccagtgtgacgtgcaactggtggagtctgggggaggcttggtccagccgtggggggtccctgagactctcctgtgcagcctctggattcaactttggtagctattggatggactgggtccgccagtctccgagggaggggctggagtgggtgccaanatacgagggaggtggtaggtaacgaaaaactgtgtggactcgtgtggcggggccgattcaccatctccgagagacaacgacccaaaactcactgtatctgacaaagtggaccggtcctgagactaccggaggacacggctgtgtattattggtcgngagagtatttagactactaagttcgagtcgactaggatgngtcg

SEQ ID NO: 115368 - DNA, 703 bp, Homo sapiens
  misc_feature: GYAE6OF01DI5KA.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggtttccttgttgctattttagaaggtgtccagtgtgacgtgcaacgtggtggagtcgtgggggaggcttggtccagccgtggggggtccctgagactctcctgtgcagcctctggattctaacgtttggtagctagttggatggacgtgggtccgccagtcctaccgagggaaggggctgggaggtgggtgccaaacgagtacgagggaggtggtagggtaaacgaaaaacgtgtggtaggactcgtggtcggccgggggaccgtagtttccaaccgtacttccgttacccgaaggtaacgaacccgaaaaccggaaccccaaaaaaaccgttccaaacgttagttaacttccgtaggaaccgaaaagttcgggaacccggtaccgttaggaacgtacgtacccggaacggtaccgtaccgggtacttaggttagttacgttaagtttggtacggtaccggtaagtaacggttacgtttaaggaaccttaaacgttaaaaggttttcggaacggttacggtaaccgttagggttaattggagttacgg

SEQ ID NO: 115369 - DNA, 298 bp, Homo sapiens
  misc_feature: GYAE6OF01D7RJ9.37.34.D01.1.454.CMB.1.raw
  modified_base (295)..(298): a, c, t, g, unknown or other
  misc_feature (295)..(298): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaaggcccatcggtcttcccctggcgccctgctccaggagcacctccgagagcacagccggccctgggctgcctggtcaaggactacttccatctacactactgagcgggctggcaaggcgcatagnnnn

SEQ ID NO: 115370 - DNA, 670 bp, Homo sapiens
  misc_feature: GYAE6OF01BVBER.37.34.D01.1.454.CMB.1.raw
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttgccggnaagtcaggcatagaatgattaggctggtatcagcagaaaccgagggaacgccctaagctactcatctagtgtnctatcctagtttacaacgtcgggtaccctattaacgacttacgacgtcggtacaggtggtactcgttacgggacctaacgtacggttactttaccaaccgttccgtacctaacctacgttaccgacgtaccgtacgtcccgtacggtaccgacgtacccgtaggtaacgttacttttacggtaccttaacgtttaactttaccgttacgttaccttaacgtaaacgttaacttaaccgttaacctttaaccccggttacgttaaccggtttaccgggaacccgtaaacggggtaacccgtaaaggggttccggtaaacgttaaccgtaaaaccggtaacgttcggttaacggtaccgttcggaccgtaacccg

SEQ ID NO: 115371 - DNA, 298 bp, Homo sapiens; identical to SEQ ID NO: 115339
  misc_feature: GYAE6OF01ASUDH.37.34.D01.1.454.CMB.1.raw
  modified_base (296)..(298): a, c, t, g, unknown or other
  misc_feature (296)..(298): n is a, c, g, or t

SEQ ID NO: 115372 - DNA, 300 bp, Homo sapiens
  misc_feature: GYAE6OF01D5Y7T.37.34.D01.1.454.CMB.1.raw
  modified_base (297)..(300): a, c, t, g, unknown or other
  misc_feature (297)..(300): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaaggcccatcggtccttccccctggcgccctgctccaggagcacctccgagagcacagccggccctgggctgcctggtcaaggactacttccatctacactactgagcgggctggcaaggcgcatagnnnn

SEQ ID NO: 115373 - DNA, 297 bp, Homo sapiens
  misc_feature: GYAE6OF01EJ1YN.37.34.D01.1.454.CMB.1.raw
  modified_base (295)..(297): a, c, t, g, unknown or other
  misc_feature (295)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagccggccctgggctgcctggtcaaggctacttccatctacactactgagcgggctggcaaggcgcatagnnn

SEQ ID NO: 115374 - DNA, 301 bp, Homo sapiens
  misc_feature: GYAE6OF01DVRAY.37.34.D01.1.454.CMB.1.raw
  modified_base (296)..(301): a, c, t, g, unknown or other
  misc_feature (296)..(301): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggccgcccttctccaggagcacctccgagagcacagcggccctgggctgcctggtcaaggactacttcatctacactactgagcgggctggcaaggcgcatagnnnnnn

SEQ ID NO: 115375 - DNA, 535 bp, Homo sapiens
  misc_feature: GYAE6OF01CTBMG.37.34.D01.1.454.CMB.1.raw
  modified_base (373)..(373): a, c, t, g, unknown or other
  misc_feature (373)..(373): n is a, c, g, or t
  modified_base (533)..(533): a, c, t, g, unknown or other
  misc_feature (533)..(533): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgagggaaggggctgggagtgggtggccaacatacgagggaggtggtaggtaacgaaaaactntgtggactctgtgcggggccattcaccatctccagagaacaacgacccaaaactcactgtatctgacaaatggacgcctagacgataccgaggacacggcttgtgtattattgtagcgagagtattagaactacgtaaagtttgagttagactggtatgntg

SEQ ID NO: 115376 - DNA, 336 bp, Homo sapiens
  misc_feature: GYAE6OF01EBR9J.37.34.D01.1.454.CMB.1.raw
  modified_base (327)..(336): a, c, t, g, unknown or other
  misc_feature (327)..(336): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagccctccaccaacgggcccatccggtccttccccctggccgccctgcctccgaggacgccaccctccggagacgcacgagccggccctgggcctcgcctggtacaaggtaccttaccttccattcctaacacttacgtgaggccgggctgggacaaggcgcatagnnnnnnnnnn

SEQ ID NO: 115377 - DNA, 518 bp, Homo sapiens
  misc_feature: GYAE6OF01A0YSY.37.34.D01.1.454.CMB.1.raw
  modified_base (369)..(369): a, c, t, g, unknown or other
  misc_feature (369)..(369): n is a, c, g, or t
  modified_base (516)..(516): a, c, t, g, unknown or other
  misc_feature (516)..(516): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggagggctggagtgggtggccaacatacgagggaggtggtggtaacgaaaactntgtggactctgtgcggggccattcaccatctcagagacaacgccaaaactcactgtatctgcaatggacggcctgagactccggaggacacggctgtgtattattgtgcgagagtatttagactacaagttcgagtgactggtatgntg

SEQ ID NO: 115378 - DNA, 522 bp, Homo sapiens
  misc_feature: GYAE6OF01DBGNR.37.34.D01.1.454.CMB.1.raw
  modified_base (519)..(519): a, c, t, g, unknown or other
  misc_feature (519)..(519): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtctgggggaggcttggtccagcctgggggggtccctgagactctcctgtgcagcctctggattcaactttggtagctattggatggactgggtccgccagtctccagggaaggggctggagtgggtggccaacatacagggaggtggtggtaacgaaaaactatgtggactcgtgtgcggggccgattcaccatctccagagacaacgaccaaaaactcactgtatctgcaaatggacggctgagatccgaggacacggctgtgtattatgtgcgagagatttagactaacaaagttcgagtgactggtatgntag

SEQ ID NO: 115379 - DNA, 298 bp, Homo sapiens
  misc_feature: GYAE6OF01CW9CR.37.34.D01.1.454.CMB.1.raw
  modified_base (295)..(298): a, c, t, g, unknown or other
  misc_feature (295)..(298): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnn

SEQ ID NO: 115380 - DNA, 578 bp, Homo sapiens
  misc_feature: GYAE6OF01CSL4R.37.34.D01.1.454.CMB.1.raw
  modified_base (528)..(528): a, c, t, g, unknown or other
  misc_feature (528)..(528): n is a, c, g, or t
  modified_base (571)..(571): a, c, t, g, unknown or other
  misc_feature (571)..(571): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgctattttagaaggtgtccagtgtgacgtgcaacgtggtggagtcgtgggggaggcttggtccaggccgtggggggtccctgagactctcctgtgcagcctcgtggacttctaacgtttggtagcttagttggatggacctcggggtcccgccagtcctccggaaggggaaggggctgggaggtggggtcggacccaacgagtaacggaggggtaggtggtaggtaaacgaaaaactgtggtagactgtgtggccggggctattccactatctaccagacgaccaacgaacccaaaacgtcaactgtactctagacaaagtcggacgctgagacgtacgagacgcgcttgtatattatgngacgagagtattagactaagtaagttgagtaggacttaggtangtgtacg

SEQ ID NO: 115381 - DNA, 553 bp, Homo sapiens
  misc_feature: GYAE6OF01E35GE.37.34.D01.1.454.CMB.1.raw
  modified_base (405)..(405): a, c, t, g, unknown or other
  misc_feature (405)..(405): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcaagaaaccagggaaacgcccctaagctcctcatctatggtgcatccagttacaaacgtcgggtacccattaagattcagcgcaggtggatcgtggcacagtatttcactctcacatcagcagcctgcacgtcctagaagtnttttgactaaactttatactgtactaacgtaagtacttaactaacttaccctcggttaccggttccggaaccgtaaacggggaaccgtaagggtacggtaaacgttaacgaaaaccgtacgttacggtaggtacctcgaccctaaccg

SEQ ID NO: 115382 - DNA, 529 bp, Homo sapiens
  misc_feature: GYAE6OF01D3MT1.37.34.D01.1.454.CMB.1.raw
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (410)..(410): a, c, t, g, unknown or other
  misc_feature (410)..(410): n is a, c, g, or t
tcagtagtgtagatcacgaccggtgctcgatttagatcgtctgtgttgggtttgggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtggggggtccctgagactctcctgtgcagcctctggattcaactttggtagctatggatggactgggtccncagtctccgagggagggctgggagtgggtgccaanagtacgagggaggtggtaggtaacgaaaaactgtggtggactcgtggtggcggggcattccacatctcaganacaacgaccaaaactcactgtatctgacaaagtggacggctgagacgtacgaggacgacggctgtagtattagtgtgcgtagagtattagacttaagaagttgagtgactggtatgatg

SEQ ID NO: 115383 - DNA, 603 bp, Homo sapiens
  misc_feature: GYAE6OF01BJSSU.37.34.D01.1.454.CMB.1.raw
  modified_base (392)..(392): a, c, t, g, unknown or other
  misc_feature (392)..(392): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatcgtgtaggagacagagtcatcatcacttgccgggcaagtcgaggcattagaatgattaggctggtatcagacaagaaacgagggaaacgcccctaagcctcctcatctatggtgcatccaagtttaacaacgtgggtaccctattaagtattcagcggacagtgatcgtgcacagtacttcactctacaccatcagcacncctgccagtcctagtaacgttattttacgaacttaactttattaaccgttgttacctaactaaagtaactttaacctaaccgtttaccccgttaggttacccggttaccgggtaacccgtaaacgggaacccggtaaaggggttacggtaaaaccgtaaccgtaaaaaccggtacgttacgggtacggtaccgttggacccttaaacccgg

SEQ ID NO: 115384 - DNA, 307 bp, Homo sapiens
  misc_feature: GYAE6OF01AHSU5.37.34.D01.1.454.CMB.1.raw
  modified_base (293)..(293): a, c, t, g, unknown or other
  misc_feature (293)..(293): n is a, c, g, or t
  modified_base (298)..(307): a, c, t, g, unknown or other
  misc_feature (298)..(307): n is a, c, g, or t
tcagtagtgtagatcacgaccggtgctcgatttagatcgtctgtggttgggtttggggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagccggccctgggctgcctggtcaaggactacttccatctacactactgagcggctggcaaggcgnatagnnnnnnnnnn

SEQ ID NO: 115385 - DNA, 552 bp, Homo sapiens
  misc_feature: GYAE6OF01BYGNV.37.34.D01.1.454.CMB.1.raw
  modified_base (548)..(548): a, c, t, g, unknown or other
  misc_feature (548)..(548): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgtggtttctgttagctatttagaaggtgttcagtgtgacgtgcaactggtggagtcgtgggggaggcttggtccagccgtggggggtccctgagactctcctgtgcagcctctggattcaactttggtagctattggatggactgggtccgccagtctccgagggaagggctggagtgggtggcctaacatacgagggagtggtaggtaacgaaaaactgtgtaggactcgtagtcggacggggccgtattcgaccactctacagacgacaacgacaaaactcactgtatactgacaaatggaacgcgtagagagtaccggaggacgacgggcttagtgtattagttgtggacgtagagtactttaagacttaataagttgagtcgacgttggtctgntacg

SEQ ID NO: 115386 - DNA, 579 bp, Homo sapiens
  misc_feature: GYAE6OF01EL6J5.37.34.D01.1.454.CMB.1.raw
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggnaagtcaaggcattagaaatgatttaggctggtatcagcaagaaaccgagggaaacgccctaagcctcctcatctatggtncatcctaagtttacaaacgtcgggtaccaagttaanattcagcggcagtggatcgnggcacagtatttacactctacaccatacagcacgcctgacagccgtagaagttattttacgacttaaactttattactagtacctaactaagtaacttaacctaactttaccccgtacgttaccggttaccggaaccgtaaacggggtaacccgtaagggtacggaaacggtaaccgaaaacggtacgttacggtagggaccttaggacctaacccg

SEQ ID NO: 115387 - DNA, 606 bp, Homo sapiens
  misc_feature: GYAE6OF01B1GRN.37.34.D01.1.454.CMB.1.raw
  modified_base (377)..(377): a, c, t, g, unknown or other
  misc_feature (377)..(377): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgacgctctcctgtgcagcctctggattcaactttggtagctattggatggactgggtccgccagtctccgagggagggctgggagtgggtgccaacagtacgaggggaggtggtaggtaacgaaaaacgtntggtaggactcgtgtggcggggccattccaccatcctccagagaacaaccgaccaaaaactcaactgtatcgtagacaaagtgggaccgtcctgaagtacgtaccggaggaccgtacgggcttaggtacgttagtttagttggtcgacggaaggtaagttaagtttaaggaacttaacgtaaaaggtttcgtaaggttagtaacgttagggttacgttagtagttacgg

SEQ ID NO: 115388 - DNA, 559 bp, Homo sapiens
  misc_feature: GYAE6OF01D0NN5.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaacttttggtagctattggatggacgtgggtccgccagtctccgagggagggctggagtgggtggccaacagtacgaggggaggtggtaggtaaacgaaaaactgtggtaggactcgtggtggcgggggccgtatttccacctatcctaccgagagacaaccgacccaaaaactcactgtatctgacaagtggacgctgagagtccgaggaccgacggtctgtagtattagttgtgacgagtagtatttagactaacgtaaagttcgaagtgaacgtggtatgtgtcg

SEQ ID NO: 115389 - DNA, 519 bp, Homo sapiens
  misc_feature: GYAE6OF01ELKXG.37.34.D01.1.454.CMB.1.raw
  modified_base (214)..(214): a, c, t, g, unknown or other
  misc_feature (214)..(214): n is a, c, g, or t
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcancacttgccgggcaagtcagggcattagaaatgatttaggctggtatcagcagaaaccagggaaagcccctaagctcctcatctatggtgctacntaccaagtttacgtaaacctggggtacccgattaagattcgagcggcgagtggatctggacactagatttcacnctcaccatcagacagcctgcacgaccgtagtaagtatttacgctaacttattactagtactaactaagtattaacattacccttcgtacgtacggccaaagggacgaaggtgaaagtacaaacgtacagtggctgac

SEQ ID NO: 115390 - DNA, 531 bp, Homo sapiens
  misc_feature: GYAE6OF01ECPC2.37.34.D01.1.454.CMB.1.raw
  modified_base (529)..(529): a, c, t, g, unknown or other
  misc_feature (529)..(529): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttcctcgttgctcttttaagaggtgtccagtgtcaggtgcacctggtggagtcgtgggggaggcttggtccagccgtggggggtccctgagactctcctgtgcagcctctggattcaactttggtagctattggatggactgggtccgccagtctccgaggggaaggggctgggagtggggtggccaacagtacgaggggaggtggtaggtaacgaaaaactgtgtggactcgtggtggcggggcattcaccatctcagagacaacgaccaaaactcactgtatctgacaagtggacggctgagactccgaggacacggctgtgtattatgtgcgagagtatttagactactaagttcgagtgactggtatgntg

SEQ ID NO: 115391 - DNA, 568 bp, Homo sapiens
  misc_feature: GYAE6OF01BWDJQ.37.34.D01.1.454.CMB.1.raw
  modified_base (563)..(563): a, c, t, g, unknown or other
  misc_feature (563)..(563): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattgggctgagctggtttcctgttgctatttagaggtgtccagtgtgacgtgcaactggtggagtcgtgggggagcttggtccgaggccgtggggggtccctggacgacgtcgtccgtgtgccagcctctggatttccaaactttgggtagtcttattggattggactgggtccacgagtctccgagggaagggctgggagtgggtggaccgaacgagtacgagggaggtggtaggtaacgaaaactgtgtggactcgtggtgcggggctagttcaccatctccgagacgacgaacgaccaaaactcactgtactctagactaagtcggacgctagacgtacgtaccgaggacgacgtactgtagtattagtgtacgtcgagtacgtatttagacttacgaagtttcgagtgactggtatggtntacgg

SEQ ID NO: 115392 - DNA, 658 bp, Homo sapiens
  misc_feature: GYAE6OF01D61LJ.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgaggggaaggggctggagtgggtggccaacatacgagggaggtggtaggtaacgaaaaactatgtggactctgtggcggggccgattcaccatctccagagacaacgaccaaaaactcactgtatctgacaaagtggacgcctgagacgtccggaggacacggctgtgtattattgtgcgagagtatttagactaataagttcgagtgacttggtatgtattgacttagtagtaacgttacccggtgggggaacccgaaacggggaccctaaggttccgggtacctacccgttcttaccttaccgacgtaccccttacccgaaccgaaccgggtacccctaacgttcccgggttacccctttccccccggtagggtccccgtccccgtggtacccgtcccggaacgggaccgaccccgtacccgtcccggaaggaccgcgaccgacccggg

SEQ ID NO: 115393 - DNA, 595 bp, Homo sapiens
  misc_feature: GYAE6OF01DVELZ.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttcctgttgctattttggaaggtgtccagtgtgaggtgcaattggtggagtcgtgggggaggcctcgtccagccgtggggggtccctgagactctcctgtgtagcctctgaactttcccctttacggcttagttggatgagcgtgggtccgcaggctccgaggggaggggctgggaggtgggtcgaccaacgataaagcaagagtaggaagtaagaaggagtagtggtggactcgtgtggaacgggtccgttcgcctatctacgagacgaaccacgaccaaagacctcgtgactatctgacaaatcgaactagtctagaagcgaccgaggacctacggtacttaagtttactacgtggcgtacgaaggaaggaacggtcgtgggggtccgttacgacgtacggtcggggaccgtagggaacccctgggtccctaccccg

SEQ ID NO: 115394 - DNA, 299 bp, Homo sapiens
  misc_feature: GYAE6OF01A6WJY.37.34.D01.1.454.CMB.1.raw
  modified_base (294)..(299): a, c, t, g, unknown or other
  misc_feature (294)..(299): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactactccatctacactactgagcgggctggcaaggcgcatagnnnnnn

SEQ ID NO: 115395 - DNA, 698 bp, Homo sapiens
  misc_feature: GYAE6OF01A06VK.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggagtttgggctgagcgtgcttttctagtggctatttaaaggtgtccagtgtgaggtgcagctgctggagtctgggggaggcttggtacaggccgggggggtccctgagactctcctgtgaagcctctggattcacctttgacaagtgtagccatgacctgggtccgcaggctccgagggagggctggagtgggtctcgtagttagttagtggtagtggtacgtagacacagtacttacgcacggaccttccggtaggaacggggtcccggtttacaacccgtaacgttcccgttacccgaaggaaccgtaaaccctaaacgtttaccccgaaaaccgtacgtaccctaaccggtcgtttacgtttaacgttttcggaacctaacctaagttaacggaaaccgaacggtcccgttaagggaacggtacgggaccccggaaggggaacccgaaccgggaccctaagttacttagttaacgtttcggtacgtaaccgttaaaccttttccgttttagtaccggtttaggttttaactttacctccccgttaaggttcgaaccccgg

SEQ ID NO: 115396 - DNA, 644 bp, Homo sapiens
  misc_feature: GYAE6OF01DXPBT.37.34.D01.1.454.CMB.1.raw
  modified_base (310)..(310): a, c, t, g, unknown or other
  misc_feature (310)..(310): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagtgtgacgtgcaactggtggagtcgtgggggagcttggtccaggccgtggggggtcccctggacgacctctcctgtgcagcctctggattcaactttggtagctaattggatggactgggtccnccagtctccgagggaagggctgggagtgggtggccaacagtacgaggggaggtggtaggtaacgaaaaactgtggtggactcgtggtcggcggggccgattccaccactctccgagacgaaccaaacgaacccaaaaactctaactagtacttcgtagacaaacgttcgggaaccggtccgtaggacgtaacgtcccggaacggtaaccgaccgggtctacggttgttaatttagttgggttaggaccggtaaggtacggttaactttaaggtaaccttaacggtaaaacggtttcggaaagttggtaaccggttaggttaactgtaagttacg

SEQ ID NO: 115397 - DNA, 548 bp, Homo sapiens
  misc_feature: GYAE6OF01D9O3M.37.34.D01.1.454.CMB.1.raw
  modified_base (427)..(427): a, c, t, g, unknown or other
  misc_feature (427)..(427): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttggccggcaagtcaggcattaagaaatgatttaggctggtatcagcaagaaaccgagggaaacgcccctaagcctcctcatctatgtgcatcctaagtttacaacgtcgggtaccctaattaagtattcgagcggctaggtggtactcgtcggacacgtagtactttcaccttcctacacctatcagcacgcctgcacgctagtaagtntttcgacttaacttattactgttactactaagtattacctaacttacccgttcgtacgttaccgaccgtaacgggtacctaaggtcgaacgtacaaacgtacgtacgtaggctgcctaccg

SEQ ID NO: 115398 - DNA, 666 bp, Homo sapiens
  misc_feature: GYAE6OF01AEY4N.37.34.D01.1.454.CMB.1.raw
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatcgacccagtctccatcctccctgtctgcatctgtagganacagagtcatcatcacttcggccgggacaagtcgagggctaagttagaaatgtatttaggctggtatcagacaacgaaaccgaagggaacgacccctaagcctcctctatctagtggtcnctactacctaagttaacgaacgtcgggtacctattaagtacttacgaggcggactaggtgtactcgtcggactacgtagtacttctacttcctacacctataccgacgccgtacgccgttagacctacggtacctaggtaacgtttacttttacgtaacttaactttaacgtttacttacgttaacttaacgtaacgttaacctttaaccgttaaaccgtttacccgttaccggttaaacccggttaccgggtaaccggtaaaccggggtaacccgtaagggttaacggtaaacgtaaccgtaaaccgtaacggttcggtacggtacgttacgccgttaacccg

SEQ ID NO: 115399 - DNA, 301 bp, Homo sapiens
  misc_feature: GYAE6OF01AXR00.37.34.D01.1.454.CMB.1.raw
  modified_base (295)..(301): a, c, t, g, unknown or other
  misc_feature (295)..(301): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnnn

SEQ ID NO: 115400 - DNA, 529 bp, Homo sapiens
  misc_feature: GYAE6OF01DRF1L.37.34.D01.1.454.CMB.1.raw
  modified_base (375)..(375): a, c, t, g, unknown or other
  misc_feature (375)..(375): n is a, c, g, or t
  modified_base (471)..(471): a, c, t, g, unknown or other
  misc_feature (471)..(471): n is a, c, g, or t
  modified_base (489)..(489): a, c, t, g, unknown or other
  misc_feature (489)..(489): n is a, c, g, or t
  modified_base (527)..(527): a, c, t, g, unknown or other
  misc_feature (527)..(527): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctatttagaaggtgtccagtgtgacgtgcaactggtggagtcgtggggggagcttggtccagccgtggggggtccctgagactctcctgtgcagcctctggattcaaacttttggtagctattggatggactgggtccgccagtctccgaggggagggctgggagtgggtggccaacatacgagggaggtggtaggtaacgaaaaactntggtggactctgtcgcggggcattcaccatctccagagacaacgacccaaaaactcaactgtatctgacaaatcggacggctgagatccgaggacncggctgtgtattatgtgngagagtattagactataaagttcgagtgactggtatgntg

SEQ ID NO: 115401 - DNA, 527 bp, Homo sapiens
  misc_feature: GYAE6OF01BNKT4.37.34.D01.1.454.CMB.1.raw
  modified_base (281)..(281): a, c, t, g, unknown or other
  misc_feature (281)..(281): n is a, c, g, or t
  modified_base (523)..(523): a, c, t, g, unknown or other
  misc_feature (523)..(523): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtanctattggatggactgggtccgccagtctccgaggggaagggctgggagtgggtggccaacatacgagggaggtggtggtaacgaaaaactgtgtggactctgtgcggggccattcacatctccagagacaacgaccaaaactcactgtatctgacaagtggacgctgagataccgaggacgacggctgtgtattagttgtgcgagagtattagactacgtaagttcgagtgacgtggtatgngtcg

SEQ ID NO: 115402 - DNA, 527 bp, Homo sapiens
  misc_feature: GYAE6OF01CIN4J.37.34.D01.1.454.CMB.1.raw
  modified_base (106)..(106): a, c, t, g, unknown or other
  misc_feature (106)..(106): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
tcagtagtgtagatcacgaccggtgctcgatttagatcgtctgtgttgggtttgggggcaggagtcagacccactcaggacacagcatggacatgagggtccccgntcagctcctggggctcctgctgctctggctcccaggtgccagatgtgccatccaaatgacccagtctccatcctcctgtctgcatctgtaggagacagagtcatcatcacttgccgggcaagtcaggcattagaaatgatttaggctggtatcagcagaaaccagggaaacgccctaagctcctcatctatgtgcatccagttacaaactgggtaccattaagatcagcgcagtgatntggcacgagagtttcactctcaacatcagcngcctgcagcctagacgtattttagctaacttattcttagtactacaacgtattactaacttacccgttcgtacggttaccggacgtaaacggggcccaaagggttggaaacgttacgaaaaccgaacttaggtacgggtctgtctaaacccg

SEQ ID NO: 115403 - DNA, 902 bp, Homo sapiens
  misc_feature: GYAE6OF01EATZ4.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctcgtggtatttctaacgttttggtagtcttagttggagttgggtacgttcggggtccccgccgtacggttccgtacccggaggggggaacgggggtcgtgggggagggttgggggtacggacccgaaacgtaagtaaccggaaggggggtaacggggttagggttaacggggttaaaaccggtaaaaaaaacgttacggttacgggttacgggtaaccgtttccggttaggggttacggggacccgggggggtacccggtaacgttttacccgaacccgttaacgttacccgttacccgtaaacgggaaaccggtaaaacccgaaaaaccccggaaaccccgtaaaaaaaacccgttccctaaacccgtttacggtttaacctttaccgttacggtaaaccgtaaaacggttacggggaacccgggtacccgttacgggaacggtaaccgtacccggggaacgggtaacccggtaaccgggtaccgttagggtttacgttaacgttttacgtttaggtacgggtaccggtaaggttaacggttaacgtttttaaacggtaaccgtttaaaccgttaaaacgggttttaccggtaaagggttacggtaaccggtttagggtttaagttaggtagttacgg

SEQ ID NO: 115404 - DNA, 551 bp, Homo sapiens
  misc_feature: GYAE6OF01EO17Q.37.34.D01.1.454.CMB.1.raw
  modified_base (305)..(305): a, c, t, g, unknown or other
  misc_feature (305)..(305): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggtagctattggatggactgggtccnccagtctccgagggagggctgggagtgggtggccaacgatacgaggggaggtggtaggtaacgaaaaactgtggtggactcgtggtggcggggccattcaccatctccagagacaacgaccaaaaactcactagtactctagacaaagtcggacggcctgagactacggaggacgacggctgtgtattagttgtgcgagtagtatttaagactaacgtaaagtttcgaagtgactaggtatgatcg

SEQ ID NO: 115405 - DNA, 552 bp, Homo sapiens
  misc_feature: GYAE6OF01DXZVZ.37.34.D01.1.454.CMB.1.raw
  modified_base (342)..(342): a, c, t, g, unknown or other
  misc_feature (342)..(342): n is a, c, g, or t
  modified_base (548)..(548): a, c, t, g, unknown or other
  misc_feature (548)..(548): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgacgactctcctgtgcagcctctggattcaactttggtagctattggatggactgggtccgcagtctccgagggagggctgggagtgggtgccaanatacgagggaggtggtaggtaaacgaaaaactgtggtggaacttcgtaggtggcggggcctagttccaccatctccagacgaacaacgacccaaaactcactatactctagacaaagtggacggctgagactaccggaggacgacggtctgtgtattagtgtgcgagagtatttagacttaacaagtttcgagtgactaggtatgnttcg

SEQ ID NO: 115406 - DNA, 413 bp, Homo sapiens
  misc_feature: GYAE6OF01DRHAG.37.34.D01.1.454.CMB.1.raw
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (356)..(413): a, c, t, g, unknown or other
  misc_feature (356)..(413): n is a, c, g, or t
tcagtagtgtagatcacgaccggtgctcgatttagatcgtctgtgttgggtttggggggaaggaggaagacttgacggtcctgccacagggtggtgctgaggaagagaataggaggtggacgtgtcagtccacccagctgggggcctggtccctggtccaccgtctcctcacgccctccaccgaacgggcccatccggtccttccccccgtgggcccgccccgtgcctccgagggacgccacccgtccggagacgccaccgacgccggccctgggctcgccgtggtacgaacggtacctaccttccatcctaacactacgtgacgcgggctggcaagggccncaatacgnagntgnnnnnnnnnnnnnnnnnnnnnnnnnnnnnnnnnnnnnnnnnnnnnnnnnnnnnnnnnn

SEQ ID NO: 115407 - DNA, 702 bp, Homo sapiens
  misc_feature: GYAE6OF01EGCI8.37.34.D01.1.454.CMB.1.raw
  modified_base (398)..(398): a, c, t, g, unknown or other
  misc_feature (398)..(398): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacgagggaggtggtggtaacgaaaaactatgtggactctgtgcggggccgattcaccatctccagagacaacgaccaaaaactcactgtatctgacaaagtggacgcctgagatccgaggacacggctgtgtattagttgtgcgagagtatttagactaanaagtttcgagtgactggtatgatgtacttagtgtaacgttaccggtacgggggtacccaaaggggaccctaaggttccgggttaccgtaacccgtttccttacccgtttaccgaccggtccccttaccccgaacccggtaaaccggggcccccctaacggttccccgggttaccccctttcccccccggtacggggcccccgtcccccggttcggacccccgtttaccccggaacggggtacccgaccccgtaaccccggttaccccgggaaaggtacccggacccgaacccggtacccggggg

SEQ ID NO: 115408 - DNA, 628 bp, Homo sapiens
  misc_feature: GYAE6OF01B2OBL.37.34.D01.1.454.CMB.1.raw
  modified_base (268)..(268): a, c, t, g, unknown or other
  misc_feature (268)..(268): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgagggaaggggctggagtggggtgccaacatacgaggggaggtggtggtaacgaaaaactntggtggactctgtgcggggccgattcaccatctccagagacaacgaccaaaaactcactgtatctgacaaagtggacgcctagagacgtccgaggacacggctgtgtattattgtgcgagagtatttagactaacgtaagtttcgagtgacgtaggtatagatgtactttatagtacgttaccggtggggaccgtaacgggtacctagttcggtacctaccgttccttccgttacacgtccctaccgaaccgtaaccgggccctacggttcccggttacccgttcccccgtgggtacccgtccccgtgccctcccgacgggaccgacccgtacccgtaccgaacggacgcaccgaccggg

SEQ ID NO: 115409 - DNA, 301 bp, Homo sapiens
  misc_feature: GYAE6OF01CZ92B.37.34.D01.1.454.CMB.1.raw
  modified_base (297)..(301): a, c, t, g, unknown or other
  misc_feature (297)..(301): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctcctccaagagcacctctgggggcacagtggccctgggctgcctggtcaaggactacttccatctacactactgagcgggctggcaaggcgcatagnnnnn

SEQ ID NO: 115410 - DNA, 585 bp, Homo sapiens
  misc_feature: GYAE6OF01BEPRK.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtggggggtccctgagactctcctgtgcagcctctggattcaacttttggtagctattggatggactgggtccgccagtctccgagggagggctggagtgggtgccaacgatacgagggaggtggtaggtaaacgaaaaactgtgtaggactcgtggtggccggggccgattccgacctatcctcagacgaacaacgaccaaaaactcaactgtatctgacaagtggacggctgagactcggaggacacggctgtagtattagttgtagtacgaagtgggtggggggtagggtgggggtccgttacgttccggtggttcggttttaggacgttcggtcggggtccgtacgggg

SEQ ID NO: 115411 - DNA, 527 bp, Homo sapiens
  misc_feature: GYAE6OF01AVO1Y.37.34.D01.1.454.CMB.1.raw
  modified_base (402)..(402): a, c, t, g, unknown or other
  misc_feature (402)..(402): n is a, c, g, or t
tcagtagtgtagatcacgaccggtgctcgatttagatcgtctgtgttgggtttgggggcaggagtcagacccactcaggacacagcatggacatgagggtcccccgctcagctcctggggctcctgctgctctggctcccaggtgccagatgtgccatccaaatgacccagtctccatcctccctgtctgcatctgtaggagacagagtcatcatcacttgccgggcaagtcaggcattagaaatgatttaggctggtatcagcagaaaccagggaaagcccctaagctcctcatctatggtgcatccagtttacaaactgggtcccattaagattcagcggcagtggatcgtggcacagtatttcacttctacaccatcagcagcctgcagcctagaagtnttttgactaactttattactgtctaacaagtattaacaatttaccctacgttaccgttccggaccgtaacgggacctaagggtcggtaacgtacaaacgtaacgtaggtaggctcggctaacccg

SEQ ID NO: 115412 - DNA, 301 bp, Homo sapiens
  misc_feature: GYAE6OF01D4ZLJ.37.34.D01.1.454.CMB.1.raw
  modified_base (298)..(301): a, c, t, g, unknown or other
  misc_feature (298)..(301): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgacatagnnnn

SEQ ID NO: 115413 - DNA, 411 bp, Homo sapiens
  misc_feature: GYAE6OF01D4DWD.37.34.D01.1.454.CMB.1.raw
  modified_base (376)..(411): a, c, t, g, unknown or other
  misc_feature (376)..(411): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctgggggcctgtccctggtccaccgtctcctcacgccctccaccgaagggcccatccggtccttccccctggccgccctgcctccgaggacgcacctccggagacgcacgacggccggccccgtggggcctcggtcccgtgggtaccgaaacgggtaccttaacctttcccgaattcccttaaccaaccttaccgttagggaacggcccgggggacttcggggaccaaaggggccgcaagttaggnnnnnnnnnnnnnnnnnnnnnnnnnnnnnnnnnnnn

SEQ ID NO: 115414 - DNA, 822 bp, Homo sapiens
  misc_feature: GYAE6OF01BP6VW.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttggttttccttgttgcttattttagaaggtgtccagtgtgacgtgcaacgtggtggagtcgtgggggagtcgttggtccagccggtgggggtccctgacgtactctccgtgtcgcagccctcgtggactttcaacgttttggtagtcttattggtatgggtacgttcgggtccccgcctacggtcctaccggaggggaacgggcgtggggaggtggggtacggaccaaacgtagtaacggaggggtaggttgggtaacggtaaacgtaaaaaacgttgttaggtacggtaacttcgtagggtcgggaccgggggtacccgtaagtttacccaacccgtacttacccgttacccgaaaggaaccgtaaacccgaaaacccgtaaacccctaaaaaaaccgttccgtaaacgttacgttaaccgtttacgtaaccgtaaccgtaaaagtccggggaaccggttaccgtaacgggtaacgtaacccggttacccgggaaacgggtacccgtaacccgggttaccgttaggtttaacgtttaacgtttaaggtttcggtacggtaccgggtaaaggtaagttaaacgttttaacggaaaccgtttaaacgttaaacgggttttaccggtaaaggttcggtaaccgtttagggttaacttaaggtacgtttacggg

SEQ ID NO: 115415 - DNA, 611 bp, Homo sapiens
  misc_feature: GYAE6OF01D8N47.37.34.D01.1.454.CMB.1.raw
  modified_base (225)..(225): a, c, t, g, unknown or other
  misc_feature (225)..(225): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggnaagtcaggcattagaatgtatttaggctggtactcgagacgaagaaaccgagggaaacgccctaagcctcgtgtctacgctgctatacctaagtttaggaacaggactaccatacgaaggttcaggtaggaagtggatcgtagggaccttagttaactttttacgtttcacccgtttacacggctacgcctgactacgttcgtaagaacgtactagttgaactaacgttacttactttagtacgttaaccaacgtacccgtagtaccggacccgggtacccgtacggggtaacccaaaggttgaacttaaccgtaacgaaaaccggttaaggttaggtcgggacctcggaccctaccgttatcccgtttacgttccttcttacccg

SEQ ID NO: 115416 - DNA, 714 bp, Homo sapiens
  misc_feature: GYAE6OF01BUEGI.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgcttattttagaaggtgtccagtgtgacgtgcaacgtggtggagtcgtgggggagtcttggtccaggccgtggggggtccctgacgactcgtcctgtcgcacgcctcgtggattactaacgttttggtagcttagttggagtggacgtcgggtcccgcctacggtcctaccggaaggggaacggggtctggggaggttcggggtacgacccgaaacgtagtacggaggggtagggtaggtaggtaaacgaaaaacgtgtaggtaggtaccttcgtagggtcgggccggggtacctacgttaccgaaccgtatcccgtaccgaacggtaacgaaccaaacccggtaaaccccaaaaacgttccaacgttagttactacgtacgaactaaagtcggacggtacctaggacgtaccgtaccggaacggaccgaacggtcgttaggtacgttattacggttgtacggacgtaaggtaacgttaacgtttaagaaccgttaaacgtaaacggttttgaacggttacgtacggttaggttaattggtaagttacg

SEQ ID NO: 115417 - DNA, 566 bp, Homo sapiens
  misc_feature: GYAE6OF01E0XSH.37.34.D01.1.454.CMB.1.raw
  modified_base (307)..(307): a, c, t, g, unknown or other
  misc_feature (307)..(307): n is a, c, g, or t
  modified_base (413)..(413): a, c, t, g, unknown or other
  misc_feature (413)..(413): n is a, c, g, or t
  modified_base (513)..(513): a, c, t, g, unknown or other
  misc_feature (513)..(513): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcacgcctctggattcaacttttggtagctattggatggactgggtccnccagtctccaggggaaggggctggagtggggtgccaacatacgaggggaggtggtggtaacgaaaaactgtagtggaactcgtggtggccggggccgattcgaccntctccagacgacaaccgaccaaaaactcaactgtactctagacaaacgtcggacggcctgagacgtaccggaggacgacggctgtacgtattagttgtgngtagagtagtttaagacttaacgtaaagtttcgagtcggattgggtatgatcg

SEQ ID NO: 115418 - DNA, 531 bp, Homo sapiens
  misc_feature: GYAE6OF01E4CPU.37.34.D01.1.454.CMB.1.raw
  modified_base (373)..(373): a, c, t, g, unknown or other
  misc_feature (373)..(373): n is a, c, g, or t
  modified_base (529)..(529): a, c, t, g, unknown or other
  misc_feature (529)..(529): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactggggtccgccagtctccaggggaaggggctgggagtgggtggccaacatacaggggaggtggtggtaacgaaaaactntgtggactcgtgtgcggggccgattcaccatctccagagacaacgacccaaaaactcactgtatctgcaaagtggacggcctgagataccgaggacacggctgtgtattattgtgcgagagtattagactactaaagttcgagtgactaggtatgntg

SEQ ID NO: 115419 - DNA, 517 bp, Homo sapiens
  misc_feature: GYAE6OF01EG522.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagccctaagctcctcatctatggtgcatccagtttacaaacgtgggtcccattaagattcagcggcagtggatctggcacagtatttcactcctcaacatcagtcacggcctgcagcctagaagtattttcgactaactttattacttgtactaactaagtattaactaattaccctacgttacgttacggtaccgaaagggtaccaaggtgaagtacaaacgactagtagctgctaccg

SEQ ID NO: 115420 - DNA, 819 bp, Homo sapiens
  misc_feature: GYAE6OF01E2DR2.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgagtcgttgggttttccttgttgtcttattttagaaggtgtccagtgtgacgtgcaacgtgggtggaggtcggtgggggaggtcgttcggtccgacggtccggttcgggggggtccctggacgtaccttccgtccgtggtcgccgacgtccctcgtaggtactttaccgttaagttttgggtacgtcgttaagttggagtcggtaccggtcggggtcccgaccgtacgtcccggtaccgggaagggggaacggggtcgtggggtagggtggggtaccgaaccgtaaacgtaggtaacgggaaggggtaggggtacggttaacggtaaaacgtaaaagttggtaggtacggtacgtcggtgggtcgggccgggtactacgttaccacctacgttaccgaaccggaagtaaccgaaaccaaacccgtaaaaccctaaaaccgttcgtaacgtttacgtaacgtcgtaacggaacgtaacgggtcgggtaaccgtcgtaaggtaacggtaccggtaaccgggaacggtaccggtacgggttacgttaggtttaagttaacgtttacggtaggtaggtaaacggttaaagttaacgtttaaacgtttaaaccgaaacgtttaaaggttaaccgggttaggacggttacggtaagttaggttagtaggttattacgg

SEQ ID NO: 115421 - DNA, 751 bp, Homo sapiens
  misc_feature: GYAE6OF01C9LJD.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttgggttttccttgttgcttattttagaaggtgtccagtgtgacgtgcaactggtggagtcgtgggggagtcttggtccagccgtgggggtccctgagactctcctgtgcacgtcctctggtattctaaacgttttggtagtctagttggatggactggggtcccgcctagtcgtccggaaggggaaggggtcgtagggaggttcggggtcgggaccaacagtaacgaggggtagggtaggttacggtaaacgaaaaaacgttcgtggtacggtactcggtcgtcgggccgggggtccgtactttaccgacctactccttaccgaaggtaacgaaaccgaaaccggaaaccctaaaaaacctctaacgttagtaacgttcttacgaacgtaaaacgtcgggaaccggtaccgtggtaacggaccgttacccgggaaagggaccgtaccgggtcctttaggggttacgtttaacgtttaggttacggttgaccggtaaaggtacgggtttaaactttaaagggttaacctttaaacggttaaaacggtttttcggaaacggttacgtaacggttaggggttaaatcgggtaatttaccggg

SEQ ID NO: 115422 - DNA, 547 bp, Homo sapiens
  misc_feature: GYAE6OF01EPHM4.37.34.D01.1.454.CMB.1.raw
  modified_base (346)..(346): a, c, t, g, unknown or other
  misc_feature (346)..(346): n is a, c, g, or t
  modified_base (390)..(390): a, c, t, g, unknown or other
  misc_feature (390)..(390): n is a, c, g, or t
  modified_base (409)..(409): a, c, t, g, unknown or other
  misc_feature (409)..(409): n is a, c, g, or t
  modified_base (545)..(545): a, c, t, g, unknown or other
  misc_feature (545)..(545): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgctattttagaaggtgtccagtgtgacgtgcaatggtggagtcgtgggggagcttggtccagccgtggggggtccctgagactctcctgtgcagcctctggatttcaactttggtagcttattggatggactgggtccgccagtctccgaggggaggggctggaggtgggtgaccaanagtacgagggaggtggtaggtaacgaaaatgtgtggactgtggnggcgggcgattcaccatcncagagaacaacgaccaaaactcactgtatctagacaagtcggacggcctagagacgtccggaaggaccgacggacttgtagttattagtgtaggcgtagagtattagaactacgtaaagttgagtgatggtatgtntg

SEQ ID NO: 115423 - DNA, 517 bp, Homo sapiens
  misc_feature: GYAE6OF01B0UDM.37.34.D01.1.454.CMB.1.raw
  modified_base (386)..(386): a, c, t, g, unknown or other
  misc_feature (386)..(386): n is a, c, g, or t
  modified_base (446)..(446): a, c, t, g, unknown or other
  misc_feature (446)..(446): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgttagagacagagtcaccatcgcttgccgggcagtcaggacatccgcaattttgtagcctggtatcagcagagaccagggcaagttcctcaactcttgatctatgatgcatctctatttggagtccgaggggtctcattcgtcggttcagtggcagcggatcgtgggcctcttcacgtctccacactcaccncgcctccacgcctagagtactgtcgactaactttattactcgtacaactagtactgagtntccgtccgtggtaccgttccggacccgacgggaaccgtaacggtacggaactacgaacgtacgacgtcggg

SEQ ID NO: 115424 - DNA, 669 bp, Homo sapiens
  misc_feature: GYAE6OF01BIWPU.37.34.D01.1.454.CMB.1.raw
  modified_base (663)..(663): a, c, t, g, unknown or other
  misc_feature (663)..(663): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagtgtgacgtgcaacgtggtggagtcgtgggggagcttggtccaggccgtgggggtccctgacgactctcctgtcgcagtcctcgtggtatttctaacgtttggtagtcttagttggagtggtacgttcggggtccgaccgtacggtccgtaccgaagggggaacggggcgtgggtaggtggggtcggaccaacagtaacggagggtagggtggtaggtaaacgaaaacgttgtaggtaggacttcgtaggtcgggccgggtaccgtattaccgaccgtactaccgtacccgaagaacgtaaccgaaaccgaaaccctaaaaactctaacgttacgtactcgtagaactaagtcggaccgtactggaacgacgtaccggaacggacgtacggtattgtacgttattagttgaggtgaagtagttaatttagaacttaacgttaaacggtttgaacgttacggacgttaggtattggtnttacgg

SEQ ID NO: 115425 - DNA, 583 bp, Homo sapiens
  misc_feature: GYAE6OF01BIIYV.37.34.D01.1.454.CMB.1.raw
  modified_base (269)..(269): a, c, t, g, unknown or other
  misc_feature (269)..(269): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccaggggaaggggctgggagtggggtggccaacatacaggggaggtggtggtaacgaaaaactntgtggactctgtgcggggccgattcaccatctccagagacaacgccaaaaactcactgtatctgacaaatggacgcctgagatccgaggacacggctgtgtattattgtgcgagagtatttagactacaagtttcgagtgactggtatgatgtcttatgactacggtggggacccaagggaccagtcgtccacgtctcttacacgtcctccgaaccgacgggccctacgtccggttcccttcccccgtggcccgtccccgtgcccttcccggaaggtaccgaccctaccgtccggaagtcgcccgacgaccggg

SEQ ID NO: 115426 - DNA, 374 bp, Homo sapiens
  misc_feature: GYAE6OF01DD0PC.37.34.D01.1.454.CMB.1.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (318)..(374): a, c, t, g, unknown or other
  misc_feature (318)..(374): n is a, c, g, or t
tcagtagtgtagatcacgaccggtgctcgatttagatcgtctgtggtttgggtttggggggaagaggaagactgacggtcctgccacaggtggtgcgtgaggaagagactggaggtggacgtgtcgagcacccagctggggcctgtcccctggtcaccgtctcctcgagcctccaccaaagggcccatccggtcttccccctggccgcccctgctccaggancacctccgagagcacagcggccctgggctgcctggcaaggctacttccatctanactacngaagcgggctggcaaggcgtacagttagntcantgnnnnnnnnnnnnnnnnnnnnnnnnnnnnnnnnnnnnnnnnnnnnnnnnnnnnnnnnn

SEQ ID NO: 115427 - DNA, 672 bp, Homo sapiens
  misc_feature: GYAE6OF01D53XP.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctggggggaggcttggtccagccctggggggtccctgagactctcctgtgcagcctctggattcaactttggtagctattggatggactgggtccgcagtctccaggggaaggggctgggagtggggtggccaacatacgaggggaggtggtaggtaacgaaaaactagtgtggactctggtggcggggccgattcaccatctccagagacaacgaccaaaactcactgtatctgacaaatggacgcctgagatcgaggacacggctgtgtattatgtgcgagagtatttagactaataaagtttcgagtgacgtggtatgtatgacttagtgtacgtaccgtaggggacccgaagggaccgtagttcggtaccgtaccggttcttaccgttacgtaccgtcccttacccgaacccgaaccgggtaccccgtaacgttccgggttacccctttccccccggtcgggtacccccggtccccgttccggtaccccgttcccggaacgggtaccgtaccccgtaaccccttacccgggaacggtacccggaccgaacccgtaaccccgggg

SEQ ID NO: 115428 - DNA, 302 bp, Homo sapiens
  misc_feature: GYAE6OF01DXIPA.37.34.D01.1.454.CMB.1.raw
  modified_base (291)..(291): a, c, t, g, unknown or other
  misc_feature (291)..(291): n is a, c, g, or t
  modified_base (297)..(302): a, c, t, g, unknown or other
  misc_feature (297)..(302): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagccggccctgggcctgcctggtcaaggactacttccatctacactactgagcgggctggcaaggcncatagnnnnnn

SEQ ID NO: 115429 - DNA, 517 bp, Homo sapiens
  misc_feature: GYAE6OF01AWWCG.37.34.D01.1.454.CMB.1.raw
  modified_base (372)..(372): a, c, t, g, unknown or other
  misc_feature (372)..(372): n is a, c, g, or t
  modified_base (428)..(428): a, c, t, g, unknown or other
  misc_feature (428)..(428): n is a, c, g, or t
  modified_base (462)..(462): a, c, t, g, unknown or other
  misc_feature (462)..(462): n is a, c, g, or t
  modified_base (515)..(515): a, c, t, g, unknown or other
  misc_feature (515)..(515): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggagcttggtccagcctggggggtcccctgagactctcctgtgcagcctctggattcaactttggtagctattggatggactgggtccgccagtctccgagggaaggggctggagtgggtggccaacatacgagggaggtggtaggtaacgaaaaactntgtggactcgtgtgcggggcgattcaccatctccagagacaacgacaaaactcatnatctgacaaatggacgctgagatcgagacgacgntgtgtatatgtgcgagagtattagactacgtaaagttcgagtgactggtatgntg

SEQ ID NO: 115430 - DNA, 819 bp, Homo sapiens
  misc_feature: GYAE6OF01EDZPA.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagctgggttttccttgttgcttattttagaaggtgtccagtgtgacgtgcaacgtggtggagtcgtgggggagtcgttggtccaggccggtcggggggtccctggacgaccttcctccgtgtcgccagcccttcgtggtaactttccgtaacgttttggtagtcttaagtttgggattgggaccgttggggtccccgccgaggttcctacccggaagggggaacgggggcgttgggacggttggggtacggacccaaacgtaagtaccggaaggggaggttagggtaagggtaaacgaaaaaactgtaggtggacttcgtggtacgggccggggtaccgtaagtttccgaacctagttacccgtaccgaacggaacgaaccaaacccggaaacccctaaaaaaccgtcctaaacgtttcgttaacttaccgtacggaaacctaaacggttcgggaacccggtcccgtaaggaacgtaaccgtaacccgggaacggaccgtaaccgggttccgttaggtttacggttaagttttacgttagggttacggtaaccggaaggttttttaaggaacgttttttaaaccggaaccgtttaaaaccgttaaaacgggttttaccggaagggtttaaccggtaacggtttagggttaaacgttaggttacgtttaacggg

SEQ ID NO: 115431 - DNA, 864 bp, Homo sapiens
  misc_feature: GYAE6OF01CL428.37.34.D01.1.454.CMB.1.raw
tcagtagtgtagatcacgaccggtgctcgatttagatcgtctgtgttgggtttgggctcagagaggagccttagccctggactccaaggcctttccacttggtgatcagcactgagcacagaggactcaccatggaattggggctgagcgttggttttccttgttgcttattttagaagtgtccagtgtgacgtgctaacgtggtggagtcggtgggggaggtcttggtccaggtcccggttcggggggtcccctggaacgtccttccgtccgtggtcgccgacgtcccttcgtaggtatttccgtaaacggttttgggtaacgtctttagttcgggtagttcgggtacgttccggggtcccgaccgtaggttcccgtaccggtaacgggggtaaggggtccgttaggggtaacgggttcggggtaccgggaccctaaacggtaacggttacgggaaagggggtacggttacggggttaacggtaaaaaccggttaaaaaacgtggttagggtaccggtaccgttacggttgggtccggggccggggtacccttaagtttaccccaaccgttacgtcccgtaacccggtaaggaaccgtaaaccccgaaacggtaaaacccctaaaaaaccgttcctaaccgttagttaacgtaccgtaagaacccgtaaaggtccggtacccgacgttaacggaacgtaacggtacccggaagggtacccgacgggtacgtttagttacggttaagtttaggttcgtaacggtcgtaaagggtacgttaaacgtttaacgtaaaccgtttaaacgttaaacgggtttacgacggttacggtaacggtttggtttaaacgtggtaccgtttaag

SEQ ID NO: 115432 - DNA, 643 bp, Homo sapiens
  misc_feature: GYAE6OF01A1O4Z.37.34.D01.1.454.CMB.1.raw
tcagtagtgtagatcacgaccggtgctcgatttagatcgtctgtgttgggttttccttgttgctattttagaaggtgtccagtgtgacgtgcaactggtgggagtctgggggaggcttggtcccagcctggggggtccctgagactctcctgtgcagcctctggattcaactttggtagctattggatggactgggtccgccagtctccgaggggaaggggctgggagtggggtggccaacgatacgaggggaggtggtaggtaacgaaaaactgtggtggactctgtgcggggccgattcaccatctccagagacaacgccaaaaactcactgtatcctgacaaatggacggcctgagactccggaggacacggctgtgtattattgtgcgagagtatttagactaacaagtttcgagtgacgtggtatggatgtcttagtgactaccgtggggaccgaagggtaccagttcggtaccgaccgttcctacttccgacgtccctaccgaacccgaacgggacccctaaggtcccggttacccgttccccccgtacgggtccccgtcccccgttacggccccgttacccgacgggtaccgacccgttaccccgtaccggaacgaccggccaccggtacccgggg

SEQ ID NO: 115433 - DNA, 788 bp, Homo sapiens
  misc_feature: GYAE6OF01DQFO2.37.34.D01.1.454.CMB.1.raw
tcagtagtgtagatcacgaccggtgctcgatttagatcgtctgtggttggggtttgggggcaggagtcagacccactcaggacacagcatggacatggagggtcccccgctcagctccgtggggctcctgctgctctggcctcccgaggtgccagatgtgccataccaaaatcgacccagtcctccactccctcctgtctgcatcgtagtaggagacagtagtcatcatctacgttggaccgggacaaggtcgagggactaagttaagaaagttagtagtttaggcttaggtatacgagaccgaaggaaaaccgaacgggaaaccgaccccgtaagcctacctacacttacgtagtgtcgactaacgtaccgtaagttttaaccgaaaccggttacgggttaaccctaaagtttaacgacgttacgaacggcggtaacgtagggtagtacgttacggtaccgggactaacgttaacggttactttaccaaccttaccgtacccaacctaacgttaccgaacgaccgtacggacccgtacggtacctaacggtacccgttaaggtaagtttaacgttttacgaaccctttaaacgttttaacttacgtaccgtttaaccgtaaacttaaacggttaaactttaaccgttaaccgttttaaccccgtacggttacccgggttaaccgggaaacccggtaaaccggggtaaccggttaaaggggtacggtaaaccgtaaaccggtaaaccggtaacgttcgggtaacggtcccgtacgtaaccctaacccg

SEQ ID NO: 115434 - DNA, 674 bp, Homo sapiens
  misc_feature: GYAE6OF01B2ZL9.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaactggtggagtcgtgggggagcttggtccaggccgtggggggtccctgagactctcctgtgcagcctcgtggtattctaaacgttttggtaagtcttaagttgggaagttgggaccgttcggggtccccgccacggttcctacccggaagggggaacgggggtcgttggggagggttggggtacggacccaaacgagtaacggaggggtaggtaggtaggtaaaacgaaaaactgtggtggacttcgtggtcgggccggggacctagttcccaaccgtactcctaccgaagaacgaaccaaaccgaacccaaaaactcaactgtatcgtagacaaagtcggacggtcctagacgacgtaccggacggaccgacggtcttaggtagttattagttggtagacgtaaggtagtaacgtttaagaaccttaacgttaaaggtttcggtaagttacgacgttaggttatggtagttacg

SEQ ID NO: 115435 - DNA, 656 bp, Homo sapiens
  misc_feature: GYAE6OF01EBSSR.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcagtttctataccgcctggatgagctggatccgccaggctccgaggaaggggctggagtgggtcgccgtagtaaaagcgaaggttctgggtgggacaacgagactacgctcgccccgtagaaaggcagattcaccatctcgagagatagaactaccaaaaaccctccctagtactctgcacatagaacacgaccggaacgaaccgagacacgacgccgtactattacgtgtacgtacatagtatagtacttacgtttagactaccgagtacggtaacgtagtttcggttacgggtacccctttagtaccgttacggtcggggtacccgaacgggtaacccgttggtaccgaccgttcctacccgtcgacgtccctacccgaacccgaacgggcccctacgttcccggttcccgttcccccgtcggcccgtccccgtcgacctcccgacgggtaccgacccgtacccgtaccgacgacgccgacgacccggg

SEQ ID NO: 115436 - DNA, 696 bp, Homo sapiens
  misc_feature: GYAE6OF01EIHQ4.37.34.D01.1.454.CMB.1.raw
  modified_base (202)..(202): a, c, t, g, unknown or other
  misc_feature (202)..(202): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcgtggtttctgtgctatttagaagtgtcagtgtgacgtgcaacgtggtggngtcgtgggggagcgttggtccagccgtggggggtccctggacgctctcctggtgcagcctcgtaggacttcaacgttttggtagtcttaggttggagttacgggaccgttcggggtcccgcctaggttccgtacccggaaggggggtaacggggtccgtggggtaacgggttggggtccggaccctaaaccgaagttaccgggagggggtaggggttaggtaacgggtaaaacgtaaaaaacgttggtaggtacgggtaaccttcggtggtcggggccggggacccgtaattccaacctagtcctacccgaagaacgaaccgaaaccgaaacccaaaacctcacgtagtattaccctagaactaagtcggaccgctagacgacgtaccggaagaccgtacggtcttaggtagttaattggtagtgaccgtaaggagttaacttaacgaagttaacgtaacggtttacgaggtgttaacgtaggtctgtcttagg

SEQ ID NO: 115437 - DNA, 296 bp, Homo sapiens; identical to SEQ ID NO: 115325
  misc_feature: GYAE6OF01A955E.37.34.D01.1.454.CMB.1.raw
  modified_base (296)..(296): a, c, t, g, unknown or other
  misc_feature (296)..(296): n is a, c, g, or t

SEQ ID NO: 115438 - DNA, 611 bp, Homo sapiens
  misc_feature: GYAE6OF01CQWLH.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgcttattttagaaggtgtccagtgtgacgtgcaactggtggagtcgtgggggaggtctggtccagccgtggggggtccctgagactctcctgtgcagcctctggattcaactttggtagctatggatggactgggtccgccagtctccgagggaaggggctggaggtgggtgaccaacagtacgagggaggtggtaggaacgtaaaaactagtgtaggaactcgtgtgcggggcctattcacatctacagacgacaacgacctaaaaacgtcaacgtcgtatactagacaaagttcggaaccggtccgttagaggtaactaccgggaaggaaccgtaccgggtcttaggtagttagttacttagggtcgacggtaagaggtaatttaggaacgttaaacgtaaagttttcggaagttaggaacttgggtaactggtattacgg

SEQ ID NO: 115439 - DNA, 606 bp, Homo sapiens
  misc_feature: GYAE6OF01EY8XA.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtggggggtccctgagactctcctgtgcagcctctggattcaactttggtagcttattggatggacgtgggtccgcagtctccgaggggaagggctgggaggtgggtcggaccaacgagtacgagggaggtggtaggtaacgaaaactgtgtggactcgtgtcggcgggcctatcacatctcagacgacaacgaccaaaactcactagtatctagacaagtcggacgcgtagagacgtaccgaggacgacggtcttaggttacgttaatttacgttggtcggtacgaaggtaggttaacgtttaacggaaccttaacgttaaaacggtttacggtaacggttacggtaacgttaggtttagttaggtagttacggg

SEQ ID NO: 115440 - DNA, 605 bp, Homo sapiens
  misc_feature: GYAE6OF01ESW2M.37.34.D01.1.454.CMB.1.raw
  modified_base (343)..(343): a, c, t, g, unknown or other
  misc_feature (343)..(343): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgcttattttagaaggtgtccagtgtgacgtgcaactggtggagtcgtgggggaggcttggtccagccgtggggggtccctgacgactctcctgtgcagcctctggatttcaacttttggagtctattggatggactgggtccgccagtctccgaggggaggggctgggagtgggngccaacatacgagggaggtggtaggtaacgaaaaactgtggtaggactcgtggtcggccggggacctagttccactattccaccagacgacaacgaacccaaaaactcaactagtatcgtagacaaagtcggaacgtcctgacgagtaccggaggaccgacggcttggtacgttattacgttggtagcgaaggtagtatttaagaacttaacgttaaacgtttcggtaaagttcggtaacgttagggtagttggtattacgg

SEQ ID NO: 115441 - DNA, 709 bp, Homo sapiens
  misc_feature: GYAE6OF01D2X4E.37.34.D01.1.454.CMB.1.raw
  modified_base (599)..(599): a, c, t, g, unknown or other
  misc_feature (599)..(599): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgctattttagaaggtgtccagtgtgacgtgcaacgtggtggagtcgtgggggagcttgggtccaggccggtggggggtccctgagtacctctcctgtgcacgcctcgtggtattactaacgttttggtagcttagttggagtggacgtcggggtccgccgtagtccgtaccggaggggaacggggcgtgggaggtgggtcggaccaaacgagtacgaggggtaggtggtaaggtaaacgtaaaaacgtgtaggtacggactcgtgggtcggccggggtcctacttccgaacctagtcctaccgacgaacgaaccaaaccgaacccaaaaactcctaagttacgtatctacggaacaaaggtcgggaaccgtctaggaacgtaccgtaccggaaggaccgtacggtacgttgttaacgttatttaggttggnggtacggtaaggtaaggttaacgttttaaacggaaccgtttaaaaccgttaaagggttttccgtaaaggggttacgtaaacggttagggttaaagttggtaagtttacgg

SEQ ID NO: 115442 - DNA, 666 bp, Homo sapiens
  misc_feature: GYAE6OF01EQLDY.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagctgggttttcctgttgctattttagaaggtgtccagtgtgacgtgcaactggtggagtcgtgggggagcttggtccagccgtgggggtccctgagactctcctgtgcagcctctggacttcaaccttagggtagcttagtggtagtcggactcggggtcccgatccggtcgtccgaggggaagggtcgtggaggtggtcggaccaacgagtacggagggaggtaggtaggtaaacgaaaactagtggtggacttcggtggtcggccggggacctattacccacctacgtcctaccgaaggaacgaaaccaaccgaaaccctaaaacgtctacgttagtactcgtacggaactaacggtcgggacgtaccggtaggaacgtaccggtaccgggaacggtacgtacgggttagttaggttagttagttacgttaggtacggtagtagtaagttacgttaacgtaacgttaacgttacgtagtacgtacgttaggttaagtcggttagttacgttaaccgg

SEQ ID NO: 115443 - DNA, 635 bp, Homo sapiens
  misc_feature: GYAE6OF01CRYCC.37.34.D01.1.454.CMB.1.raw
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
tcagtagtgtagatcacgaccggtgctcgatttagatcgtctgtgttgggtttgggggcaggagtcagacccactcaggacacagcatggacatgagggtcccccgctcagcctcctggggctcctgctgctctggctcccaggtgccagatgtgccatccaaatgacccagtcctccattccctccctgtctgcatctgtagganacagagtcatcatcacgttgccgganagtcaggcattagaatgtaagttaggctaggtatcagacaacggaaaccgagggaaccgacccgtaagccttcctactactcgttatggtgacactcctaacgttacaacgtcgggtacctaagtttaagagttacaggccggagtacggttagacttcgtaggaccaacggtatacctttacacttcctacacctatcacgaccacgtccgtacgcgtaacgccgttaagtaacgttacgttttacgtacttaaactttacgttacgtacgttacttaaactaacgttaacttaacttaaccgtttaaccctaccggttaccgtttacccgggaacggtaaccgggtaacgtagggttaacgtaacgtaacgaaccgtaacgtggtacgctacgtctaaccg

SEQ ID NO: 115444 - DNA, 854 bp, Homo sapiens
  misc_feature: GYAE6OF01EHRLN.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttgccgggcaagtcgaggcattagaaatgatttaggctggtatcagacaagaaaccgagggaaacgcccctaagcctcctcatctagtggtcgctactaccgtaagtttaacaaacggttcgggtaccctaagttaaacgtactttacgacggtacgggtacgtaagggttacgggtacgtttccggtacggggtacctaacgttaacggtttaactttttacccaacccgtttacccgtacccctaaaccccttaacgttaacccgaacggtacccgtaaccggtaccccgttacggacccgtaaccggtacccgtttaagggtaaacgttttaacggttttttaaccggaacccttttaaacctttttaaccgttttaacccgtttaaccgggtttaacctttaaaaccggttaaaagtttaaaccctttttaaacccgttaaaacccgtttttaaaccccccggtttaaccgggttttaaaccccggtttaacccggggtaaaccccgggtaaaaccgggggttaaaccccggtaaaggggttaaaccggggtaaaaccggttaaacccggtaaaaacccgggtaaccggtttacgggtaaccgggttaccgttaccggaaccccgttaaacccg

SEQ ID NO: 115445 - DNA, 663 bp, Homo sapiens
  misc_feature: GYAE6OF01CMBIJ.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcgagcctctggattctaacgtttggacgtctagttggagtggacgtcggggtccgccgtagtccgtaccggaaggggaacggggtcgtagggaggttggggtacggacccgaaacgtaagttaaccggaggggtagggttggtaacgggtaaaacgtaaaaaacgtgttaggtaggaaccttgtggtcggccggggtaccgtattaccacctatcccgtacgaggaacgaacaaaccgaaaccaaaactcaactgtactctagactaagcggacgctagacgacgtccggacgacgacgtcgtgttacgttagttagttggtaggaccgtaaggtagtaagtttaagaacgttaaacgttaaaggtttccgaagttacggtaactaggtacttaggagttacg

SEQ ID NO: 115446 - DNA, 595 bp, Homo sapiens
  misc_feature: GYAE6OF01ESAF2.37.34.D01.1.454.CMB.1.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (399)..(399): a, c, t, g, unknown or other
  misc_feature (399)..(399): n is a, c, g, or t
  modified_base (535)..(535): a, c, t, g, unknown or other
  misc_feature (535)..(535): n is a, c, g, or t
  modified_base (563)..(563): a, c, t, g, unknown or other
  misc_feature (563)..(563): n is a, c, g, or t
  modified_base (583)..(583): a, c, t, g, unknown or other
  misc_feature (583)..(583): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgagggaagggctggagtgggtgccaanatacngggagtggtgtaacgaaaactntgtggactctgtggcggggccgattcaccatctccagagacaacgaccaaaaactcactgtatctgacaaagtggaacggcctgagacgtccgaggacacggcttgtgttattatgtgcgagagtatttagacttaanaagtttcgagtgactgtatgatgtcttatagacttaccggtggggaccaagggaccctaggttcggtcctaccgtcttacttccgacgtaccctaccaaccgaacggtccccacgttccggttacccttcccccgnggcccgtccctcgcctccgtacggaccnccgtaacccgtcggagaccncgaccgtacggg

SEQ ID NO: 115447 - DNA, 847 bp, Homo sapiens
  misc_feature: GYAE6OF01DDJAT.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtcgtggggggaggcttggtccagccgtggggggtccctgagactctcctgtgcagcctctggattcaactttggtagctagttggatggacgtgggtccgccagtcctccgaggggaaggggctgggaggtggggtcggaccaacatacgagggtaggtggtaggtaaacgaaaaactgtggtggactcgtggtggccggggccgattccgacctatcctaccgaagaacgacaaccgaaccaaaaactcactgtactctagactaaagtcggaaccggcctaggagacgtccggacggaccgacggcttggttattagtttagttggaggacgtaggtaagttaacgtttaacggaacttaaaccgtaaaggtttacggtaagggttacgtaacggttagggtaagtaggtagttacggttaacttaggtagtaagtttacgtaccgggtacgggggtaaacccggtaaggggtaacccgtaaggttccgggttaacccgttacccgggtttaacccgtttcccgttacccgtaacccgttaccccgtaacccgtaaacccccgggtaaccggggtaccccctaacccgggtttccccgggtttacccccccgtttaccccccgggtacccgggttccccccggtaccccgttcccggtacccggttaccccgggaaccggggtaacccctacccggtacccccggtaacccgggaacggaacccggacccggtaaccccggg

SEQ ID NO: 115448 - DNA, 607 bp, Homo sapiens
  misc_feature: GYAE6OF01D797G.37.34.D01.1.454.CMB.1.raw
tcagtagtgtagatcacgaccggtgctcgatttagatcgtctgtgttgggtttggggctcagagaggagccttagccctggactccaaggccctttccacttggtgatcagcactgagcacagaggactcaccatggaattggggctgagcttgggttttccttgttgctattttagaaggtgtccagtgtgacgtgcaacgtggtggagtcgtgggggaggcttggtccagccgtggggggtccctgagactctccgtgtgcagcctctggattcaacttttggtagtctagttggattgggaccttggggtcccgccgagtccgtcccggagggggaacgggggcgtggggaggttggggtcggaccaaacgagtaacgaggggaggtggtaggtaaacgaaaaacgtgtgtggactcgtggtggcggggccattcaccatctcgagacgacaacgaacccaaaaactcaactgtactctagacaagtcggacgcgtagacgacgtaccgaggacgacggtcttgtagttagttagttgtcgacgaagtagtatttagaacttaacgtaaaggtttcgaagttgacgttaggtaatgagttacgg

SEQ ID NO: 115449 - DNA, 770 bp, Homo sapiens
  misc_feature: GYAE6OF01BNJJ2.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggacctcaccatggaattggggctgagctgggttttccttgttgcttattttagaaggtgtccagtgtgacgtgcaactggtggagtcgtgggggagcttggtacagccgtggggggtccctgagactctcctgtgcagcctctggtttcattctttagctaactacgccatgagtcgtcgggtccgccgaggcctccgaaggggaacgggcgtgggaggtcgggtccttacggaaggttacttacgtaggggttaacggttaggtaaactaacccggcgtaagttaaccgtaaccggcgaacgtacccgtcccggttgggaaccccggggtcccgttttaccgaaccccggtttcgtacccgaagggtacgtaaaccgtaacgtttaaccccgaaaaggttaacggtttaaacccgggttacttaacgttaccggttaaagggaaaactttacggaaaccgtacgggttacccgtaagggaacggtaaccgggacccggtaaacgggtaacccgtaccccgggttacccttagttaaaccgttcggttacgggtgaaccggtaaggaacgttacgtaccggaagggtaaccggtaggttaagtaacggcttaacgggcctaaggtccctaccgtaggtaaacccgg

SEQ ID NO: 115450 - DNA, 737 bp, Homo sapiens
  misc_feature: GYAE6OF01CGMJL.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattgggctgagctgggttttccttgttgcttattttagaagtgtccagtgtgacgtgcaactggtggagtcgtgggggaggcttggtccagccgtggggggtccctggagacctcgtccgtgtgcagccttcgtaggtactttctaaacgttttggtagcgttagttggagtggtacgttcgggtcccgcctagtcctccgaaggggacggggtcgtgggaggttggggtcggacctaacagtacgaggggtaggtggtaggtaaacgaaaactagtaggtacggactcgtggtacggcgggccgtatccactactctccgagacgaacaacgaaccctaaaactctaactgttaactcgtacgacgtaaagtacgggaccggtccgtagacgtaacgtaccggaggtaacccgtagggtaccgttagtttacggttaacgtttagttggttacggtaaaccggttaaagggttggggttacggggggggtagggttaccggggggtcccgtttaaccgggttcccggtttaggggtttccggtttttaacggtaaccgggttttaccgggtccgggggtaacccggtaaccgggggg

SEQ ID NO: 115451 - DNA, 326 bp, Homo sapiens
  misc_feature: GYAE6OF01DEXOF.37.34.D01.1.454.CMB.1.raw
  modified_base (313)..(313): a, c, t, g, unknown or other
  misc_feature (313)..(313): n is a, c, g, or t
  modified_base (319)..(326): a, c, t, g, unknown or other
  misc_feature (319)..(326): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccgaagggcccatccggtccttcccccgtggccgccctgcctccgaggacgccaccgtccgagacgcacgacggccggccctgggctcgccgtggtacaaggtacctacttccatcctaacactactgagcgggctggcaagggcncatagnnnnnnnn

SEQ ID NO: 115452 - DNA, 825 bp, Homo sapiens
  misc_feature: GYAE6OF01AMVRV.37.34.D01.1.454.CMB.1.raw
tcagtagtgtagatcacgaccggtgctcgatttagatcgtctgtgttggttttccttgttgctattttagaaggtgtccagtgtgacgtgcaactggtggagtcgtgggggaggcttggtccagccgtggggggtccctgagactcctcctgtgcacgcctcgtggattcaacgtttggtagcttagttggatggaccgtgggtcccgcctagtcctccgaaggggaacgggtctagggaggtggggtggacccaaacgagtacggaggggtaggtgggtaggtaaaccgaaaaactgtggtaggtacttcgtggtcggccggggccgtaacttccgaacctacttcctaccgaaggacgaaccaaaccgaacccaaaaaacctctaacgttcgtaatccgtagaaccgtaaagtcgggaccggtcctaggagtaccgtaccggacggaccgacggtcttaggtagttatttagtggtcgacggtaagtagtactttaagaacgtaaacgttaacggttcgtagtgtacgttaggtagtagttagtgttagttagtaggtaccgtaaccgggtcggggaaaccgtaacgggtaccctaggttaccggtacccgttaccgtttaccttcccggttaccgaccgttaccccgtaacccgaaccgggtaacccgggtaccccttaccggttcccggttacccccgttcccccgggtaaccgggttcccccggtaccccgtaccgggttaccccgtaccgggaaccgtaccggtacccccgttacccggaccggaaccggaccgtaacccgggacccggtaccccgggg

SEQ ID NO: 115453 - DNA, 590 bp, Homo sapiens
  misc_feature: GYAE6OF01BGU7D.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttcctgttgctattttagaaggtgtccagtgtgacgtgcaactgggtggagtcgtgggggaggcttggtccaggccgtggggggtccctgagactctcctgtgcagcctctggtttcattctttagctaactacgccatgagtcgtgggtccgccagcctccgaggggaagggctgggagtgggtctcgagttattacgtggtagtggtaaatccgacatactacgcacgactccgtggaccgggtccggttccaccgtctccgagacgactattaccaaagtaactacggtctactcgtaaggaaatcgaacagtcccgtaggaacgacggacccgaagggaccctaccgggccccttataacttaccgtgtcgacgagtagacgtcaaggaccggagtactacgcgtaacgcgaacgctacgtgtaacccgg

SEQ ID NO: 115454 - DNA, 303 bp, Homo sapiens
  misc_feature: GYAE6OF01E1AFH.37.34.D01.1.454.CMB.1.raw
  modified_base (302)..(303): a, c, t, g, unknown or other
  misc_feature (302)..(303): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggcccatcggtccttccccctggccgccctgctccaggacgccacctccgagacgcacagccggccctgggctgcctggtcaaggactacttccatctacactactgagcgggctggcaaggcgcatgnn

SEQ ID NO: 115455 - DNA, 302 bp, Homo sapiens
  misc_feature: GYAE6OF01AISHY.37.34.D01.1.454.CMB.1.raw
  modified_base (294)..(302): a, c, t, g, unknown or other
  misc_feature (294)..(302): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctgggcctgtccctggtcaccgtctcctcagcctccaccaaggcccatcggtcttccccctggccaccctcctccaagagcacctctgggggcacagcggccctgggctgcctggtcaaggctacttccatctacactactgagcgggctggcaaggcgcatagnnnnnnnnn

SEQ ID NO: 115456 - DNA, 879 bp, Homo sapiens
  misc_feature: GYAE6OF01C2QQQ.37.34.D01.1.454.CMB.1.raw
  modified_base (225)..(225): a, c, t, g, unknown or other
  misc_feature (225)..(225): n is a, c, g, or t
  modified_base (304)..(304): a, c, t, g, unknown or other
  misc_feature (304)..(304): n is a, c, g, or t
tcagtagtgtagatcacgaccggtgctcgatttagatcgtctgtgttgggtttgggggcaggagtcagacccactcaggacacagcagtggacatggacgggtccccgctcagcctccgtggggcctcctgctgctcgtggcctcccgaggtcgccaggatgtcgacctaataccaaatcgacccagtcctccactcccgtcctgtctagctatcgtggaagganacgagatcatcactcgtacgtcggccggactaaggtcgaggtactaagttaagaattggttaagttaggcgtaggtacncgaacggaccgaaacggaaaaccggacggggaaaccctacccgtacgtccttaccctacgtacgttacgtaagtcggtactacctaccgttaaccgtttaacgttaaaccgaaccggttccgggtaaccttaaagttacgacttacggacgtacggtacgtaaggtcggtacgttcggtacgtaccgtaacgttacgttacctttaccaaccttccgtaacccctaacctaacgttaccgacggtaacgtacccggtccccgttaaggccctaacgggtacgttaaacggtttaacggttaagtttttacccgaaactttaacccgtttttaacgttaacccgttaccggttaaaaccttaacgttaaaacgtttaaacctttaacccgtttaaaacccgtttaccccgggttccgggttaaaacccggggtttacccccgggaaaaaccgggttaacggggtaaaaccccggttaaggggtttaaccccgaaaaacggggttaaaccggtaaaaccccggtttacgggttaccgggtaaccggttacccctacggtaaaccccgttaacccggg

SEQ ID NO: 115457 - DNA, 626 bp, Homo sapiens
  misc_feature: GYAE6OF01EQM4W.37.34.D01.1.454.CMB.1.raw
  modified_base (225)..(225): a, c, t, g, unknown or other
  misc_feature (225)..(225): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggnaagtcaggcattagaaatgattaggctggtatcagcagaaacagggaacgccctaagcctcctcatctatgtgcatccatttaacgaacgtcgggtacctattaagattcgagcgggctaggtggtactcgtggacaacgtagtactttaccacttccgtacctaccctatcgaagccaacgtccctacgcaacgtacccgtaggtaaacttacgttttacgaacttaactttaactttaaccgtcgttaactaactaaacgttaactttaaccttaaactttaccccgttaccggtttaccgttacccgggaaccggtaaacgggtaaccggtaaacgggtacgggaaaccgttaaccgaaaaccggtaacgtacggttagggacctcggactaaacccg

SEQ ID NO: 115458 - DNA, 618 bp, Homo sapiens
  misc_feature: GYAE6OF01CGIGU.37.34.D01.1.454.CMB.1.raw
  modified_base (205)..(205): a, c, t, g, unknown or other
  misc_feature (205)..(205): n is a, c, g, or t
  modified_base (322)..(322): a, c, t, g, unknown or other
  misc_feature (322)..(322): n is a, c, g, or t
tcagtagtgtagatcacgaccggtgctcgatttagatcgtctgtgttgggtttgggggcaggagtcagacccactcaggacacagcatggacatgagggtcccccgctcagctcctggggctcctgctgctctggctcccaggtgccagatgtgccatccaaatgacccagtcctccatccctccctgtcctgcatctagagganacagatcatcatcacttgccgggacaagtcgagggctaagttaagaaatgaatttaggctaggtatcgagcaagaaacgagggaaacgccctaagcctacctcaagtctagtggtancacttaccgtaacgtttaacaaccgtacggggtaccctaaagtttaacgaattccgaaggccggtactaggtaggattacgtggaccactagtatttccactctccaacccagtacagccgagtcctacggacacgtcctaaggtaagttattttacgacttaacgtttaacttcgtagtactacgtactaacttaagtaagtagggaactacggtaccgggaccggtacgggtaaccggtaggggttacgaacgtaataaccgtaaaaccgttagtcggttaggcctggtaaccc

SEQ ID NO: 115459 - DNA, 586 bp, Homo sapiens
  misc_feature: GYAE6OF01B3KEI.37.34.D01.1.454.CMB.1.raw
  modified_base (265)..(265): a, c, t, g, unknown or other
  misc_feature (265)..(265): n is a, c, g, or t
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
tcagtagtgtagatcacgaccggtgctcgatttagatcgtctgtgttgggtttggggtctcagagaggagccttagccctggactccaaggcctttccacttggtgatcagcactgagcacagaggactcaccatggaattgggctgagctgggttttccttgttgctattttagaaggtgtccagtgtgacgtgcaactggtggagtcgtgggggagtcttggtccagccgtggggggtccctgagactctcctgtgcagcctntggattcaacgtttggtagcttattggatggactgggtccnccgagtccgtccgagggagggctgggagtgggtgccaacgatacgagggagggtggtaggtaaacgaaaaactntggtggactgtgtggcgggtccattcaccgtntcctacagacgacaaaccgaccaaaacgtcaacttgtatcgtagaccaaagtcgggaccgtccgtagaagacgtccggaaggcgaaccggtctaggtacgtagtttacgttggtgaccgaaggtagtagtttagaacttaacgtaaagtttcgagtcgtacgtgtatgtagtcg

SEQ ID NO: 115460 - DNA, 595 bp, Homo sapiens
  misc_feature: GYAE6OF01CTN6I.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtcctgcatcgtgtaggagacagagtcatcatcacttggccgggcaagtcgagggcattagaaatgtattaggctggtatcagcaagaaaccgagggaaacgacccctaagcctcctacatctagtggtgacactaccgtaagttaactaacggtcgggtaccctaagttaacgtacttacgagcggactaggtgatcgtgacacgtagtacttcactacctacaccatacgacgctacgcctgccacgtacgtagtaagttattttacgacttaacttacttacgttacgtacttaacctaagttaacttacctaaccgtttacccgttcggttaccggttaccggaccgaacgggtaacgtaagggtacggaacgtaacgaaacgtacgtacggtagctcgtcctaacg

SEQ ID NO: 115461 - DNA, 645 bp, Homo sapiens
  misc_feature: GYAE6OF01BJ15H.37.34.D01.1.454.CMB.1.raw
  modified_base (341)..(341): a, c, t, g, unknown or other
  misc_feature (341)..(341): n is a, c, g, or t
tcagtagtgtagatcacgaccggtgctcgatttagatcgtctgtgttgggttttccttgttgctattttagaaggtgtccagtgtgacgtgcaactggtggagtctggggggaggcttggtccagccgtggggggtccctgagactctcctgtgcagcctctggattcaactttggtagctattggatggactgggtccgccagtctccgagggaggggctgggagtgggtcggcaacatacgaggggaggtggtaggtaacgaaaaactgtggtggactgtgtggcgggccgtatcaccatctaccagagacaacgaccaaaaactcaactgtactcgtnacaagtgacggctagagactcgaggacacgctgtcgtattatgtgacgagagtattagactacgtaaagttcgagtgactgtatgtatgtacttagagtacgtaccggtaggggtaccaagggtaccctaggtcggtacctaccgttcgtaccttcgaccgtccccgtaccaacccggtaaccgggcccctagttccccggttacccttccccccggtacgggtccccgaccccgttcgacccggttacccggaacggtaccgaccccgtacccgacccggaagacccgtcgaacccgtccggg

SEQ ID NO: 115462 - DNA, 584 bp, Homo sapiens
  misc_feature: GYAE6OF01DYDAR.37.34.D01.1.454.CMB.1.raw
  modified_base (372)..(372): a, c, t, g, unknown or other
  misc_feature (372)..(372): n is a, c, g, or t
  modified_base (504)..(504): a, c, t, g, unknown or other
  misc_feature (504)..(504): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaactggggctccgctgggttttccttgttgctattttagaaggtgtccagtgtgaggtgcagctggtggagtcgtgggggaggcctggtcaagccgtggggacgtccctgagactctcctgtgcagcctctggattccaccttcagtagctatagcaatggaacgtgggtcccgccgaggcctaccgaggggaagggctgggagtggtctcatccattagtagtagtggtacttanatataactacgcagactgaggtggacgggctagttccacctatcccacaagacaacaaccgacaaacgactcactgtatcgtagaaccaaatacgaacacgtccgtaggaacgacggaccgaacgggaaccnccgggtacttaggttacgtttaagtttccgtggtaccggcggaacgaccgtccccctacccgtaaccctgaaccgtaccg

SEQ ID NO: 115463 - DNA, 1007 bp, Homo sapiens
  misc_feature: GYAE6OF01D4796.37.34.D01.1.454.CMB.1.raw
tcagtagtgtagatcacgaccggtgctcgatttagatcgtctgtgttgggtttgggggtctcaggagaggacgtccttacgcccgtaggacctaccgaacggttcccctttaccctacgtttgggtagtactcgacgccaacgtaggacgaccaacgaaggaacggtacctaccaaccgtaggtagggttaagggtttcggggcctaggtacgttcggtttttcgggttttttccctttggttcgtactttttaagttttaggggaacggttcgtaccgtaggttggtaggtaggtcgacttaaggttggggtacgggtacggttcggggtagggggaccgtcccgttccggtacccgacggttccccgggggttcgggggttcccctaggaaccgttaccttccgttccggttggttacgtaccgtccctttacgtaaccgtttaaccccgttttttaccccggtttaggttacttttagggttaggtagtacggcgttccgggttccgggtccccgaccggacgggtacccgtaaccgggggaaaggggggtacgggtcggttaggggacgggttggggtacctaaaccaaaagtaaaggtaaacggacgaaagggtaagtaaaggggtaaaagtaaaggggtaaaggttagttaggtcgggtacgtacgtttacggtagggaaccggggtaccggttttcccttaacccgaaccgttacgtaccccgtaaccggaaggaaccgtaaaccgaaccgaacccgtaaacgtacccgtcgtacgactacgtacgttacgaaactaacgtacgtaacgtaggttacgaaggaaccggaacggtaaccggaacgtaacgtaaccggttatttaacgtttacgtacggacggtacggacgggtaaaggaacgggtaacggttacgggttacggggttaccgttaacccggtaccggtaccgggggtacgggaacccggtaaccgggtacccgttcggtaccccgtaccccg

SEQ ID NO: 115464 - DNA, 777 bp, Homo sapiens
  misc_feature: GYAE6OF01A4ZQH.37.34.D01.1.454.CMB.1.raw
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtgggggtccctgagactctcctgtgcagcctctggattcaacttttgganctattggatggactgggtccnccagtctccgagggagggctggagtgggtgccaacatacgagggaggtggtaggtaacgaaaaacttgtgtaggtacctcgtaggtcggccgggggccgtatttcccgacctaattcctacccgaaggtaacgaaccgaaacccggaacccctaaaaaaactcccgtaaccgttacggttaacttaccgttacggaacctaaaaggtcggggaaaccccgggtcccgttaggaacggtaaccgttaccccgggaaacgggtaacccgaaccggggtaccccgttttaggggttaaggtttaaacgtttttaggtttacgggttacgggtacccgggtaaaggggttaaacgttaaagttttttaaccgggaaaacccttttaaaacccggtttaaaaacgggttttttaccgggtaagggtttaacgggtaaaccggttttaaggggtttaagtttaggttaacgtttaaccggg

SEQ ID NO: 115465 - DNA, 685 bp, Homo sapiens
  misc_feature: GYAE6OF01BY0IJ.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattgggggctgagcttgggttttccttgttgctattttagaaggtgtccagtgtgaggtgcaattggtggagtcgtgggggaggcctcgtccagccgtgggggtccctgagctctcctgtgtagcctctgaactttccccgttacggcttattggatgagcgtcggggtccgccgaggctaccggaggggaacggggcgtgggaggtgggtcggaccaacataaaagcaagatagggaaagtaaggaaggtagtatggtaggacttcgtggtaggaacgggtccgtttacacctatccgtacagaacgaacgaaccgaccaaacggtaacctccgtacgccattccgtacgaactaaagtacgaactaagttcgtaggaacggtacggacccggaacggggaaccgacgggttaccctttaagttttactttaccgaggtccggacggaagggaaaggtaacggggtacgttacgggggtccggtttaccggaacgttacgggtccggggaccgaccggggtaaccccgttggttacccgtaccccgg

SEQ ID NO: 115466 - DNA, 900 bp, Homo sapiens
  misc_feature: GYAE6OF01EOC41.37.34.D01.1.454.CMB.1.raw
tcagtagtgtagatcacgaccggtgctcgatttagatcgtctgtgttgggtttggggctcagagaggagccttagccctggactccaaggccctttccacttggtgatcagcactgagcacagaggactcaccatggaattggggctgagcttggttttccttgttgcttattttagaaggtgtccagtgtgacgtgcaactggtggagtcgtgggggagtcttggtccagccggtcggggggtccctgacgacctctccgtgtgcacgcccttcgtggtatttccaacgttttggtagtctaagtttggatggtaccgttcggggtccccgcccgtaggttccgtacccggaaggggggaaacgggggtcgtaggggaggttgggggtcggaccaaaccgagttaaaccggaagggggtaggggttggggtaacggggttaaaaaccggtaaaaaaacgttagtaggggttacgggtaaaccttccggttgggtaccgggggacccggggggtcccgtaacgttttaccccgaaccccgtaacttcccgttaccccgaacgggtaacgaacccgtaaaacccggaaacccccgaaaaaaaaccgttacctaaaccgttacgttaacttcccgttaacggaacctaaaacggttaccggggaaccggtacccgtaggaaccggacgttaaccccgggaaagggtaacccggtacccgggtaccgtttagggttaggttaacgttttaaggtttcggttaaccgggtaaccgggtaaaaccccgggtttaaaggggggggttttacgggaaacgggtacgttacggaccgggtaaggtccggggttaagggggtaggggttaacgggtttaaggtttcggggtttttaaggtttaacgggg

SEQ ID NO: 115467 - DNA, 315 bp, Homo sapiens
  misc_feature: GYAE6OF01CI3QT.37.34.D01.1.454.CMB.1.raw
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (309)..(315): a, c, t, g, unknown or other
  misc_feature (309)..(315): n is a, c, g, or t
tcagtagtgtagatcacgaccggtgctcgatttagatcgtctgtgttggggtttggggggaagaggaagactgacggtcctgccacaggtggtgctgaggaagagatggaggtggacgtgtcagcacccagctggggcctgtccctggtcaccgtctcctcagcctccaccgaagggcccatcggtccttcccctggccgccctgctccaggagccacctccgagacgcaacgacggccggcccgtgggctcgcctggtcaaggactcttcatctacactactgacgcgggctggcaaggcnctanagnnnnnnn

SEQ ID NO: 115468 - DNA, 730 bp, Homo sapiens
  misc_feature: GYAE6OF01CBFAQ.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgtctattttagaaggtgtccagtgtgacgtgcaacgtggtggagtcgtgggggagtcgttggtccaggccgtgggggtccctgagacctctcctgtcgcacgcccttgtacggtacttacgtaacgttttgggtaacgtcttaagtttgggacgttggaccgttcggggtcccgccgtacggtccgtaccggaggggaacgggcgtgggaggtgggtcgaccaagagtaacgaggggacggtagggtaggtaaacgaaaactgtggtacggactcgttagggtcggccggggtaccgtattcccgacctactcccgtacgaaggacgaaaccgtaaacccaaacccaaaaactccaacgtagttaacttcgtagtaacgtaaaacgtcgggaacgtaccgtaggaacgaacgtccggaacggaaccgtacggtccgttaggttacgttagttaagttggtacggtacggtaaggtagttaaacggtttaacgtaaaccgttaaaccgttaaagggtttaccggtaagttacggtacgttaagggtaacgttgggtaacgtttcgg

SEQ ID NO: 115469 - DNA, 610 bp, Homo sapiens
  misc_feature: GYAE6OF01EDNG5.37.34.D01.1.454.CMB.1.raw
  modified_base (397)..(397): a, c, t, g, unknown or other
  misc_feature (397)..(397): n is a, c, g, or t
tcagtagtgtagatcacgaccggtgctcgattttagatcgtctgtgttgggtttgggggttcggtcagagaggaggccttacgtcccgtcggacgtcccaacggaccgtttccctaccttggttggatcagcactgagcacagaggactcaccatggaagttgggcgtgagctggttttccgtttgttgctattttagtaaggtgtccagtgtgacgtgcaactggtggaggtcgtgggggagggcttggtcacggccgtggggggtcccgtgagacctctcctgtgcagcctctggattcaacgttttggtagcttagttggagtggacgttggggtccgccagttcgtccgaggggaaggggctgggaggtgggtggaccaacagtacgaggggnggtggtggtaacgaaaaatatggtaggactgtgtggcggggccgattcaccatctccagagacaacgacccaaaaactcactgtactcgtagacaaagtgggacggtcctaggagacgtacgacgggacacggtcgttgttagtagtttattggtggacgagtaggtatttaggaactagttaaagttgtagtagtactagggttatgtgtag

SEQ ID NO: 115470 - DNA, 739 bp, Homo sapiens
  misc_feature: GYAE6OF01CHRX9.37.34.D01.1.454.CMB.1.raw
  modified_base (177)..(177): a, c, t, g, unknown or other
  misc_feature (177)..(177): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (729)..(729): a, c, t, g, unknown or other
  misc_feature (729)..(729): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctggtttcctgtagctatttagaaggtntccagtgtgacgtgcaactggtggagtcgtgggggagcttgggtccaggccgtgggggggtccctgacgactctccgtgtgcagcctcgtggattcaactttggancttagtggactggacgtgggtccncctagtcgtccgaggggaacgggctagggaggtgggtaggacccaaagtacgtacgaggggtagggttaggtacggtaaacgaaaaacgttgtagggtacggtaacctccgttaggtcgggacccgggggtcgtaactttccgaacccgtataccgttacccggaaggaacggtaaccgtaaaccggtaaccctaaaaaccgtcgtaaaccgttgttaacgttccgttaggaactaaacggttacggaccggtacccgttagggacgaaccgtaccggaacgggacctacgggtcgttacggttacgttacgtttaagttcggttaggtaccggtaaggtaacgttaagtttaaccggtaacgttaaaccggttaaacggtttcggtaacggtttacggtaaacgttacgggttagttacgngtttaaccgg

SEQ ID NO: 115471 - DNA, 782 bp, Homo sapiens
  misc_feature: GYAE6OF01EFTCI.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccagtggaagttggggctggagtcgttgggttttccttgttgtcttattttagaaggtgtccagtgtgacgtgcaacgtgggtggagtcggtgggggaggtcgttcgggtccgacggtccggttcggggggtccctggacgtaccttccgttccgtggtcgcgacgtcctcgtaggtactttacgtaacgttttggtagtcgtagttggagtcggtacgtcggtccgccgtacgtccgtaccggaggggacgggtcgtagggtaggtcgggtacgaccgaacgtaggtacggagggtacgggtaggtaacggtaaaacgtaaaagttgtaggtacggtacgtcggtggtcggggccgggtaccgtacgttaccacctacgtaccgtaccgaacgaaccgaaccgaaacccgtaaaccctaaaaaccgtcgtaacgttacgttacgttacgtacggaaacgtaacggtacgggaaccggtacgtaggaacgtaaccggtaccggaacggtaccgtaccggttcgtttaggttacgtttaagtttcggtaggtacggtacggtaaagttaaggtttaaactttaacggaaacgtttaaacggttaacggtttaggtaacggttcgttaacggttaggttatagttacgttacgg

SEQ ID NO: 115472 - DNA, 813 bp, Homo sapiens
  misc_feature: GYAE6OF01DNG7W.37.34.D01.1.454.CMB.1.raw
tcagtagtgtagatcacgaccggtgctcgatttagatcgtctgtgttgggtttgggctcagagaggagccttagccctggactccaaggcctttccacttggtgtatcagcactgagcacagaggactcaccatggtattgggctgagcttggttttccttgttgcttattttagaaggtgtccagtgtgacgtgacaacgtggtaggagtacgtgggggaggtcttggtccaggccgtggggggtccctgacgtactctcctgtgcacgtcctgtggtacttcgtaacgttttggtacgtcttagttggatcgggtaccgtcggggtccccgcccgtaggtcccttaccggaagggggaagggggtccttaggggacgggttgggggtaccggacccaaacgtaacgttacggaagggggtaggggttagggttaacgggttaaaaccgaaaaaacgttgttacgggtacggtaccgttcgttacgggtcggcccggggggtaccctaagtttacccgaaccgtacgttaccgttacccgaacggaaccggaaacccgaaacccggaaacccctaaaaaaaccgtccgtaaacgttacgttaacttacgtacggtaacgtaaacggtcgggaaccggtccgttagggaacgtacggtaccggaacggtaccggtcggttacggttacggtttagttaactttaaggttcggtaggtaccggtaaggtaacggtaagttttaaacggaaacgtttaaacggtaaacggttttacgaacggttacggttaacggtaggttaagtggtagttacg

SEQ ID NO: 115473 - DNA, 554 bp, Homo sapiens
  misc_feature: GYAE6OF01AXCHT.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctggattcaactttggtagctattggatggactgggtccgccagtctccgaggggaggggctgggagtgggtggccaaacatacgaggggaggtggtagggtaacgaaaaacgtgtgtggactcgtggtcggcggggccgtattccacctatcctccagagaccaacgacccaaaaactcaactagtactctagacaaagtgggacggcctgagactaccggaggacgacggctgtgtattatgtgcgagagtattagactacgtaagttcgagtgacgtggtatgagtg

SEQ ID NO: 115474 - DNA, 706 bp, Homo sapiens
  misc_feature: GYAE6OF01B79Z9.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgcttattttagaaggtgtccagtgtgacgtgcaactggtggagtcgtgggggagcttggtccaggcccgtggggggtcccctggagacctctcctgtcgcagcctctggattcaactttggtatctattggatggactgggtccgccagtctccgaggggaagggctgggagtgggtgaccaacataacgaggggaggtggtaggtaacgaaaaacgtgtagtggtactcgtgtcggcggggccgtagtttccaaccgacttaccgtcccgaaggaacggtaaccaaacggaaaccccaaaaaacgtccaaccttaggttaactccgtagaaccgtaaacgtgggaacccgggtcctaggaacggaacgtacccgggagggaaccgaccgggtaccgtttaggtacggtttagttaaggtttacggtacgggaccggtaaggtaaaggttaacgttttaacggaaaccgtttaacgttaaaagggttttacgtaagggtttacggtaacgttaacggtttagtacggttaagtttacgg

SEQ ID NO: 115475 - DNA, 849 bp, Homo sapiens
  misc_feature: GYAE6OF01BS5IW.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtgggggggtccctggagactctccgtgtgcgacgccttcgtggtacttactaaccgttttgggtaagctttaagttgggtacgtacggggtacgttcgggggtccccgaccgtaacggttcccgtacccggaaagggggggtaaacgggggtccgttaggggtagggttcgggggttacggacccgtaaaacgtaaaacgttaaccggtaaaggggggtagggggttacggggttaacggggttaaaaaaccggtaaaaaaaaccgtttaggttacggggttacgggtaaccttcggttagggtccggggtacccggggggtaccgtaacgttaccgaaccctacgttccctaccggaagacgaaaccgtaacccgaaaccctaaaaacgtcctaacgttagtaactccgttacgaacgtaaacgtaccgggaaccggtaccgtaggacgtaacgtaaccgggacggaaccgtacgggtccttaggttacggtttaaactttgggttaggtaggttacccgggtaaaggttaacgttaaagtttaacgtaacccgttaaaggtttaaaacgtttaccggtaaggttacgtacggttaggttaactggtagtttacgg

SEQ ID NO: 115476 - DNA, 746 bp, Homo sapiens
  misc_feature: GYAE6OF01EEM3H.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagcttggttttccttgttgctattttagaaggtgtccagtgtgacgtgcaacgtggtggagtcgtgggggaggcgttggtccagccgtgggggtccctgagactctcctgtcgcacgcctcgtggatttcgaacgtttggtagcttagttggagtggacgttcggggtcccgccgtaggttccgtaccggaggggtaaggggctgggaggtgggtcgaccgaacagtacgagggaggttggtaggtaaacgaaaaacgtgtcgtggacttcgtggtcggaccggggtccaagtttccaaccctacgtcctaccgacgaacgaacgaaaccgaacccctaaaaacgtcctaacttagttacgtactacgtaacgtaaagtacgggtaaccggtaccttacgggacggtaacgttacccgggaacgggaacccggtaacgggtaccgttggttaacgtttaacgttttaaggttcgggttacggtaccgggtaaggtttacggttaaacgttttaaggtaaacctttaaaacggttaaaacgggttttacggtaaacgggttacgtaaacggtttaaccgggttaattaggtaagttaacgg

SEQ ID NO: 115477 - DNA, 694 bp, Homo sapiens
  misc_feature: GYAE6OF01AZRS8.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaacgtggtggagtcgtgggggagcgttggtccaggccgtcggggggtccctggacgacctcctcctgtgcacgcctcgtggtattactaacgtttggtgtaaaaaaaaaaaacttgttaggtagtggtacgtcgggtccgccgacgtccgtccggagggaagggcgtgggaggtgggtcggaccgaacgagtacggagggtaggtaggtaggtaaacgaaaacgtaagtagtaggtacgtcgtacggcggcgggaccgtacgttacctacctactcctaccgacgaacgaacgaaccgaaacccaaaacctactaacgtagtacttactacgtacgtaaacgtacggtaccggtacgtacgagacgtaccggaacggaccgtacggtacgttagttagttagttagttggtagtacgtaaggtaagtaagtttaacggtaacgttaaacgttaaacgtttacgtacgttacgtacgttaggttacgttgtagtacg

SEQ ID NO: 115478 - DNA, 758 bp, Homo sapiens
  misc_feature: GYAE6OF01BEUSI.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttcctgttgctattttagaaggtgtccagtgtgacgtgcaactggtggagtcgtgggggagtcttggtccagccgtgggggtccctgagactctccgtgtgcagcctcgtggtattctaacgtttggtagtcttagttggagtggacgttcggggtcccgccgtagtccgtaccggagggggaacggggtcgttaggggaggttggggtacggaccccaaaacgtagtaaccggaagggggtaacgggttagggtaacgggtaaaaccgtaaaaaaacgttgttacggtacgggtaacctttcggtgggtacgggcccggggggtaccctaacgtttccgaacccgtattcccgtaccgaaggaaccgaaccaaaccgaaaccctaaaaaaccgtcgtaacgttagtactaccgtacggaaccgtaaagtcgggaccggcgtaggacgtacgtaccggaaggaccgtacggtcgttaggttacgttaagttacgttcggtacggtaccggtaaggtaaggttaactttaacgggaacgttaaacgttaaacggtttacggtaaggttacggtaacgttaggtttaacgtaggtaagttacgg

SEQ ID NO: 115479 - DNA, 835 bp, Homo sapiens
  misc_feature: GYAE6OF01DJEIB.37.34.D01.1.454.CMB.1.raw
tcagtagtgtagatcacgaccggtgctcgatttagatcgtctgtgttgggtttggggctcagagaggagccttagccctggactccaaggccctttccacttggtgatcagcactgagcacagaggactcaccatggaagttggggctggagtcgttgggttttccttgttgtcttaattttagaaggttgtccagtgtgacgtgactaacgtggtggagtcggtgggggagtcgttggtccgaggtccggtcggggggtccctggacgtaccttctccgtggtgccgacgtcccttcgtgggtactttaccgtaacgttttggtagcgttagttgggattgggacgttcgggtcccgccagttccgtaccggaagggaacggggcgtgggaggttggggtcggaccaaacgtagtacggaagggtaggttgggtaaggtaaaacgtaaaaacgttggttagtacggtaactcgttgggtcgggtacccgggggtacctaaacgtttcccgaaccctaagttcccgtaacccgaacgggaacgtaaaacccgaaacccggtaaacccctaaaaaaacgttcccgtaacttacggtaactacgtaacgaaccgtaaagtccggggaccgtcgtacggaacgtaaccggtaccgaacgggaacctaaccggggttcttagggttaacgttttaagttaccggtttaggtacggtaacccggaaaggttaacggtttaaacgttttaaacgggaaaaccttttaacccggtttaaaaggtttaacccggtaggttaaccggttaaacgggtttaggttaagttaggtaggtttaacgg

SEQ ID NO: 115480 - DNA, 722 bp, Homo sapiens
  misc_feature: GYAE6OF01CC9TP.37.34.D01.1.454.CMB.1.raw
  modified_base (187)..(187): a, c, t, g, unknown or other
  misc_feature (187)..(187): n is a, c, g, or t
tcagtagtgtagatcacgaccggtgctcgatttagatcgtctgtgttgggtttgggggcaggagtcagacccactcaggacacagcatggacatgagggtcccccgctcagctcctggggctcctgctgctctggctcccaggtgccagatgtgccataccaaatgacccagtctccatccctcccngtctgcatcgtgtaggagactagagtcatcaatcacgttcggaccgggacaaagtccgagggtactaagttaagtaaattaggtaagttttagggccgttaggtactacgacgacgaacgaaaaccggaaggggaaaccgacccctaagccttaccctactaactttccgtaagtcgggtactacgtaacttaccgtaaacgtttaacgtaaaaccggttcggggttaaccctaagtttaaagacgtttacacggtcggtacgtagggtacgtacgttcgtacggaccgacgtaacgttactttaccactacctacctaaccgtattaccgaacgtaccaccggtcctcgaccgtacgtaccgtaagttaagttagtttacgactttaaactttacttacttacgtacctaacgtaacgtaacttacttaaccgtacccgtaccggttaccgtaccgggaaccgtaaacgggtaaccggtaaggtcggaaacgtaaaccgtaacgtacgtaggtacgtaccgcctacgtaacccg

SEQ ID NO: 115481 - DNA, 539 bp, Homo sapiens
  misc_feature: GYAE6OF01BTCN5.37.34.D01.1.454.CMB.1.raw
  modified_base (284)..(284): a, c, t, g, unknown or other
  misc_feature (284)..(284): n is a, c, g, or t
  modified_base (447)..(447): a, c, t, g, unknown or other
  misc_feature (447)..(447): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccaggcctggggggtccctgagactctcctgtgcagcctctggattcaactttggtanctattggatggactgggtccgcagtctccaggggaaggggctgggagtggggtggccaaacatacaggggaggtggtaggtaacgaaaaaactgtagtggaactcagtggcgggggccattccaccatctccagagacaacgaccaaaaactcactgtatctncaaatggacgcctgagataccgaggacacggctgtgtattattgtgcgagagtatttagactacaaagtttcgaggtgactggtatggatag

SEQ ID NO: 115482 - DNA, 788 bp, Homo sapiens
  misc_feature: GYAE6OF01CQINX.37.34.D01.1.454.CMB.1.raw
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (494)..(494): a, c, t, g, unknown or other
  misc_feature (494)..(494): n is a, c, g, or t
tcagtagtgtagatcacgaccggtgctcgatttagatcgtctgtgttgggtttgggggcaggagtcagacccactcaggacacagcatggacatgagggtcccccgctcagcctccgtggggcctcctgctgctctggcctcccgaggtgccagatgtcgccataccaaatcgacccagtcctccactccctccctgtcctgctatcgtagaagganacagatcatcatcgacgtcgccgganagtcgaggactaataagaatgtaagttaggctaggtatacgacgacgaaacggaaaaccggaacgggaaacctacccgtaacgtccttaccctactaactaccgtaagtcggtactacctaacgtacctttaaacggttaacgaaaccggttccgggtaaaccttaaagttaaggaacttacgaacggtccggtagtaggttacgtacgttacgacggactaacgtagtacctttacaacttccactaacncgtaccacgacgtaccgccgtacgaccgtacggtactaaggtaacgtttactttaacgaaccttttaaacgttaacttccccgtaaagttacctaaaagtaccgtttaaacttaaacccggttaacccgtttaacccccgggttacgggttaaaccgggttaaccccgggaaaaccgggtaaaacggggttaaacccgggtaaacgggttaacgggtaaaaccgtaaaaccgggtaaaccggtttaaaccggcggtttaaccgggacccttaaccgggaacccctttaaaccgg

SEQ ID NO: 115483 - DNA, 710 bp, Homo sapiens
  misc_feature: GYAE6OF01EJWN5.37.34.D01.1.454.CMB.1.raw
  modified_base (198)..(198): a, c, t, g, unknown or other
  misc_feature (198)..(198): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccnccagtctccagggaaggggctggagtgggtggccaacatacgagggaggtggtaggtaacgaaaaactgtgtggactctgtggcggggccgattcaccatctccagacgacaacgaccaaaaactcactgtatctgacaaagtcggacggctagagactccggaggacacggctgtgtattagttgtgcgagagtatttagactaagtaaagtttcgagtgactggtatagtatgtacttagtcgtaacgtaccggtacgggggaccgtaaacggggaccctaaggttcggtacccgtacccggttccttcgtttacccgacgtaccccgttaccccgaacccggtaaccgggtaccccgtacggttccccggttacccccgtttcccccccggtacgggtccccccggtcccccgttacggtcccccgttacccgggaacgggtacccggtaccccgtaacccccggttacccggaaacggtacccggacccgaaccggtaaccccggggg

SEQ ID NO: 115484 - DNA, 617 bp, Homo sapiens
  misc_feature: GYAE6OF01CJNIV.37.34.D01.1.454.CMB.1.raw
  modified_base (581)..(581): a, c, t, g, unknown or other
  misc_feature (581)..(581): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgaggggaaggggctggagtggggtggccaacatacgaggggaggtggtaggtaacgaaaaaactgtggtggtactctggtggcggggccgattcaccatctccagagacaacgaccaaaaactcactgtatctagacaaagtggacgcctagagacgtccgaggacgacggcgtgttagtaacgttagttgtgcgagtagtaagtttagtactaactaaggtttcgagtgacgttggtatgaattgtacttagtgtacgtaccggtaggggacccgaagggtaccgtagtcgggtacctaccgttcgtcttccgacgtccctaccgaaccgtacggaccctcgtaccgttttcccgccccgtggcccgccgtcnccgtccgacgcgccacccgtacgagacgcgacgccg

SEQ ID NO: 115485 - DNA, 562 bp, Homo sapiens
  misc_feature: GYAE6OF01AXMIZ.37.34.D01.1.454.CMB.1.raw
  modified_base (377)..(377): a, c, t, g, unknown or other
  misc_feature (377)..(377): n is a, c, g, or t
  modified_base (512)..(512): a, c, t, g, unknown or other
  misc_feature (512)..(512): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtcccgtgagactctcctgtgcagcctctggattcaactttggtagctattggatggactgggtccgccagtctccagggaaggggctggagtgggtggccaacatacaggggaggtggtggtacgaaaaactatgtggactctgtgcggggccgattcaccatctccagaagacaacgccaaaaactcactgtatctgcaaagtggacgcctgagatccggaggacacggctgtgtattattgngcgagagatttagactacaaagtttcgagtgactggtatgatgcttatgatccgtgggaccaagggaccagtcggtccacgttctcctcccgacgtccctaccaaccgacggccccagtccgtcccttcccccgnggcccgccctgccgtcccgaggcaccacccgtacggagcgccgacgacgg

SEQ ID NO: 115486 - DNA, 740 bp, Homo sapiens
  misc_feature: GYAE6OF01CE01B.37.34.D01.1.454.CMB.1.raw
  modified_base (153)..(153): a, c, t, g, unknown or other
  misc_feature (153)..(153): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
  modified_base (407)..(407): a, c, t, g, unknown or other
  misc_feature (407)..(407): n is a, c, g, or t
tcagtagtgtagatcacgaccggtgctcgatttagatcgtctgtgttgggtttgggggcaggagtcagacccactcaggacacagcatggacatgacgggtcccccgctcagctccgtggggctcctgctgctctggctcccgaggtgccagntgtgccataccaaatcgacccagtcctaccactccctccgtgtcctgctatcgtagtaggagacagntcatcatacncgttgggaccgganaaggtcgaggctaagttaagaagtgtaagtttagggctaggtancgaagacgaaggtaaaccggaggtaaccgaccctaaggcctaccgtactaacttcgtagtggtacacctacgtaccgtaaagttaccggaaaccggtccgggttaaccaaagttaacgngttcgaacggtacgtcggtaaggtgtactacggtcgatacgtagttaacttccgaacttcctacgaactacgtagaccgacaccggtctcgtaaccgtacgtaccttaagggtaacctttagtttaaccgaactttaaccgtttactttacggtaaccgttataaaccggtaaactttaacccttaaaccgtttaccggttaacccgttccggggttaaacgtttaacccccgggaacgggtaaacggttaacccgggtaacggggtaacggaaaccttaaccccgaaagggtttaccgacggggttaccgtcaaccgggttacctaaccggg

SEQ ID NO: 115487 - DNA, 829 bp, Homo sapiens
  misc_feature: GYAE6OF01ESQG0.37.34.D01.1.454.CMB.1.raw
  modified_base (183)..(183): a, c, t, g, unknown or other
  misc_feature (183)..(183): n is a, c, g, or t
  modified_base (205)..(205): a, c, t, g, unknown or other
  misc_feature (205)..(205): n is a, c, g, or t
tcagtagtgtagatcacgaccggtgctcgatttagatcgtctgtgttgggttttccgttgttgctattttacgaaggtgtccgagtgtgtacgtgccaactggtggagtctgggggaggcttggtccacgcctggggggtccctgagacctctcctgtgcagctctggattcaactttggtanctttatggatcggactggtccncagtctccgagggagggctggagtggtgaccaacatacgagggaggtggtaggtaacgtaaaaacgtgtggtacggactcgtgtcggcggggccgagttcaccgtagttctccgaagacgaaccaaacggtacctaaaaaacgtccgtaacttggttaagttcgttaggacctaaaacgttgggaacccggtcccgttaggaacggaacgttacccggaacgggtaaccgaaccgggtacttacggttaacggtttaaacttttacgtttacgggttaacggtaaccggtaaggtaacgggttaacgttttaaacggaaaccgtttaaacggttaaaacggtttttacgggaaacggttaggtaacccgtttagggtaagtttacggtaacgttacgggttacttaagtttacgttaagtaccggttacgggtaccgggaacgtaaccgacgtaccggtacgtacccgtaccttaccttaccgtcgtaacccgtacccgtaaccgaccggtaccgtacccgtaccggttacccgttccccggtacccgtccgggtccccgtaccgtccgtccgaccggtacgcccgtacccttacccggagtacccggacgaccgtaccccggg

SEQ ID NO: 115488 - DNA, 759 bp, Homo sapiens
  misc_feature: GYAE6OF01EKDLH.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgagcttgggttttccttgttgcttattttagaaggtgtccagtgtgacgtgcaactggtggagtcgtgggggaggtcgttggtccaggccgtcggggggtccctggacgacctctccgtgtcgcgagcctcgtggtattctaacgtttggtacgtcttagttggatcggtacgttcggggtcccgccgtagttccgtaccggaagggggaacggggtcgtggggaggttgggtcggaccctaaacgaagtaacggaggggaggtcggtaacgggtaaaacgaaaaacgttgtaggtcggtaactcgtaggtcgggccggggtacctaagttccaacccgtatcccgtaccgaaggaaccgtaaaccgaaaccgaaacccctaaaaactcctaacgttaagttaacgttacgtacgaaactaaacgtccggggaaccgtaccgttagggaacgtaaccgtacccgggaaacggaaccgtacggtaccgtttagttaggttaacttttaaggttggtaacggacggtaaaggtaacgtttaagtttaaacggacttaaacggttaaacggtttcgaacggttacgtacggttaggttaacttggtaagttacgg

SEQ ID NO: 115489 - DNA, 692 bp, Homo sapiens
  misc_feature: GYAE6OF01CQ38S.37.34.D01.1.454.CMB.1.raw
  modified_base (183)..(183): a, c, t, g, unknown or other
  misc_feature (183)..(183): n is a, c, g, or t
  modified_base (371)..(371): a, c, t, g, unknown or other
  misc_feature (371)..(371): n is a, c, g, or t
  modified_base (600)..(600): a, c, t, g, unknown or other
  misc_feature (600)..(600): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtntccagtgtgacgtgcaacgtggtggagtcgtgggggagcttggtccagccgtggggggtccctgagactctcctgtgcacgcctcgtggtattctaacgtttggtacgtcttagttggatgggacctcgggtcccgccagtcctaccggagggggaacgggcgtgggaggttggggtcggacccaaanagtaaccgaggggtaggttgggtacggtaaacgaaaaaacgtgtaggtaggtactcgttgggtgggccggggtaccgtatttacccgacctattccaccgaagacgaaccaaaccgaacccaaaacgttcaacgtagtactacgagactaaagtcggaaccgtctaggaacgtacgtaccggacggaaccggacggttagttacgggttaagtacgttttaagttcggnggtaaccgtaggtaaggtttaactttaaggaaactttaacggttaaaaggtttcggaagttacgggtaacgttagggtaattgtagtttacg

SEQ ID NO: 115490 - DNA, 750 bp, Homo sapiens
  misc_feature: GYAE6OF01BCKU9.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtggggggtccctgagactctcctgtgcagcctctggattcaactttggtagctattggatggactgggtccgcagtcgtccgaggggaagggctgggagtgggtgaccaacgtataacgaggggaggtgggtaggttaaacgaaaaaacgtagtagtacgggaactcgttggtcgggcccgggggtaccgagtttacccgaacccgtattcccgttaccgaacggaacgaaccgtaaaccggaacccctaaaaaaaaccgttcaaacccttaggttaaacttaccgtaggtaacctaaaagttcgggaaacccgggtcccgtagggtaacggtaacgtaccccgggtaacgggaacccgtaaccgggtccgtttaggttacggttaatttaacgtttaggttacggtaccgggtaaaggtaacggttaaagttttaacggtaaacccttaaaacgttaaaacgggttttaccggtaaggttacgtaacggttaacggttagttaggtaacgttacgg

SEQ ID NO: 115491 - DNA, 824 bp, Homo sapiens
  misc_feature: GYAE6OF01DCJKM.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaacgtggtggagtcggtgggggagtcgttcggtccaggcccgtcggggggtccctgacgacctctcctgtgcacgcctcgtggtatttcctaacgttttggtagtcttagttaggagtcgggtaccgttcgggggtccccgaccctaggttccgtaccggaaggggggaacggggtcgttggggagggttggggttcggaacccaaacgtaagtaacggagggggtaggttgggtagggttaaaacgaaaaaacttgttaggtacggaacttcgtagggtcgggacccgggggtacctacgtttacccgaaccctacgtcccgtaacccgtaaggaaccggaaacccgaaaaccccggtaaacccctaaaaaaacccgttaccgtaacccgtttaacggtttaacgttaccgttacggaaaccgtaaaacggttccggggaaacccggtcccgtttaagggaacggtaaccgttaccccggggaaacgggtaaacccgaccgggtcgttacggtttaggttacgttttaggttccggtaggacggtaaggtagttaagtttaacgtaacttaaacggtaaacggttttggaacgttaggtaacgttaggtaacttggtagttacgg

SEQ ID NO: 115492 - DNA, 725 bp, Homo sapiens
  misc_feature: GYAE6OF01DL9EN.37.34.D01.1.454.CMB.1.raw
tcagtagtgtagatcacgaccggtgctcgatttagatcgtctgtgttgggtttggggctcagagaggagccttagccctggactccaaggccctttccacttggtgatcagcactgagcacagaggactcaccatggaattggggctgagctgggttttccttgttgcttattttagaaggtgtccagtgtgacgtgcaactggtggagtcgtgggggagcttggtccagccgtgggggtccctgagctctcctgtgcagcctctggattctaacgttttggtagtcttagttggatggacgtcggggtcccgccacgtccgtaccggagggggaacggggcgtggggaggttggggtacggaccgaaacgaagtacggaggggagggttgggttaggtaaaaccgtaaaaaacgtgttaggtacggtacttcgtaggtgggcccggggacccgtagtttacccgaaccctacgttccctaccgaagaacgaaccgaaacccgaaaccccaaaaaaccttcctaaaccgttagttaacttacgtacggaacgtaaaacgttcgggaaccggcccgttaggaacgtaacgtcccggaagggacgacggtcgttggttagttagtttagttgtgtacggtaaggtagttaaagtttaacggaacttaaacgttaaaacggttttaccgaaggtttacgtaacgttaggttaacgtgttaagttacgg

SEQ ID NO: 115493 - DNA, 335 bp, Homo sapiens
  misc_feature: GYAE6OF01EXIM4.37.34.D01.1.454.CMB.1.raw
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (303)..(335): a, c, t, g, unknown or other
  misc_feature (303)..(335): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtccaccgtctcctcagcctccaccaagggcccatcggtccttccccctggcgccctgctccaggagcacctccgagagcacagccggccctgggctgccgtggtcaagctacttccatctacactacngagcgggcnggacaaggccgntantagnnnnnnnnnnnnnnnnnnnnnnnnnnnnnnnnn

SEQ ID NO: 115494 - DNA, 571 bp, Homo sapiens
  misc_feature: GYAE6OF01B5IFQ.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttcctgttgctattttagaaggtgtccagtgtgacgtgcaactggtggagtcgtggggggaggcttggtccagccgtgggggggtccctgagactctcctgtgcagcctctggattcaacgtttggtagctagttggatggactgggtccgccagtctccgaggggaagggctggagtgggtgccaacatacgagggaggtggtaggtaacgaaaactgtggtggactgtggtggcggggcgattcaccatctcagagacaacgaccaaaactcacttagtatctagacaagtggaccggctagacgactaccggaggaccgtacggcttgtagtatttagttgtcggacgtaggagtagtttaagaacttaacgtaaagtttcgaaggtagtacgttaggtatgtagttacg

SEQ ID NO: 115495 - DNA, 769 bp, Homo sapiens
  misc_feature: GYAE6OF01B5EEY.37.34.D01.1.454.CMB.1.raw
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
tcagtagtgtagatcacgaccggtgctcgatttagatcgtctgtgttgggttttccttgttgctattttagaaggtgtccagtgtgacgtgcaactggtggagtcgtgggggaggcttggtccagccgtggggggtccctgagactctcctgtgcagcctctggattcaactttggtagctattggatggactgggtccgccagtcctccgaaggggagggctgggagtgggtcgaccaacatacgagggnggtggtaggtaaacgaaaaactgtggngactcgtgtggcgggctattcaccatctcgaagacgacaacgaaccaaaaactcaacttgtactcgtagaacgaaagtcggacgtaccgtagacgacgtaccggaagaccgacgtcgtagttgttaattagtgtgacgaagtagtaattagaacttaacgtaagttcgagtagtacgttaggtatacggtatagtacgttagtagtaacgttaccccgggtagggaacccggtaaacgggtaccgtacgtaccgggttacccgtaacccgtttccttaccgtaacccgtaccgtaacccccgttaaccgaaaccccgggtaacccgggtaccccgtttaacccggttaccccgggtttcccccgttcccccccgggtaccgggttccccccggttacccggttcccgtacccggtacccggaaccgggtaaccgacccccgtaaccggtaacccggaaccgaacccggtaccgacccgggtaaccccgggg

SEQ ID NO: 115496 - DNA, 620 bp, Homo sapiens
  misc_feature: GYAE6OF01BLY4R.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattgggctgagctgggttttcctgttgctattttagaagtgtccagtgtgacgtgcaactggtggagtcgtgggggagcttggtccagccgtggggggtccctgagactctcctgtgcagcctctggattcaactttggtagctattggatggacgtgggtccgccagtctccgaggggaagggctgggagtgggtgccaacatacgagggaggtggtggtaacgaaaaacgtgtgtaggactcgtggtcggcggggtccagttccgacctacgtcgtccgagacgaaccaacgacccaaaaactcactacgtatcgtagacgaaagtggacggtcgtacgaggacgtaccggaaggaccgacggtccgttaggtgttacgttagttggtacggtaccggtaagtaagtaagttttagaaccgttaaacgtaacggttttaccggaagttacggtaacgttagggttaatggtagttacgg

SEQ ID NO: 115497 - DNA, 371 bp, Homo sapiens
  misc_feature: GYAE6OF01DOH2V.37.34.D01.1.454.CMB.1.raw
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (358)..(371): a, c, t, g, unknown or other
  misc_feature (358)..(371): n is a, c, g, or t
tcagtagtgtagatcacgaccggtgctcgatttagatcgtctgtgttgggtttggggggaagaggaagactgacggtcctgccacaggtggtgctgaggaagagatggaggtggatgtgtcagcacccagcgtggggcctgtccctggtccaccgtctcctcacgccctcccaaccgaacgggccccattcccgggtcccttccccccgtggccgcccctgcctcccgaggacgcctaaccctccgaagacgaccacgaggcccggccctggggcctgtcccgtgggtacaaaacggtaccttaaccttccaatcctaacacctacgtggagcgggtcnggacaacggnactaanagnnnnnnnnnnnnnn

SEQ ID NO: 115498 - DNA, 614 bp, Homo sapiens
  misc_feature: GYAE6OF01BZZPN.37.34.D01.1.454.CMB.1.raw
  modified_base (307)..(307): a, c, t, g, unknown or other
  misc_feature (307)..(307): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtcccctgagactctcctgtgcagccctctggattcaacttttggtagctattggatggactgggtccnccagtctccgaggggaagggctggagtgggtggccaagatacgagggaggtggtaggtaacgaaaaactgtgtggactctggtgcggggccgattcaccatctccagagacaacgacccaaaaactcaactgtactctagacaaagtggacggcctagacgacgtacccggaggacccgaacgggtccttaggtacggttatttagttgggtaggccgtaaaggtaggtacgtttttaaggaaccttaacgttaaaacggttttacccggaggttacggtacgttaggggttaattaggatttacgg

SEQ ID NO: 115499 - DNA, 681 bp, Homo sapiens
  misc_feature: GYAE6OF01A8DYD.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtgggggtccctgagctctccgtgtgcagcctcgtggatttcgaacgttttggtagcttagttggatggacgtggggtccgccaggtcctccgaggggagggctgggagtgggtggccaacgagtacgagggtaggtggtaggtaacgaaaaacttgtgtacgggacttcgtaggtcggccggggtaccgtacgttccacccgtatccgtaccgaagaacgtaaccaaaccggaaccctaaaaacctcctaacgttacgtactacgtacgaactaaacgtcggaaccggccgtaggaacgacgtaccggacggaaccgaccggtcgttcggttagttacgttagttggtcgacggtaaggtaacgtaagtttaacgtaaccgttaaacgttaaacggtttacggttaacggttacgttaccggttaggttaacttggtagtttaaccgg

SEQ ID NO: 115500 - DNA, 842 bp, Homo sapiens
  misc_feature: GYAE6OF01D2TKL.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgagtcgttgggttttccttgttgtcttattttagaaggtgtccagtgtgacgtgcaacgtggtggagtcggtgggggagtcgttggtccgaggcccggttcgggggggtcccctaggaacggtaccttccgttccgttggtcgacctacggtcccttcggtagggtaacttttaccgtaaaaccgtttttgggtaacgtctttaaggttggtaagttcgggaaccgttcggggtccccgtccgtaacggttccgtacccggaaggggggaacggggtccgttagggggaaggttcgggggtacggaccctaaaacgaagtaacggaggggtaggggttaggtaacgggtaaaaccgtaaaaaaacgttgtagggtacggaacttcgtaggtcgggcccgggggtacctagttcccgaaccattcctaccgaagtaacgaaccgtaaacccgtaaacccaaaaacctcgtaacgttacgttaactacgtacgaacgtaaaggtcgggaacccggtccgtaggaacggtaccgtacccgggaacggaacccggtacgggtaccgtttggttaacggtttaactttcggttaggtaccggtacggtaaaggttaacgttaagttttaacggaaaccttttaaacggttaaaacggtttggtaaagttcgtaaacggttggtaacgttgtaacgttacg

SEQ ID NO: 115501 - DNA, 897 bp, Homo sapiens
  misc_feature: GYAE6OF01B2K9I.37.34.D01.1.454.CMB.1.raw
  modified_base (214)..(214): a, c, t, g, unknown or other
  misc_feature (214)..(214): n is a, c, g, or t
  modified_base (257)..(257): a, c, t, g, unknown or other
  misc_feature (257)..(257): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgtggtttcgtgtagctatttagaaggtgtcagtgtgacgtgcaactggtggagtcggtgggggngtcttggtccgaggccgtgggggtccctggacgctctccgtgngcacgtctcgtggtactttctaacgtttgggtactacgttagttcggaagttcgggtaccgttacggggtccgacccgttaagggtttccctaccgggaaaagggggggtacggggtccgtagggggtaacggggtttacggggtccgggtaacccccgaaaagtaacgggtttaacgggaacgggggggtacggggttaaggttaaaccgggggttaaaaaccgtaaaaaaacggttggtttcggggtaacggtaaccgtttccggtaggggttcggggcccgggggtaaccgttaacttcccgtaaccgtaaccggtttccccgtaaccggtaacgggtaacgaaacccgttaaacccgtaaaacccccgaaaaaactttcccgtaacgtttaacggttaccttacgtaaacggaacccgttaaagggtaccgggtacccggttaacgtacggaacgtaaccgggttaacccgggaggtaaccccgtaagggtccttaggggtttaggttacttttaagggttgggacggtaccggttaaagggtaacgtttacgggtttaacgtaaccgtttaaaacggttactttacggggacgttaacggtaggttaaacgggtttgtaacgggtgttaacccgg

SEQ ID NO: 115502 - DNA, 922 bp, Homo sapiens
  misc_feature: GYAE6OF01BVJHW.37.34.D01.1.454.CMB.1.raw
tcagtagtgtagatcacgaccggtgctcgatttagatcgtctgtgttgggtttgggctcagagaggagccttagccctggactccaaggcctttccacttggtgatcagcactgagcacagaggactcaccatggaattgggctgagcttgggttttccttgttgtcttattttagaaggtgcctagtgtgacgtgcaacgtgggtggagtcggtgggggagtcgttggtccaggtccggtgggggtccctgacgtctctccgtgtcgcagtccctgtggtattacgtaacgtttgggtactcttagttggagtcgggacgttcggggtccccgccgtaacgttccggtaccggaagggggtaacggggtcgtaggggtaacgggttcggggtaccgaacccgtaaaacgtaagttaaccgggagggggtaacggttacgggtaacggtaaaacgtaaaaacgttcgtagggtacggtaaccttcgtagggtacgggacccgggggtaccttaacgtttcccgaaccgtaacgttccccggttaacccgaaacggtaaaccggtaaaaccccgaaacccggtaaaaaccccaaaaaaaccgtttcccgaaactttaacggtaaccttacgtaacgaaaaccgggtaaacggttaccggggaacccggttacctaaacggggtaaccggtaaccgggttaaccccggaaacggggtaacccggtaaccgggtttaccggtttaagggttaacggtttaacgttttacggttaaccgggtaaggtaccgggttaaacgggttaaacggtttaacggttttaaaaccggtaaaccggtttaaaccggttaaaacgggttttaaccgggaacggtttaaccggtaacgggtttaaagggttagttaacgggttattttaaaccggg

SEQ ID NO: 115503 - DNA, 746 bp, Homo sapiens
  misc_feature: GYAE6OF01BNK92.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagtgtgacgtgcaactggtggagtcgtgggggagtcttggtccagccgtgggggtccctgagctctcctgtgcagcctcgtggtattcaacttttggtagcttagttggatgggacgttggggtcccgccgagtcctccggagggggaaggggtctgggaggtcggggtcggacccaacgtaagtacggaagggtagggttaggtagggtaaacgaaaaaacgttgtaggtggtacttcgtgggtcgggccgggggtaccgtactttcccgaacctaacttcccgtaccgaaggaaccggaacctaaacccggaaaccctaaaaaacctcctaacgttacgttaactcgttagaactaaaaggtcgggaaccggtccgtaggagtaccgtaccggaacggaccgaacgggtccgttaggttagttattttaacggttggttacgggacggtaagggtaacggtttaacgttttaaacggtaaaccgttaaaccggttaaacggttttccgggaaaggttttccggaacgggtttaaggtacgtttaggtaagttttaccgg

SEQ ID NO: 115504 - DNA, 337 bp, Homo sapiens
  misc_feature: GYAE6OF01BM6U2.37.34.D01.1.454.CMB.1.raw
  modified_base (242)..(242): a, c, t, g, unknown or other
  misc_feature (242)..(242): n is a, c, g, or t
  modified_base (321)..(337): a, c, t, g, unknown or other
  misc_feature (321)..(337): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcacgcctcccaaccgaagggccccagtccggtccttcccccctggccgcccctgctccgaggacgccacctccgagagccaacnggccggcccgtgggctgcctggtcaaggactacttccatctaacgactactgagcgggtctggacaaggcgacagtagnnnnnnnnnnnnnnnnn

SEQ ID NO: 115505 - DNA, 474 bp, Homo sapiens
  misc_feature: GYAE6OF01DH4F0.37.34.D01.1.454.CMB.1.raw
  modified_base (160)..(160): a, c, t, g, unknown or other
  misc_feature (160)..(160): n is a, c, g, or t
  modified_base (174)..(174): a, c, t, g, unknown or other
  misc_feature (174)..(174): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (214)..(215): a, c, t, g, unknown or other
  misc_feature (214)..(215): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
tcagtagtgtagatcacgaccggtgctcgatttagatcgtctgtgtttgggtttggggctcagagaggagccttagccctggactccaaggcctttccacttggtgatcagcactgagcacagaggactcaccatggaattggggctgagcgtgttcgtntaggctattagagntcatngntgcatgngngntgggngctgcngcctgggtccnngctctctgngcancnctgatctattgtanctatgagtgctggcacngtcncgagggaggntggngtgcacanagacgnggngtaggagtaacgaatgtgngctgngtggcggtctctcactctcgacagacaacacacaatcatntatacngacagcgacgagngagacgacgacgacgtacgtcgtgttagttagttagtagtagagtagtagtagttataactaacgttacgttagtagtagtagtagttgtgtgtg

SEQ ID NO: 115506 - DNA, 676 bp, Homo sapiens
  misc_feature: GYAE6OF01D9OYU.37.34.D01.1.454.CMB.1.raw
  modified_base (267)..(267): a, c, t, g, unknown or other
  misc_feature (267)..(267): n is a, c, g, or t
  modified_base (376)..(376): a, c, t, g, unknown or other
  misc_feature (376)..(376): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccaggggaaggggctgggagtgggtggccaacatacagggaggtggtaggtacgaaaaactntgtggactctgtggcggggccgattcaccatctccagagacaaccgaccaaaaactcactgtatctgcaatggacgctgagactccgaggacacggctgtgtattatgngcgagagtatttaagactaataaaggtttcagtgactggtatgatggtacttagtacgtaacgttaccggtaggggaccctaaaggggtaccctagttcgggttacccaacccggttcgttacctttaccggaccgtccccttacccgaacccgtaaaccggggcccctacgttacccgggttccccttccccccggtagggtccccgtacccccgttggaccccgttacccggaacggggaccctacccggtaaccccggttacccggaaaggacccggcccgtaaccggaccccgggg

SEQ ID NO: 115507 - DNA, 871 bp, Homo sapiens
  misc_feature: GYAE6OF01CAEA4.37.34.D01.1.454.CMB.1.raw
tcagtagtgtagatcacgaccggtgctcgatttagatcgtctgtgttgggttttccttgttgctattttagaaggtgtccagtgtgacgtgcaactgggtggagtcgtgggggaggcttggtccagccgtggggggtccctgagactctcctgtgcagcctctggattcattctttagcaactacgccatgagcgtcggggtcccgccgaggcctaccggaagggggaacgggggtcgtgggtaggttcggggttccttacgaagggttatttaccggtagggttagttacggttaaactaccgactaatacgtacgacaagtaccgtccggtacggaccggggtccggttaccaccggtcctaccgaagacgtaactaaacgtttacccgaaaaggtaacgttaccgggttacttagtacgtaaggaaaactcggaaaaccacggtcctaggaacggaccggaccgggtaaacggaacccgacccgggttacccctttaacgttaacgtttaccggtgggtacggaaccggaaaggaaggtaacgtaccggaagggaaacgggtaagtaacgtaacgacgacgaccgacgtaccttacgtaccgtaacggtaaccgggtccggggacccgtaaccgggtaacccgtcggtaccccgtacccgttccctcccgtaaccgacccggtaccccacccggaaacccggtacccggtaccccgtaccggttccccggtttcccccgttccccgacccggtccccctaccccgtaccccgtaccgaaaccgtcccggtacccgtaccggttccggggaccgggaccacccggggtaccggtcccgggtacccggtccgggtcccgttcggtcccgg

SEQ ID NO: 115508 - DNA, 841 bp, Homo sapiens
  misc_feature: GYAE6OF01AMLUW.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagtgtgacgtgcaactggtggagtcgtgggggagcttggtccaggccgtggggggtccctggagtactcgtcctgtgcagcctcgtggattcaactttggtagctagttggatggacgtcggggtccgcgtagtccgtaccggaagggggtaacgggggccgtggggtaagggttcgggggtacggtaccccgaaaccgtaagttaaccggaagggggtaggggtagggttaacgggggttaaaaccggtaaaaaaaccgtttaggttacgggtttacggggtaaaccgtttaccggttaggggtccgggtacccgggggggtaccccgttaagtttacccgtaacccgtaaccgtttcccgttaacccggaaacgggtaaacgtaaaccccgtaaaaccccggaaaccccgtaaaaaaaccgttcccgtaaaacccgttaggttaaccttacggtaaccgtaaccggtaaacgtacggggtacccggtaccgttaagggaaccggtaccgttacccgggaacggaaccgtaccgggtacttacggttaaggtttaacttaggtttagtcgggtaccgtaaggtacggttaacgtttagtaaacgttaacggttaagtttaccggaggttacgacgttaggtagttggagttacgg

SEQ ID NO: 115509 - DNA, 314 bp, Homo sapiens
  misc_feature: GYAE6OF01APE8P.37.34.D01.1.454.CMB.1.raw
  modified_base (303)..(314): a, c, t, g, unknown or other
  misc_feature (303)..(314): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtccttccccctggccgccctgcctccgaggacgccacctccgagagcacgagccggccctgggctgcctggtcaaggactacttcatctacactactgagcgggctggcaaggcgcatagnnnnnnnnnnnn

SEQ ID NO: 115510 - DNA, 555 bp, Homo sapiens
  misc_feature: GYAE6OF01EFUME.37.34.D01.1.454.CMB.1.raw
  modified_base (342)..(342): a, c, t, g, unknown or other
  misc_feature (342)..(342): n is a, c, g, or t
  modified_base (446)..(446): a, c, t, g, unknown or other
  misc_feature (446)..(446): n is a, c, g, or t
  modified_base (551)..(551): a, c, t, g, unknown or other
  misc_feature (551)..(551): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagccttggtccaggccgtggggggtccctgagactctcctgtgcagcctctggattcaactttggtagctagttggatggactgggtccgccagtctccgaggggagggctggagtgggtgccaanatacgagggaggtggtaggtaacgaaaaactgtgtgggactcgtggtcggcggggccgtagttccacctatcctccgagacgacaacgacccaaaactcaactntaatctagacaaagtggacgactggagagtccggaggacgacggtctgtatattatgtgcgagagtatttagaacttacaaagtttcgaagtgactaggtactgntacg

SEQ ID NO: 115511 - DNA, 623 bp, Homo sapiens
  misc_feature: GYAE6OF01BYRS8.37.34.D01.1.454.CMB.1.raw
  modified_base (284)..(284): a, c, t, g, unknown or other
  misc_feature (284)..(284): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctatttagaggtgtcagtgtgacgtgcaactggtggagtcgtgggggaggcttggtccaggccgtggggggtccctgagacctctcctgtgcagcctctggattcaactttggtanctattggatggactgggtccgccagtccaccgaggggtaaggggctgggagtggggtcggaccaaacgattaaccgagggggtaggttgggtaggtaaaccgaaaaaattcgtagtgggaactcgtggtggcggggcctacgttccacctatcctcagacgaacaaccgacccaaaaactcaatgtactctgacaaagtggacggcctagacgacgtaccggaggtaccgacggtctggttagttattagttggtcggacggaaggtaggtaatttaagtaaccgttaaacgtaaaggttttacggaagttacggtacgttagggttaatgtagttcgg

SEQ ID NO: 115512 - DNA, 575 bp, Homo sapiens
  misc_feature: GYAE6OF01AKS1A.37.34.D01.1.454.CMB.1.raw
  modified_base (383)..(383): a, c, t, g, unknown or other
  misc_feature (383)..(383): n is a, c, g, or t
  modified_base (570)..(570): a, c, t, g, unknown or other
  misc_feature (570)..(570): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttgggtccagccgtggggggtccctgagactctcctgtgcagcctctggattcaactttggtagctattggatggactcggggtccgccagtctccgaggggaaggggctgggagtgggtggccaaacagtacgaggggaggtggtaggtaacgaaaaactntggtggactcgtggtggccggggccgtattccacccatcctccagacgacaaccgaccaaaaacctcacttagatctagaccaaatcggaacggctggaagacgtccggaaggaccgacggctgtagttattagttgtgcgtagagtagttagactaacttaaagttcgagttgacgtaggtatgtnttacg

SEQ ID NO: 115513 - DNA, 672 bp, Homo sapiens
  misc_feature: GYAE6OF01AZFUN.37.34.D01.1.454.CMB.1.raw
tcagtagtgtagatcacgaccggtgctcgatttagatcgtctgtgttgggtttgggggcaggagtcagacccactcaggacacagcatggacatgagggtcccccgctcagctcctggggctcctgctgctctggctcccaggtgccagatgtgccataccaaatcgacccagtcctccatccctccctgtctgcatcgtgtaggagacagagtcatcatctacgttcggccgggacagtcgagggctaagttaagaaattgtatttaggcttaggtatacacgacgaacgaaaccgaacgggaaaccgtacccgaacgtccgttacctactacttacgttagttcgggtacgtactacgttaccgttaacgtttaaccgtaaaccggttaccggggttaacccttaaagtttaaacgtacttacgacggtacggtacgtacggtggtacttcgacggtactaacgtacgttactttaccgtaccttacctacctaaccgactcgaccgacgtaccgcctacgccgtacgtcgtaaggtacgtttacgtttactacttaacttacttacgttactacgttaataacgttaacttactaaccgttaccgtcggttaccgacgtaccggaacggtagaaggtacgaacgtacgaacgtagcgtagcagcgtacg

SEQ ID NO: 115514 - DNA, 762 bp, Homo sapiens
  misc_feature: GYAE6OF01DIR09.37.34.D01.1.454.CMB.1.raw
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
  modified_base (243)..(243): a, c, t, g, unknown or other
  misc_feature (243)..(243): n is a, c, g, or t
  modified_base (711)..(711): a, c, t, g, unknown or other
  misc_feature (711)..(711): n is a, c, g, or t
  modified_base (756)..(756): a, c, t, g, unknown or other
  misc_feature (756)..(756): n is a, c, g, or t
tcagtagtgtagatcacgaccggtgctcgatttagatcgtctgtgttgggtttgggggtctcagagaggagccttagccctggactccaaggccctttccacttggtgatcagcactgacgcacgagagtactcaccagtaggtagttgggctggagtcgttcggtttcgttgtgtcttatttaggaggtntcagtgngcgtnacgtacgtggaggngtcggtaggggcgtcgttcggtaccncggtccgggtcgggtacctgacgtctcctcgtgtcgcgacgtctcgtaggtacttacgtacggtttgtagtcttagtggagtcggtaccgttcggcccgacgtacgtccgtacggggaggggacggtcgtaggggtacggtgggtccgaaaccaacgtaacggacgggtaggggtaggttacgggttaaacggtaaaaactaaactgggtacggtaacgtccgttaggtcgggtaccgggggtccgggtaccttacctttacgaacccctgttccccgaagaaccgggtaaacaacccgaaaaccccgtaaaaccctaaaaccgttacgtacgtttaacgtcgtaaccgtaacggtaacggttaaaccggcgggaacccgttcgaacggtaacgtacccgggaccggaacggacccgtgttgtacgttaaggtttacttggaccgagtcggtaagtagttacgttaanaccgtttaaacgtagtaccggtaattcgttacgtagttacgttgngttacg

SEQ ID NO: 115515 - DNA, 1008 bp, Homo sapiens
  misc_feature: GYAE6OF01EEHW0.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaacgtggtggagtcgtgggggagtcttggtccgacggccggtggggggtcccctggacgaccttcctccgtgtcgcgacgccttcgtaggtactttccgtaacgttttgggtaagtcctttaggttagggaacgttcgggtaccggttcggggtcccgaccgtacggttccggtacccgggaaggggggtaacggggtccggttagggggtacgggttcgggggtacgggaaaccccgtaaaccgtaaggttaaccggggaaggggggtaacggggtttacggggttaaacggggtaaaaaccggttaaaaaacgttggttacgggtacgggtaaacccgtttcggttaggggtacgggggacccggggggttacccctaaagtttaccccgaacccgtaacgtttacccgttaacccgaaagggtaaaccgtaaacccgaaaaacccgtaaaacccccgtaaaaaaaaccgttcccgtaaacgtttacggtttaaacgttaccgttaacgggaaaaccgttaaaacgggttaccggggtaaaccccggtacccggttaggtaaacccggggtaaccggtttaaccccggggaaaccggggtaacccggtaaacccggggttaccggttttaacggggtttaacggttttaacggttttacggtttagggtaaccgggtaacgggtaaaggttaaacgggtttaaacgttttaacggtaaaacccggttttaaaaccggtttaaaacggttttccgggtaaggtttaaccgttaacgggtttaaggtttaacggttggtaaagttacggg

SEQ ID NO: 115516 - DNA, 611 bp, Homo sapiens
  misc_feature: GYAE6OF01A07IP.37.34.D01.1.454.CMB.1.raw
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttcctgttgctattttagaaggtgtccagtgtgacgtgcaactggtggagtcgtgggggaggcttggtccagccgtggggggtccctgagctctcctgtgcagccctctggattcaactttggtagctattggatggactggggtccnccagtctccgaggggaggggctggaggtgggtcggcaacagtacgagggaggtggtggtaaacgaaaaagtntgtggactcgtggtcggcggggcctaattccacatcctccagacgacaaccgacaaaaactcaactgtactctacgacaaagtcggaccggtctagggagtacgtaccggaagggaccaccgggtcttggtagttaagtttagttcggtgtacggtaaggaggttaactttaagaacgttaaacgtaaacgggttttcgaaggttcgaaccggtttaggtacgtggtagttacgg

SEQ ID NO: 115517 - DNA, 801 bp, Homo sapiens
  misc_feature: GYAE6OF01CF9JM.37.34.D01.1.454.CMB.1.raw
tcagtagtgtagatcacgaccggtgctcgatttagatcgtctgtgttgggtttggggtctcagagaggagccttagccctggactccaaggcctttccacttggtgatcagcactgagcacagaggactcaccatggaattggggctgagtcgttgggttttccttgttgtcttagttttagaaggtgtccgagtgtgacgtgcaacgtggtggagtcggtggggagtcgttggtccaggtccggtcgggggtccctgacgtactctccgttggcgcacgtcctcgtaggtacttaccgtaacgttttggtacgtcttagttggtacgtcgggtacgttcggggtcccgccgtacggtccgtaccggaagggggtaacgggtcgtagggtagggttcggggtaccggacccgtaaagtacggttaacggaggggtacggttaggtaacggtaaaacgtaaaaacgttgtaggtacggtactacggtggtcgggaccggggtaccgttacgttaccgacccgttacgttacccgtacccgtaacggaaccggaaacccgaaaacccgtaaaccctaaaaaaccttccgtaacgttacgttaacttacgtaacgtaacgtaaacggtcggtaccggtacgtacggaacgtaccgtaaccggacggtacgtacggtacgttacgttagttacgtttagttggtacggtacgtaaggtacggtttaaacgttaacggtaaacttaaaccgttaaaggtttacgtaacggttaacgtacggttaaggttacgttagtacggttacg

SEQ ID NO: 115518 - DNA, 693 bp, Homo sapiens
  misc_feature: GYAE6OF01BE7S1.37.34.D01.1.454.CMB.1.raw
  modified_base (387)..(387): a, c, t, g, unknown or other
  misc_feature (387)..(387): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagtcttggtccagccgtggggggtccctgagactctcctgtgcagcctcgtggattcgaactttggtagcttagttggatggacgtgggtccgccgagtcctaccgaggggaagggctgggagtgggtcgaccaagagtacgaggggaggtggtaggtaaacgaaaacgtntaggtaggtactcgtggtcgggcggggtaccgtattccgaccgtatcctaccgtaagacgaacaaaccgaaccctaaaaacgtctaaaccgtgtactacgttacgacgtaaacgtcgggaccggtaccgtaggaacggtaaccgtaccgggaacggaaccgtacgggtacgttacggttagttaactttagttagggttacggacggtaacgggtaaagttaaggtttaacgtaaccgttaaacgttaaacggttttacggaacggtttacggaaccgttaagggtttactagggttagttacggg

SEQ ID NO: 115519 - DNA, 819 bp, Homo sapiens
  misc_feature: GYAE6OF01BRXUE.37.34.D01.1.454.CMB.1.raw
  modified_base (810)..(810): a, c, t, g, unknown or other
  misc_feature (810)..(810): n is a, c, g, or t
tcagtagtgtagatcacgaccggtgctcgatttagatcgtctgtgttgggtttggggctcagagaggagccttagccctggactccaaggcctttccacttggtgatcagcactgagcacgagaggactcaccagtaggtaagttggggctgagtcgttggttttccttgttgtcttattttagagtgtccagtgtgacgtgactaacgtggtggtagtcggtgggggaggtcgttggtccgaggtcccggtcgggggtccctggacgtacttcctccgtgtgcgacgtcctgtaggtacttacgttaacgtttggtagtacgttagttacggtagtcggtacggtcggtccgacgtcgttacgtaccggaggggacgggtcgtgggtaggtggggacgaacgaacgtacgtacggaagggtacgggtagggtaacggaaaacgtaaaacgttagtacggtacggtacttcggtcgggtacgggccggggtacgttactaccgaaccgtacgttaccgtacgaacggtaaccgaaaccgtaaaaccgaaacccgtaaaaacctcggtaaacgttacgttaacgttaacgtacggtaaacggtaaacggtacggggtaaccgtacgttacgggaacgtaccggtaaccgggtaaccggaaccggttaccgtacgggttaggttgttttaacgttacggttaggtccgggtaaagtaacggttaaacgggtttaacgtttaaacggaaactttaaacggtttaacggtttaacgtaaccgggttagttaacgttagggttaattaacgggtntttaaccgg

SEQ ID NO: 115520 - DNA, 953 bp, Homo sapiens
  misc_feature: GYAE6OF01C3GYV.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtcgtgggggaggcttggtccagccgtggggggtccctgacgactctccgtgtcgcagcctctggtattctaacgtttggtaagtcttagttggaagttcggtacgttcggggtccccgtccaacggttccgtaccggaagggggtaaacgggggtccgttagggggagggttcggggggtacgggaccccgtaaaacgaacgttaaaccgggaagggggtaagggtttaggggttaacggggtaaaaaccgtaaaaaaaaacggttagttagggttacggggtaaccctttcggttagggttaccggggaccggggggggtaaccccgtaacgttttaccccggaaaccccttaacgtttccccttaccccggaaaggtaaaccggaaaacccgaaaaccccggggtaaaaccccctaaaaaaaacccgttcctaaaacccggttacggttaaaccgtttcccggtaacggtaaacccgtaaaaacggttaccgggggtaacccgggtaaccctttaagggaacggtaaaccggtttaaccccggggaaacgggtaacccgggtaacccgggtccgttttaggttaggttttaacgttttaaggtttacggttacgggaacgggtaacgggtaaaggttaaacgtttttaaaacggtaaccctttaaaaccgggtttaaaaaacgggttttccggtaagggtttcggttaaaacggttaggggtttaacttagggtaacgtttaagg

SEQ ID NO: 115521 - DNA, 764 bp, Homo sapiens
  misc_feature: GYAE6OF01EMIJ8.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggtttttccttgttgcttattttagaaggtgtccagtgtgacgtgcaactggtggagtcgtgggggaggcgttggtccaggccgtggggggtccctgagactctcctgtgcagcctctggatttcaacgttttggtagcttagttggagttgggacgttcggggtccccgccgtacggttccgtacccggaaggggggaacgggggtcttggggtagggttggggtcgggacccaaacgtaagtaaccggaggggtaggggttagggtaagggtaaacgaaaaaacttgtaggtagggaaccttcgtagggttcgggccgggggacccgtagtttcccgaaccctacgttacccgtacccgaacggaaccggaaccgaaaacccggtaaacccctaaaaaacctccgaaacgttacgttaacttacgtacgtaacgtaaagtcgggaccgtacgtaggaacgtacgtacccggaaaggaccgtaacgggtccttaggttacgtttaatttacgttggtacggtacgtaaggtaagttagttttaaacggacttaaacggttaaacgttttacggaaggttacgtaacgttagggttaactggtgttaagg

SEQ ID NO: 115522 - DNA, 882 bp, Homo sapiens
  misc_feature: GYAE6OF01EZCH9.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcgctgagcacagaggactcaccatggaattggggctgagctgggttttcctgttgctattttagaaggtgtccagtgtgacgtgcaactggtggagtcgtgggggaggcttggtccagccgtgggggtccctgagactctctgtgcacgtcctgtggtattctaacgttttggtagtcttagttggagttgggtaccgttcgggggtcccgccgtacggttcccgtacccgggaaggggggaaacgggggtccgttaggggtaacgggttgggggttaccggggacccaaaacgtaacgtaaccggaagggggtaggggttaggggttacgggtaaaacggtaaaaaaccgttaggtgggtacgggtacctcgttaggttcggggcccgggggtacccgtaactttcccgaacccttaacgttccgttaacccgaaggaacgtaacccgaaaacccgggaaacccctaaaaaaaccgtccgtaaaccttacggttaacttaccgtacggtaaccgtaaacggttaccggggaacccggtaccgtacggaacggtaccggttacccgggaacgggaacccgtaccgggtcgttacgggttacggtttaagttttaacgttcgggttacggtacgggtaaagggttaaacggttaaacggtttttaacggtaaacccgtttaaaaccggtttaaaacgggtttttacgggtaaaggttaacccgggttaacgggtttagggtttaaaccggttggttaaacggtttaacggg

SEQ ID NO: 115523 - DNA, 543 bp, Homo sapiens
  misc_feature: GYAE6OF01A9W44.37.34.D01.1.454.CMB.1.raw
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (497)..(497): a, c, t, g, unknown or other
  misc_feature (497)..(497): n is a, c, g, or t
  modified_base (540)..(540): a, c, t, g, unknown or other
  misc_feature (540)..(540): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggccagcctggggggtccctgagactctcctgtgcagcctctggtattcaacttttggtaanctattggatggactgggtccgccagtcnccgagggagggctgggagtgggtggccaanatacgagggtaggtggtggtaacgaaaactgtgtggactgtgtggcgggcattcacntcncagagacaacgaccaaaactcactagtatcgtagacaagtcggacggtccaggacgacgtccggaggaccgacgggtcctgtcgtattagtgtcgngagtagtattagacttactaagttcgagtcgtacgttgtatgntcg

SEQ ID NO: 115524 - DNA, 716 bp, Homo sapiens
  misc_feature: GYAE6OF01CRNGC.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagcttgggttttccttgttgcttattttagaaggtgtccagtgtgacgtgcaacgtggtggagtcgtgggggagcgttggtccagccgtcgggggtccctgacgtactctcctgtgcgacgcctcgtggacttctaacgtttggtagtcttagttggagtcggacgtcggggtacccgtccacgttcctaccggaggggaacggggtcgtagggacggtcgggtacggaccaaacgacgtacggagggtaggtggtaaggtaaacgtaaaactgtaggtgactcgtggtcggccgggcgtacttccaaccgtataccgtcgaagacgaaccgaacgaacccaaaaactcgtaactagttactacgtagaacgtaaacggtcggaaccggtcgtaggaacgtacgtaccgggaacggacccgtacggtcgttagttaacgtttagttaacggtttcggtacggacggtaaggtaaggtttaaacgtttaaggtaaaccttaaacggttaaaaccggtttacggtaacggtttacggtaaacggtttaggttaacgtcggttaagttaccgg

SEQ ID NO: 115525 - DNA, 603 bp, Homo sapiens
  misc_feature: GYAE6OF01ANO1G.37.34.D01.1.454.CMB.1.raw
  modified_base (344)..(344): a, c, t, g, unknown or other
  misc_feature (344)..(344): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactgggtggagtcgtgggggaggcttggtccagccgtggggggtccctgagactctcctgtgcagcctctggattcaactttggtagcttattggatggactggggtccaccagtctccgaggggagggctggaggtgggtggccaanagtacgaggggaggtggtaggtaaacgaaaaactgtggtggactcgtggtggccgggggtccgattccacctatcctccgagacgacaacgaccaaaactcaactgtactctgacaagtggacggctagagataccggaggacacgacgtgtagttattagttggtcgacggtaagtaacgttaagtttaagaaccgttaacttaaaacgggttttcgaaggttaggtaaccgtttagggtaattagggtacgttacgg

SEQ ID NO: 115526 - DNA, 743 bp, Homo sapiens
  misc_feature: GYAE6OF01BX7EB.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccataccaaatcgacccagtcctccactccctcccgttgtcctgcatcgtaggtaggagacagtacgtacatctactcgtaccgttcggaccgggactaaggtcgagggtctaagttaagaaaattggtaagtttaggcgttggtatcgagaccgaaaggaaacccgtaggggaaaccgtccccgtaaacggtcctaccctcaacttccgtaagtcggtcgtactactaccgtaacgttttaacgaaaccggttcgggtaccctaagttaagacttacgaggccgtaggtacggtacggtacgttacgtacgggaccaacgttagttacctttaccgaaccttcctaccgtaaccgtactaccgtacgacgtaccgtacccgtacggacctaccgtaccgtaagttaacggttttactttacggaaccttaaccttttaacgttaccgttagttaaccgtaacgtaaagtttaccttaaccttaaccgttaccccgtacggttaacccggtacggtaaccggtaacgggtaccggtaagggtaacgtacgtaaacgaaccgttcgtacggtacgtactcgacccgtaacg

SEQ ID NO: 115527 - DNA, 643 bp, Homo sapiens
  misc_feature: GYAE6OF01BZABX.37.34.D01.1.454.CMB.1.raw
  modified_base (291)..(291): a, c, t, g, unknown or other
  misc_feature (291)..(291): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtggggggtccctgagactctccgtgtgcagcctcgtggtattcctaacgtttgggtancttaagttggatggactgggtccgccagtctccgaggggaacgggcgtgggaggtgggtggacccaacgagtaacgaggggaggtggtagggtaaacgaaaaacgtgtaggtaggactcgtaggtcggccggggactagttccacctatcctacgagacgaaccaacgaaccctaaaactcaactgtactctacgactaaacgtcggaaccgtccgtagagacgtaccggaggacgtacgggtcttaggtgtttattagttggtaggacgtaaggtaagttacgtttaacgaaccttaaacggttaaacggtttcggaagttacggtacggttaggtattcgggtattacgg

SEQ ID NO: 115528 - DNA, 850 bp, Homo sapiens
  misc_feature: GYAE6OF01C7K8I.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcccgtggggggtccctgagactctcctgtgcagcctcgtggattctaactttggtagcttagttggatggacgtcgggtccgccagttcctccgaaggggaaggggctgggaggtggggtcggaccaaacgataaccggagggggtagggtagggtaggtaaaccgaaaaacttgtggtacggacttcgtaggtcggccgggggtaccgattccaacctagtacctccgaagaacgaaccaaaccgaaccaaaaaacctcctaacgtagtactcgtacgaacgtaaagtcgggaaccgtccgtaggacgaacgtccggaaggaccgacggtacttggttagttatttagttcggagtacggaagtagttaacgtttaacgaacttaaacggtaacgttttacggaaggttacgtaacgtttagggttataggtagttagtaacctttaggacggttaacgttaccgggtaccggggtaaacccgaacgggtacctacggttaccggttacccgtaccggtttccttacccggtttacgacccggttacccctaaccccgggaacccggtaaccccggggtacccttaaccgggtttcccccggtttacccccgttcccccccggtagggtacccccgtccccgttcggtaccccgtaccgggtaacgggaccccgtacccgtaaccccggttacccgaagggaccgcccgaacccggtacccgggg

SEQ ID NO: 115529 - DNA, 733 bp, Homo sapiens
  misc_feature: GYAE6OF01B0Q7Z.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcgttgggttttccttgttgcttattttagaaggtgtccagtgtgacgtgcaactggtggagtcgtgggggagcttggtccaggccgtggggggtccctgagctctcctgtgcagcctcgtggtattcgtaacgtttggtagcttagttggagtgggtaccgtcggggtcccgccgtagttccgtaccggaagggggaacggggtcgtaggggaggttcggggtcggacccctaaacgagttaacggaaggggtaggggttgggttaacggtaaaccgtaaaaaacgttgtaggtacggtaaccttcgtgggtcgggccggggtaccgtactttaccgaccgtacttcccgtaccgaacggaacgaaccgaaacccgaaccctaaaaaccgtctaacgtagttactacgtagacgtaaagtcggaccgtcgtagagacgtaccgaggaccgaggtcgttgttagttacgttagttcggtcgtacggtaaagtacgttaagtttaaacggaaccgtttaaacgttaaaccggtttaacggtcggtttaaacgtaccggtttaggttaacgttggtagtttacgg

SEQ ID NO: 115530 - DNA, 536 bp, Homo sapiens
  misc_feature: GYAE6OF01AYBDA.37.34.D01.1.454.CMB.1.raw
  modified_base (283)..(283): a, c, t, g, unknown or other
  misc_feature (283)..(283): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
  modified_base (531)..(531): a, c, t, g, unknown or other
  misc_feature (531)..(531): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggacttcaactttggtanctattggatggactgggtccgcagtctccgagggacgggcgtgggaggtgggtcggccaacgagtacgagggaggtggtaggtaacgaaaaactgtaggtgtactctgtcgcgggcattcacatactcagacgacaacgacaaaactcactatatctanacaagtggacgcngagctacgagaccgacggcttgtgtattagttgtgcgagagtagttagactataagttcgagtcgataggtatggngtacg

SEQ ID NO: 115531 - DNA, 762 bp, Homo sapiens
  misc_feature: GYAE6OF01DZ710.37.34.D01.1.454.CMB.1.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaacgtggtggagtcgtgggggagcgttggtccgaggccgtgggggtccctgacgctctctgtgcngcctcgtggtattactaacgtttggtacncttagttggatgggaccgttcgggtcccgtccgagttccgtaccggaagggggaaggggcgtagggaggttcggggtcggaacccaacgtaagtaccggaggggtacgggtagggtacggtaaaaacggtaaaaacgttgtaggtacggtactcggttgggttacgggccgggggtaccctagtttacccaacccgttacgttcccgtaaccgaagtaaaccgaacccgaaaaccgtaaaaccccgaaaaacttacccgaagttaccgttaattccgtaacggaaccgtaaaacggttccggggaacgttccgagggttaacgaccgttacccggggaagacccggtacggttcgtggtttacggttatttacgttgggtaggaccgtaagggtagtttaaaccgtttaacgttaaccgttaaacgttaaggtttcggaagttaggttacggtaggttatggtgttacgg

SEQ ID NO: 115532 - DNA, 775 bp, Homo sapiens
  misc_feature: GYAE6OF01DLX71.37.34.D01.1.454.CMB.1.raw
  modified_base (224)..(224): a, c, t, g, unknown or other
  misc_feature (224)..(224): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
tcagtagtgtagatcacgaccggtgctcgatttagatcgtctgtgttgggtttggggaagaggaagactgacggtcctgccacgaggtggtgctgaggaagagagtggaggtggacgtgtacagccacccgaggtccgtgggcctcggtcccgtggtccaccgtctccctacgacgtccctaccgaaccgaacggccctagttcccggttccccttcccccggnggacccgtccccgtgtcccgtaccgaggtaccgcccgtaaccccgtaccggaagaccgaccgtaaccgtaccggtcccggtcccgtagggtccttaacggcccgtacgggttaacccgaaacggttacccttttaccgttaaccgaactttacccgtaaaacccgtaacgttcccgggtaggtaaccggcccgggtaacttaccgggggaaacctaaccgggtccttacgaaaggtgcgnttacgngtacgccgtgtaacgngtacgtcgtctancgtcgtacgacgtacgtacgtacgtcgtacgtacgtacgtacgtcgtcgtacgtacgtacgtacgtacgtacgtacgtacgtcgtcgtacgtacgtacgtacgtacgtacgtacgtacgtacgtacgtacgtacgtacgtacgtacgtcgtacgtacgtacgtacgtcgtacgtacgtacgtacgtacgtacgtacgacgtacgtacgtaccgtacgtacgtacgtacgtacgtccgtacgtacgtacgtacgtaccgtacgtcgtccgtcgtacg

SEQ ID NO: 115533 - DNA, 559 bp, Homo sapiens
  misc_feature: GYAE6OF01EYC6A.37.34.D01.1.454.CMB.1.raw
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
  modified_base (555)..(555): a, c, t, g, unknown or other
  misc_feature (555)..(555): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttcctgttgctattttagaaggtgtccagtgtgacgtgcaacgtggtggagtcgtgggggagcttggtccagccgtgggggtccctggagactctcctgtgcagcctctggattacgaactttgganctattggatggactgggtccgcagtcgtccgaggggagggctggagtgggtgccaanatacgagggacggtggtaggtaacgaaaaactgtgtaggactctggtggccggggctacttcacctatctaccgagacgacaacgaccaaaaactcactagtactcgtacacgaaagtggacgtacagagactaccggacgacgacggctgtgttagttatgtagacgagtagtagttagactacgtaaagttcgtagtcgtactagtatgnttag

SEQ ID NO: 115534 - DNA, 497 bp, Homo sapiens
  misc_feature: GYAE6OF01CPXR2.37.34.D01.1.454.CMB.1.raw
  modified_base (445)..(445): a, c, t, g, unknown or other
  misc_feature (445)..(445): n is a, c, g, or t
  modified_base (448)..(449): a, c, t, g, unknown or other
  misc_feature (448)..(449): n is a, c, g, or t
  modified_base (451)..(497): a, c, t, g, unknown or other
  misc_feature (451)..(497): n is a, c, g, or t
tcagtagtgtagatcacgaccggtgctcgatttagatcgtctgtgttggggtttggggggaagaggaagactgacggtcctgccacagggtggtgctggaggaagagagtggagggtggacgtgtcagccacccagcgtggggcctgtcccgtggtcacccgtctcctcacgccctaccaaccgaacgggcccagttccggttccctttccccccgtgggcccgtcccctgccgtcccgagggacgccctacccgtccggagacgtaccaaccgtacggcccgggtcccgttgggggaccttcggaccccgttagggtaaccgaaacgggtaccctttaccttacccctaattcccttaaaacccgtaaccgttaaccgttagggaacggggcccggggtcttacgggggacccgaaaacggggttccccggactaaggttagcntcnnannnnnnnnnnnnnnnnnnnnnnnnnnnnnnnnnnnnnnnnnnnnnnn

SEQ ID NO: 115535 - DNA, 733 bp, Homo sapiens
  misc_feature: GYAE6OF01CAZ5J.37.34.D01.1.454.CMB.1.raw
tcagtagtgtagatcacgaccggtgctcgatttagatcgtctgtgttgggtttgggggcaggagtcagacccactcaggacacagcatggacatgagggtcccccgctcagctcctggggctcctgctgctctggctcccaggtgccagatgtgccatccaaatgacccagtctccatccctccctgtctgctatcgtaggtaggagacagagtccacatcacgttcgccgtaggcgagtccaaggactattgactaacttaatttaaacgttggtatcgaagacgaagaaccgaagggaaaccgccccgaagcctccgtggtcctacgtctgactactacctaagttacggaaacaggtaccgtaccagttacgtaaacggttcgaaggtacggtaagttggacttacgggtagggtaactacggtttaactttttaccgtttacctaaccctttagaaaccggtcgtaaccgtccgtcggtaccttaaggtacgtaacggtaacggtaactaagtttaccgaactaacgttaacttacgttttaacgttccgaaacctaaacccttaccggaaccgttacgggtaaccccggtaaccgtaaccggggtaacctaaagggttaccgtaattaaaccgtaaacgtaaaacccggttagtaccgggtcgttaccgtaccgtaacctaccgttacgttaccttcgtttaacccgttcctaacccggtttcccccg

SEQ ID NO: 115536 - DNA, 633 bp, Homo sapiens
  misc_feature: GYAE6OF01CVNFU.37.34.D01.1.454.CMB.1.raw
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagccctggggggtccctgagactctcctgtgcagcctctggattcaactttggtagctattggatggactgggtccgccagtctccgagggaaggggctggagtgggtggccaacatacagggaggtggtggtaacgaaaaactatgtggactntgtgcggggccgattcaccatctccaganacaacgaccaaaaactcactgtatctgacaaatggacgccagagatccgagaccacggctgtgtattagttagtgacgagagtattagactaacgtaagtttcgagtgactaggtatgatgcttaatgattaccggtagggacccgaagggtacctagtcggtacctaccgtcctcgttcaaccgtccctacccaacccgtaacgggcccctaacgttcccggttccccgttcccccccgtggtccccggtccccgttcgacccgttaccccgacgggtaccgcccgtaaccccgtcccgaaccggtacggcccacccggtaaccggg

SEQ ID NO: 115537 - DNA, 672 bp, Homo sapiens
  misc_feature: GYAE6OF01C5XR0.37.34.D01.1.454.CMB.1.raw
  modified_base (328)..(328): a, c, t, g, unknown or other
  misc_feature (328)..(328): n is a, c, g, or t
  modified_base (435)..(435): a, c, t, g, unknown or other
  misc_feature (435)..(435): n is a, c, g, or t
tcagtagtgtagatcacgaccggtgctcgatttagatcgtctgtgttgggttttccttgttgctattttagaaggtgtccagtgtgacgtgcaactggtggagtcgtgggggaggcttggtccagcccgtggggggtccctgagactctcctgtgcagcctctggattcaactttggtagctattggatggactgggtccgccagtcctccgaaggggaaggggctgggaggtggggtggaccaaacatacgaggggaggtggtaggtaaacgaaaaactatggtgactcgtggtggccggggccgtattccaccgatcctccaaganaaccaaccgaaccaaaaacctctaactgtaatctacgacgaaagtcgggaaccggtccgtaggacgacgtccggaggaccgacggtcttggtagttatttagttggngacgagagtattagactaataagtttcgagtagtacgttaggtatgtatgtacttagtgtaacgtaccggtcgggaccgaacgggacctagtcggtccgtaccgttctccttacgaccgtccctacccgaccgtaaccgggccctacgttcccgttccccttccccgtcggccccgtcccgtcgtcccgtaccgacggaccgacccgtacccgtacggaccgacgccgacgtccggg

SEQ ID NO: 115538 - DNA, 820 bp, Homo sapiens
  misc_feature: GYAE6OF01BBY8L.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgcttattttagaaggtgtcagtgtgacgtgcaacgtggtggagtcgtgggggagtcgttggtccacggccgtggggggtccctgacgtactctccgtgtgcagccctcgtaggtattactaacgtttggtaacgtcttaaggttggagtgggtaccgttcggggtcccgtaccgtaggttcccgtaccggaagggggaagggggtccttggggaacggttcggggtacgggacccctaaaacgacgttaaccggagggggtaggtacggttaacggtaaaaccgtaaaaaacgtgtcggtagaaccgttcggtcggtacgggaccgggggcctaacttacccgaccctacttccgtacccacggtaacgaaaccgaaacccgtaaacccgtaaaaaaccctccgtaaacgttacgttaacgtaccgtttaacggaaccgtaaacggtaaccggggtaaccggtaccgtaagggtaacgtaacgtacccgggaaccgggtaaccggtaccgggtacctttagggttacctttaggtttaacgttggttacgggacgtaaacggttaaaggttacggtttaagtaaccggttaaacgttaaagggttacgtaacggttacgtaacggtttaggttacttaggtagttaaccggg

SEQ ID NO: 115539 - DNA, 623 bp, Homo sapiens
  misc_feature: GYAE6OF01EQQLU.37.34.D01.1.454.CMB.1.raw
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
tcagtagtgtagatcacgaccggtgctcgatttagatcgtctgtgttgggtttgggggcaggagtcagacccactcaggacacagcatggacatgagggtcccgctcagctcctggggctcctgctgctctggctcccaggtgccagatgtgccatccaaatgacccagtctccatcctccctgtctgcatcgtgtaggagacagagtcatcatcacttgccgggnaagtcgaggctagttagaaatgatttaggctggtatcagcaacgaaaccgaaggaaacgccctaagctcctcatctatgngactactactaacgtttaacgaacgtacgggtaccctaaagttaagtacttacgacggtacggacgtaggttacggagttcgtaggcctaacgtagtactttaccgacttacctacaacctactacgacgacaacgtccgtacgctacgtaccgttaggtaattacgtttagacgttaactttacttactagttactaaccgaatacttaactaaccgtccgttacggttaaccgttaccggacgtaaacgggtaacgtacgggttaacgaaacgtaaccgaaacggtacgtacgtacggtactggaacctaacccg

SEQ ID NO: 115540 - DNA, 566 bp, Homo sapiens
  misc_feature: GYAE6OF01EV3JI.37.34.D01.1.454.CMB.1.raw
  modified_base (564)..(564): a, c, t, g, unknown or other
  misc_feature (564)..(564): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggaggcttggtccagccgtggggggtccctgagactctcctgtgcagcctctggattcaacttttggtagctagttggatggacgttggggtcccgccagtctccgaggggaaggggctgggaggtgggtggaccaacgatacggagggtaggtgggtaggtaaacgaaaaacttgtaggtggactcgtggtcgggccggggccattccaccatctccagacgacaaccgaccaaaactcaactgtatcagacgaaagtcggacggtcctggagacgtaccggacgacgacggtctgtagtattagttgtgagagagtattagactactaagttcgagtgtactggtatgntg

SEQ ID NO: 115541 - DNA, 855 bp, Homo sapiens
  misc_feature: GYAE6OF01DAR1D.37.34.D01.1.454.CMB.1.raw
tcagtagtgtagatcacgaccggtgctcgatttagatcgtctgtgtttgggtttggggctcagagaggagccttagccctggactccaaggcctttccacttggtgatcagcactgagcacagaggactcaccagtggaattggggctgagtcgttgggtttttccttgttgcttagttttagaaggtgtccagtgtgacgtgcaacgtgggtggagtcggtgggggaggtcttgggtccacggtcccggtcggggggtccctaggacgtactccttccgtgtcgccacgtcccgttgtggtaactttacgttaacgttttggtagcctttaaggttggtagtcgggaccgttcggggtcccccgtaccgtagttcccggtaccggaaggggggaacggggtcggttagggggtacgggttcggggttacggaaccctaaacgtaacggtaacgggtagggggtagggtttagggtaaacgggtaaaaccgtaaaaaacgttggtaagggttacggtaccgttaggttcgggtcggggaccggggtacccgtaacgtttacccaacccgttacgttacccgtacccgaagggaaaccctaaaccggaaaaccccgtaaaaccccaaaaacgttacctaacgttcggtacttacgacgaaacgtaacgtcgggaaccgcgttaaggacgtacgtaccgggaacgtacggtacgttacgttttacgttttaagtttacggtggttacggtacgtaaaggttaaaggtttaacgtttaacggtaaaccctttaaaggttaaaccgtttaggtagtttaccggtaagtttacgggtatttaaggtcgttagtttaacgg

SEQ ID NO: 115542 - DNA, 792 bp, Homo sapiens
  misc_feature: GYAE6OF01DATZO.37.34.D01.1.454.CMB.1.raw
  modified_base (779)..(779): a, c, t, g, unknown or other
  misc_feature (779)..(779): n is a, c, g, or t
tcagtagtgtagatcacgaccggtgctcgatttagatcgtctgtgttgggtttgggggtctcagagaggagccttagccctggactccaaggtccctttccacttggtgatcagcactgagcacgagaggactcaccagtggaagttggggctgagcgttggttttccttgttgtcttatttagaggtgtcctagtgtgcgtgcaacgtggtggagtcggtggggacgtcgttcggtccacgggtcccggttcggggggtccctggaacgtccgtccgtccgtggtgcctacgtccctcgtagttacgttaccttaacgtttggtacgtacgttaaggttggtaacgtcgggtaccggttccgggtcccgaccgtacggttcccgtacgggaacggggtaacggggtccggtaggggtacgggtgggtaccggtaacctaacgagtaaccggaggggtacggtagggtaaaccggtaaacgtaaaaacgtgttacggtacggtaccgtcggttaggtccggggaccggggtacccgtagtttacccgaccgtacgtaccgtaccaacggtaaccgtaaccgaaaacccgtaaaccaaaacttcgtaaccttacggtactacgtagaaaccgtaaggtccgggaccgtcgtaaggacgtacgtacgggaacggaccgttaggtaccgttaggttagttacttaggttccgtaggtacgtagtaagttaacggttaatacgttaacgttaaacggtttagtacggttacgtagaggtttanccggttattacgg

SEQ ID NO: 115543 - DNA, 785 bp, Homo sapiens
  misc_feature: GYAE6OF01A44GM.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttgggctgagtcttgggttttccttgttgtcttattttagaaggtgtccaggtgtgacgtgcaacgtggtcggaggtcggtagggggagtcgttcggtccgacggtccggtcggggggtcccctggacgtaccgtcctccgttggtcgcacgtccttcgtggttaacttaccgtaacgttttggtacgtacttagttggtacgttcgggtaccggttcggggtccccgccgtacggtaccgtaccgggaagggggtaacggggtcgtagggacgggttcggggtacggaaccgtaacgtaaggtaaccgggaggggtacggtacgggtaaacgggtaaaactaaaaacgtgttacgggtacgtacgtcggtgggtaccgggccggggtacctacttaccgaaccgtacttaccgtaccgaacggaccgtaaaccgaaacccgaaaccctaaaactccgaacgttacgtaacgtaccgttaagacgtaaaaggtccggaacggcctaaggacgtacgtaccggacggtaccgtccggttagttacggttattaggttagttcggaggtaacgtaggttaagttaacttaggtaaacttaaaggtaacgtttcgtaacggtacttacggtaggttacaggtgttaacg

SEQ ID NO: 115544 - DNA, 782 bp, Homo sapiens
  misc_feature: GYAE6OF01DAQFB.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttgggttttccttgttgcttattttagaggtgtccagtgtgacgtgcaactgggtggagtcgtgggggagcttggccagccggtgggggtccctggagactctcctgtcgcacgcctcgtggtacttacgtaacgttttggtagtcttagttgggatgggtaccggttcggggtcccgccgtagtccgtaccggagggggaacggggcgttggggaggttggggtacggacccaaacgagtaacgggaagggtaggggttagggttaacgggtaaaacgtaaaaaacgttggttagggttaacggtacgttacggttcggggtacgggcccgggggttacctacgtttacccgaaccctacgttcccgtaaccgaagggtaaccgaaaccgaaaaccgaaaaccccgttaaaaaacctccgtaaacgttaggttaacctcgttacgaacgtaaacggtcgggtaaccggacttaggaacgtaacggtaccggaacggaccggtaccggtagttagtttagttacgtttagttcggtagaccggttaaggtaacgttatttaaacggaccttaaacggtttaaagggttacgtaagggtacgtaacggttaggttaacgtggtaagttacgg

SEQ ID NO: 115545 - DNA, 904 bp, Homo sapiens
  misc_feature: GYAE6OF01AEQHO.37.34.D01.1.454.CMB.1.raw
tcagtagtgtagatcacgaccggtgctcgatttagatcgtctgtgttgggtttgggctcagagaggagccttagccctggactccaaggccctttccacttggtgatcagcactgagcacagaggactcaccatggaagttgggctgagtcttggttttccttgttgcttattttagaaggtgtcctagtgtgacgtgctaacgtggtaggagtcggtgggggaggtcttaggtccacggccggttcggggggtcccctaggacgaccgttcttccgtggtcgccgacggtcccttgtgggtaactttaccgtaacgttttgggtacgtcgttaagttgggtacgttcgggtaccgttcggggtaccccgtccgtaacggttccgtaacccggaaggggggtaaacggggggtccttagggggtaacgggttcgggggttacgaccccgtaaaacgtacgtaaaccgggtaagggggtaagggttcggggtaaacgggttaaaaccgtaaaaaaaccgttggttacggttacgggtaccttacggttggggtacggggtcccgggggtacccgttaacttacccgtaacccgtaccgtaccgttaacccgaaacgggtaacgaaaccccgaaaacccggtaaaacccctaaaaaaccgttaaccgtaaaccgtttacggttaaccttccggttaaacgaaaccgtttaaaccggtccgggaaccccgttacggtaacggaagggtaaccgtaaccgggtacgggaaccgtaccgggttctttacggtaagtttacttaggttacgtacggacggtaaagtagtttaaacgtttaaaggttaacttaaacggttaaacggtttacgtaacgttcggaacgtttaggttaagtcgtaagtttacgg

SEQ ID NO: 115546 - DNA, 791 bp, Homo sapiens
  misc_feature: GYAE6OF01DPI0U.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagtgtgacgtgcaactgggtggagtcggtgggggagtcttggtccaggccggtcggggggtaccctggacggtaccttcctccgtggtcgcgacggtcccttcgtaggtactttaccgtaacgttttgggtagtactttagttaggagttgggaccgttcggggtacccgccgtaggtccgtaccgggaagggggaaggggtcgtaggggaggttgggggtaccggaacccaaacgtaacggtaacggaggggtaggggttgggtaacggtaaaccggtaaaaaacttgtaggtacggtaaccgtcgtgggtcggggccggggtaccgtacttaccgaccctacgtccgtaaccgagaacgaaccaaacccgaaacctaaaaccgtccaacgttacgtacgtactacggaacgtaacggtccgggaacggtccgtaggaggtaaccgtacgggaacggaccgtacgggtacgtttacggttagtttactttaggttcggtaggtaccgggtagtaaggtttaacgtttaagttaaacggtaaaccgtttaaaacgggtttcgtaacggttaacggtaacgttaggttaagtacggtagtttaacgg

SEQ ID NO: 115547 - DNA, 785 bp, Homo sapiens
  misc_feature: GYAE6OF01CQMDG.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttcctgtgctatttagaagtgtccagtgtgacgtgcaactggtggagtcgtgggggagtcttggtccagccgtgggggtccctgagctctcctgtgcagcctctggattcgtaacgtttggtacgtctagttggagtcgggacgtcgggtccgcctaaggttccgtaccggaaggggaacggggtcgttgggaggtggggtacgacccgaaatacgttaacggaggggtaggttggtaaggtaaacgtaaaaaacgtgttggtaggtaccgtcgtggtacgggccggggtaccgtattaccgaacctactcccgtacccgaaggaaccgaaaccgaaaccggaaacccccgtaaaaaaactccgtaaaccttaggttaaccttcgtaacggaaaccgtaaaacggtccggggtaaacccggtcccgtttaagggaacggtaaacccggttaccgggaacgggaacccgaccgggtaccgtttaggttaacgttacgtttaaccggttgggtaacggtaccgggtaaacgacccgggtacccccttaccccgaacccgttaccggaccgaaccgacggcccggtaacggtaccgggttaacggtacccgttttccggggaacccgggggg

SEQ ID NO: 115548 - DNA, 816 bp, Homo sapiens
  misc_feature: GYAE6OF01C51G9.37.34.D01.1.454.CMB.1.raw
  modified_base (365)..(365): a, c, t, g, unknown or other
  misc_feature (365)..(365): n is a, c, g, or t
  modified_base (798)..(798): a, c, t, g, unknown or other
  misc_feature (798)..(798): n is a, c, g, or t
tcagtagtgtagatcacgaccggtgctcgatttagatcgtctgtgttgggttttccttgttgctattttagaaggtgtccagtgtgacgtgcaactggtggagtcgtgggggaggcttggtcccagcccgtggggggtccctgagactcctcctgtgcagcctctggattctaacgttttggtagctattggatggacgtgggtccgccagtcgtccgaggggaaggggctggagtgggtgaccaacagtacgagggaggtgggtaggtaacgaaaaactgtagtggacgtctaggtcggccggggaccgtagttccaacctatcctaccaagacgacaaccgaaccaaaaactcaagttgtacncgtagacgtaaaggtcggaccgacgtagacgaacgtccggaaggaccgacggtactggttaacgttagtttaacgtttggtacggtacggtaagtaaaggttaaacttttaaacggtaactttaaacggtaaaacggtttttcggaaggttacggtaacgttagggtaacgttggtaactttcgtacgtttaaagttcggaacgttaaccgggtaccggggaaaccggaacgggtacccttaaggttaccgggtacccgtaacccgttcgttccgttaaccgaccgtaccccgtacccgtaaacccggtaaccgggtacccttaaccggttcccccggtttaccccgtcccccggttccgggaacccgttccccgttacgacccgtaccggaaccggtaaccaccccggtaacccgtacccggaggtaacccncccgtaccggaacccggg

SEQ ID NO: 115549 - DNA, 768 bp, Homo sapiens
  misc_feature: GYAE6OF01D1AVI.37.34.D01.1.454.CMB.1.raw
  modified_base (195)..(195): a, c, t, g, unknown or other
  misc_feature (195)..(195): n is a, c, g, or t
tcagtagtgtagatcacgaccggtgctcgatttagatcgtctgtgttgggtttgggggtctcagagaggagccttagccctggactccaaggccctttccacttggtgatcagcactgagcacagaggactcaccatggaagttggggctgagtcgttgggttttccttgttgcttatttaggagtcgtcagtgngacgtgcagtggtggaggtcggtgggggagtcgttcggccgaggtcccggttcggggggtccctggacgtacctccgtccttgtcgcacgtcctcgtggtacttaccgtaacgtttggtactctagttgggtactaggccgtcggggtccaccgtgttccggaccggaagggggtaacggggcgtggggaggttcgggacgacctaaacgagttacgggaggggtagggttaacggtaacgggtaaaactaaaacgtgtacggtacggtaccgtacgtggggtacggggtcccggggtaccgtaacttacccgaaccgtacctacctacccggaaaggtaaccgaaacccgaaaccgtaaaccctaaaaacctccgtaattacgttacgtacgtacgaacgtaaacggtcggaaccgtacggtaagacgtaacgtaccgggaaacggaccgggtaggtacgttagttagtttagttaggttaggtagtacggtaagttaacgttaaggttaacgtaacgtaaacggttaaacggttggaacggttacgtaggttacggtagtcgtaagttacg

SEQ ID NO: 115550 - DNA, 802 bp, Homo sapiens
  misc_feature: GYAE6OF01D0G7Q.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagtgtgacgtgcaactggtggagtcgtgggggagcttggtccaggccgtggggggtccctgacgactctcctggtcgcacgcctcgtggtacttctaacgtttggtagtcttagttggatgggaccgttggggtcccgtcctagttccgtaccggagggggaacggggcgtgggaggttggggtacggaccctaaacgagtacgaggggtagggtagggtacggtaaaacgtaaaaactgtaggtacggtaactcgtgggtcgggcccggggtacgtaacgttcccaaccgtacgttccgtaaccgaacggtaacgaaacccgaaacccgtaaaccccgtaaaaaaccgtcctaaaccgttacgttaactcgtaacgaacgtaaacggttcggggaacccggtccttaacgggaacggtaacccgtaccggggaaaccggtaacccggtaccgggttaccgttagggtttacggtttattaacggtttgggtacggtaacggtaagggttaaacgtttaaacggtttaaaggtaaacccgttttaaaacggttaaaacggtttcgggtaaacggttacggtaaaccggtttaggtttaaaggtcggtaagtttacgg

SEQ ID NO: 115551 - DNA, 590 bp, Homo sapiens
  misc_feature: GYAE6OF01D98OL.37.34.D01.1.454.CMB.1.raw
  modified_base (313)..(313): a, c, t, g, unknown or other
  misc_feature (313)..(313): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (510)..(510): a, c, t, g, unknown or other
  misc_feature (510)..(510): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgcttattttagaaggtgtccagtgtgacgtgcaactggtggagtcgtgggggaggtcttggtccagccgtggggggtccctgagctctcctgtgcagcctctggatttcaacttttggtaagcttattggatggacgtgggtccnccagtctccgaggggagggctggagtgggngccaanagtacgagggaggtggtaggtaacgaaaaatgtgtggactgtggtcggccggggcctattccaaccgtatccgtaccagaacgacaaaccgaaccccaaaaactcaactgtaactcgtgactaaagtcggacggtcctgagaacgccggaaggacacggtnttagtgttatttagtggtagcgagtagtatttaagacttaaagtaacgtttcgaggtacgagttaggtaatgtagttacg

SEQ ID NO: 115552 - DNA, 762 bp, Homo sapiens
  misc_feature: GYAE6OF01B5Z6K.37.34.D01.1.454.CMB.1.raw
  modified_base (272)..(272): a, c, t, g, unknown or other
  misc_feature (272)..(272): n is a, c, g, or t
tcagtagtgtagatcacgaccggtgctcgatttagatcgtctgtgttgggtttgggggtctcagagaggagccttagccctggactccaaggccctttccacttggtgatcagcactgagcacagaggactcaccatggaattggggctgagcttgggttttccttgttgcttattttagaggtgtcagtgtgacgtgcaactgggtggagtcgtgggggagtcgttgggtccaggccggtcggggggtccctggacgtcctctccgtggtnccagccctgtggtacttccgtaatttggtagtcttagttggatcgggacgttcggggtccctaccgtacggttccgtaccggaagggggaacggggtcgtagggtagggtcggggtacggacccgtaaacgtaacgtaaccggaaggggtacggggttagggttaaacggtaaaaacgtaaaaaacgttggttacggtacgggtaactcggttaggggtccggggaccgggggtaccctacgttaccgaacctagtcctaccgagaacgaaccaacgaaacctaaaactcgatagtatcctagacaaacgtccgggacgtcccgtaggaacgtaacgtacccgggaacggtaccgtacggacttagggttcttaagttttccgtgggtaacgaccggttaaaggttaagttaaccgttttaagaaaaccggtttaacttaaacgggtttagaacggttacgtagttaacggtattacggtaaagtttcgg

SEQ ID NO: 115553 - DNA, 981 bp, Homo sapiens
  misc_feature: GYAE6OF01ERFSD.37.34.D01.1.454.CMB.1.raw
tcagtagtgtagatcacgaccggtgctcgatttagatcgtctgtgttgggtttgggctcagagaggagccttagccctggactccaaggcctttccacttggtgatcagcactgagcacagaggactcaccatggaattgggctgagcgttggttttccttgttgtctattttagaaggtgtccagtgtgacgtgcaacgtggtggagtcggtgggggaggcgtttcggtccgaggcccggttcgggggggtcccctggacgaccttccttcccgtggtcgccgacgcccttaccgttgggtaacttttcccgaaacgttttttgggtaacggtactttagtttgggtaagtgggtaccgttcgggggtccccgcccgtagttcccgtccccggaaggggggaaacggggtccgttaggggaagggttcgggggttacgggaccctaaacgtaacgtaaccggaagggggttaacggggttacgggttaacggggtaaaaacggtaaaaaaaacgttaggtttacgggttacgggtaaaccgtttccgtacggggtttcggggaccccgggggggtccccggtaacgttttaccccgaaacccgtacgtttcccgttaaccccgaacgggtaaaccggaaaccccggtaaaaacccgggaaaaccccctaaaaaaaaacccggttcctaaacccgtttacggttaacgttcccgtaaggtaacccgtaaaagttcggggtaaccccgggtaccgtacgggtaacggtaaccgtaccccgggtaacggggaaccccgtaaccgggttacgtttacggttaagtttaaacgttttaggtttacgggttacggtaacggggtaagttaaacgggttaaagtttttaaaccggtaaccgttaaaacgggtttaaaacggttttaacgggaacgggtttaacggttaccggttaagggtttaacggttggtaagttttaaaccggg

SEQ ID NO: 115554 - DNA, 380 bp, Homo sapiens
  misc_feature: GYAE6OF01B4HLE.37.34.D01.1.454.CMB.1.raw
  modified_base (331)..(380): a, c, t, g, unknown or other
  misc_feature (331)..(380): n is a, c, g, or t
tcagtagtgtagatcacgaccggtgctcgatttagatcgtctgtgttggggtttggggggaagaggaagactgacggtcctgccacaggtggtgctgaggaagagatggaggtggacgtgtcagcacccagctggggcctgtccctggtccaccgtctcctcagcctccaccaagggcccagtccggtcccttcccccgtgggccgcccctgcctccgaggacgccacctccggagagcacgaggccggcccgtggggctgccgtggtacaaggactacttccatcctacactactgaggcgggctagggccaagggccgtacaatagcannnnnnnnnnnnnnnnnnnnnnnnnnnnnnnnnnnnnnnnnnnnnnnnnn

SEQ ID NO: 115555 - DNA, 589 bp, Homo sapiens
  misc_feature: GYAE6OF01CDTPG.37.34.D01.1.454.CMB.1.raw
  modified_base (538)..(538): a, c, t, g, unknown or other
  misc_feature (538)..(538): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgctattttagaaggtgtccagtgtgacgtgcaacgtggtggagtcgtgggggagcttggtccagccgtggggggtccctgagactctcctgtgcagcctcgtggattccaaacttttggtaagccttattgggatgggactggggtcccgccagtcctccgaggggaaggggctgggaggtgggtcggaccaaacgatacgagggtacggtggtacggtaaacgaaaaaactgtggtacggacttctaggtcgggcgggggaccatttcaccctatccgtaccgagacgaacaacgaacccaaaactcaactgtatctgacaagtggaccgtctagagactccgaggaccacggctgtagttatagttgngacgagagtattagataacgtaagtttcgagttgaacgttgtactgtatag

SEQ ID NO: 115556 - DNA, 869 bp, Homo sapiens
  misc_feature: GYAE6OF01ECF8H.37.34.D01.1.454.CMB.1.raw
tcagtagtgtagatcacgaccggtgctcgatttagatcgtctgtgttgggtttgggggtctcagagaggagccttagccctggactccaaggccctttccacttggtgatcagcactgagcacagaggactcacatggaagttgggctgagtcgttgggtttttccttgttgcttattttagaaggtgtcagtgtgacgtgacaacgtggtggagtcggtgggggaggtcgttcgggtccaggtccggtggggggtccctggacgtcctccgtccgtggtgaccgacgcccttcgtaggtatttaccgtaacgttttggtagtacgttagtttggaagtcgggacgtttcggggtccccgcctaggttaccggtaccggaagggggaacgggggtcgtaggggtaacgggttcgggggtacggaccccgtaaaacggaggttaaaccgggagggggtacgggggttagggtaaacgggttaaaaaccgtaaaaaacgttggttacgggtacggttaacgtcggttagggtccggggaccggggtaaccgtacttcccgaacgtactcccgtaccggaagaacgaaccgaaacccgtaaacctaaaaaccgtccgacgtttaacgttacgtaccgttaacggaaacgtaaacgggtacgggtaaccggccgtaaggaccgtaacggaacccgggtacgggaaccgttacgggtacgtttagtaggtttaactttacggtcggtacgggtaaacggtaaagtaacggttttaaacgtttaaacgggtaacttaaaacccggggttaaaaggttttaccgggtaaagggtacccgttaagggttagttaaacggttggttaacgggttaacg

SEQ ID NO: 115557 - DNA, 1006 bp, Homo sapiens
  misc_feature: GYAE6OF01DK3NP.37.34.D01.1.454.CMB.1.raw
tcagtagtgtagatcacgaccggtgctcgatttagatcgtctgtgttgggtttgggctcagagaggagccttagccctggactccaaggcctttccacttggtgatcagcactgagcacagaggactcaccagtggaattggggctgagtcgttgggttttccttgttgcttattttagaaggtgtccagtgtgacgtgacaacgtggtggaggtcggtgggggaggtcgttcgggtacccgacggtcccggttcgggggggttcccctaggacgtaccgttccttccgtggtcgaccgtacgtcccttcgtaggtactttcgtaaaccgttttggtacgtcttagttaggagtcggacgttcggggtcccgaccgtacggtcccgtaccggaagggggtaacggggtcgtaggggagggttcggggtacggaaccctaaacgtaacgtaacggaaggggtagggttacgggtaacggttaaaaaccgtaaaaaagttggttacgggttacggtaccgttaccggttggggttacggggacccggggtacccgttaacgtttacccgaacccgttacgttacccgttaacccgaaaggtaaacccggaaacccgaaaaccccggtaaaaccccttaaaaaaaacccgttcccgttaaaccgtttaacggtttaaccttaccggttaaacggtaaaccgtaaaacgggttacccggggaaacccggtacccggttaacgggaaacgggtaacccgttaaccccggggtaaacgggtaaaccccggtaaccggggttaccgtttaacggggttttaaggttttaacgttttaaacgggtttacgggtaacgggtaaacccgggtaaagggttaaaacgttttaaacggtttttaaaacggtaaaacccgttttaaaaccgggtttaaaaccgggttttacgggttaaacggtttaacgggttaaacccggtttagggtttaaaggtttacggtaaggttttaaccggg

SEQ ID NO: 115558 - DNA, 882 bp, Homo sapiens
  misc_feature: GYAE6OF01B6GGB.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttggttttccttgttgcgttattttagaaggtgtccagtgtgacgtgcaacgtggtggagtcggtggggaggtcgttggtaccgacggtcccggttcggggggtccctggacgtaccttcgtccgtggtacgcctacggtcctcgtaggtacttacgtaacgttttggtagtcttagttggagttacggacggttccgggttcccgaccgtacggttaccgtaccggaaggggggtaacgggtcggtagggtaacgggttcggggtacggacccgtaaacgtaacgtaacggacggggtaagggttgggttaaacggtaaaccgtaaaaaacgttggttacgggtacggtaaccgttcggttacggtcggggtacccggggtacccgttacgttcccaaccgtagtttacccgaaccgtaaacgaaccggtaaaccaaacccggtaaaaccccgtaaaaaaccgttcctaaacgtttacggttaacctacgttaaacggtaacccgtaaaacggtcccgggtaaccgggtacgtaaacgggaacgtaacccggtaaccgggaaacgggtaccccgggtaacggttaccgttaacggtttcgtttaatttaccgggttggtacccggtaagtaaggtaaaccggtttaaaggttaaccggtaaacgtttacggttaaaccggtttacgtaacgttaacggtacgttagggtttaacgtagttaggtttaacg

SEQ ID NO: 115559 - DNA, 866 bp, Homo sapiens
  misc_feature: GYAE6OF01EKA6W.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagagactcaccatggaagttgggctgagtcgttgggttttccttgttgcttattttagaggtgtcagtgtgacgtgcaacgtggtggaggtcggtgggggtacggtcgtttcgggtcccgacggtcccgggtttcgggggggtcccctcggtaacgtaccgttccttcccgttggtacgcctacggtcccttcgttacggtaacttttaccgtaacgttttggtacgtactttaagttggtagtcgggtacgttccgggtccgaccgtcggttccgtaccgggaggggtaacgggcgtgggagggttcgggacgaccgaacgtagtaacggaggggtaggttcggtaacggtaaaacgtaaaattgtcggttacggtacttcggtggtaccggggtccgggtaccgttacttacccgtaaccgtacgtttaccgaacccgtaaggaacgaaaccccgtaaacccgtaaacccctaaaaaccgttcgaaaccgtttacgtttaacgttacgtaaccgtaaccgtaaagggtcgggtaaacccggtcctaagggtaacgtaacccgtaacgggaccgggtaaccgtacgggttacctttaggttacttttaaggtttacgttcggttacggtaacggtaaaggttacggtttaaacgttttaaaggtaaaccgtttaaaccggtttaaagggtttacccgtaaggtttaaaccggtttaggttaagggtttattaggttaacggttta

SEQ ID NO: 115560 - DNA, 699 bp, Homo sapiens
  misc_feature: GYAE6OF01BZ0XD.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaacttttggtagctagttggatggactgggtccgccagtctccgagggagggctgggagtgggtgaccaacatacgagggaggtggtaggtaacaaaaactgtgtggactcgtggtggcggggacgtattacgaccatctccagacgacaacgaccaaaaactcactgtactcagaacaagtaggacggcctagacgacgtacggacggacgacggcgttgtagttacttagtttgcgtacggtaaggtagttagtttaacgaacttaaacgaaagttttcggaagtgtacgttaggtacttagtagtgtacttagtacggtacgttaaccggtcgggaaccggtaaacgggtcctaagttccgggtaccttacccggttcttaccgttaccgacccgtacccgttaccccgaacccggaacggtcccctaacggtttccccggttacccgttccccgtcggcccggtccccttcggacccgtccgaccgggaccgacccgtcccgtacggacgacgacccgacgtacccggg

SEQ ID NO: 115561 - DNA, 945 bp, Homo sapiens
  misc_feature: GYAE6OF01B8H4I.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaactgggtggagtcgtgggggagtcgttcggtccaggcccggtggggggtcccctggacgtaccttccgtcctggtgccacgcccttcgtggtacttacgtaaccgttttagggtagtaccttagttgggagttcgggtaaccgttcgggggtccccgtcccgtaaggttcccgtaccccggtaagggggggtaaaccgggggtccggttaggggtaggggttagggggttacccgggaaccccgtaaaaccggtaagttaaacccgggaagggggggttaacgggggtttacggggtaaaccggggttaaaaaccggtaaaaaaaccgttggttacgggttaacgggtacccggtttcggttacgggggtcggggtccccggggggtaacccgttaacgtttaccccgtaacccgtacgtttaccccgtacccggaaacggtaaccgggaaaaccctaaacccgggaaaaccccctaaaaaaccgttaccgtaaaccgtttacggttaaccttaccggtaacggtaaacccgtaaagttacccgggggtaaccggtcccgtaaggtaaaccgggtacggtaccccgggaacggtaaccccgggtaacgggttacccgtttagggtttaacgtttacgttttaggttcggtaccggtacggtaacgggtaagtttacggtttaacgtaaacgtttaaacggttaaacgtttacgtaggttacgtacgttaggtacttgtagtttacg

SEQ ID NO: 115562 - DNA, 713 bp, Homo sapiens
  misc_feature: GYAE6OF01BWY7Z.37.34.D01.1.454.CMB.1.raw
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
tcagtagtgtagatcacgaccggtgctcgatttagatcgtctgtgttggggtttgggggggaaagaggaagactgacggtcctgccacaggtggtgctgaggaagagatggaggtggacgtgtcagcacccagctcggggcctgtccctggtcaccgtctcctcacgtccctccaccgaacgggccccaagttccgggttcccttccccccgtgggcccgtcccctggccctccgagggacgccaacccgtccgagagccaaccgaggccggcccgtggggcctcggcccgttaggtacgaaacgggtaccttaaccgttccaattcctaaccaaccgttaaaccgtggaacggtccggggtccttaggggaccgaaacggggcccaacgtaacgttacggcacncggtctacgtgagcgaccgattacgaacggntacgtacgtacgacgacgacgacgtacacgacgtacgtcgtacgtacgtacgtacgtacgtacgtacgtacgtacgtacgtacgtacgtacgtacgacgtactacgacgtacgtacgtacgacgacgtacgtacgtacgtacgtacgtacgacgtacgtacgtacgtacgtacgtacgacgtacgtacgtacgtcgtacgtcggtacgtacgtacgtacgttacgtacggtacgtacgtacgtacgtaccgtacgtacggaccgtccgtcgtacccg

SEQ ID NO: 115563 - DNA, 658 bp, Homo sapiens
  misc_feature: GYAE6OF01BTOPQ.37.34.D01.1.454.CMB.1.raw
  modified_base (270)..(270): a, c, t, g, unknown or other
  misc_feature (270)..(270): n is a, c, g, or t
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgagggaaggggctgggagtgggtggccaaacatacgagggaggtggtggtaacgaaaaaactntgtggactcgtgtgcgggcgattcacatctccagagacaacgaccaaaaactcgactgtatctagacaaagtcggacgcctggaagacgtccggaaggaccacggactggtgtattagttgngngaagagtatttaagactaactaagtttcgagtgtactggtatgtatgtacttaagtgacgtaccgtaggggaccaagggacctaggtcgtaccgaccgttcctacttccgacgtccccgaccaaccggtaacgggcccctaacggttcccgggttacccctttacccccccggtgggtaccccggtcccccgtacggtccccgtacccggagggtacccgacccgtaaccccgtcccggaaggtaccgcccgtaaccgaccggg

SEQ ID NO: 115564 - DNA, 725 bp, Homo sapiens
  misc_feature: GYAE6OF01AY253.37.34.D01.1.454.CMB.1.raw
  modified_base (317)..(317): a, c, t, g, unknown or other
  misc_feature (317)..(317): n is a, c, g, or t
  modified_base (700)..(700): a, c, t, g, unknown or other
  misc_feature (700)..(700): n is a, c, g, or t
tcagtagtgtagatcacgaccggtgctcgatttagatcgtctgtgttgggtttggggctcagagaggagccttagccctggactccaaggcctttccacttggtgatcagcactgagcacaggaggactcaccatggaattggggctgagcgtggttttctgtagctatttagaggtgtccagtgtgacgtgcaacgtgggtggagtcgtgggggaggtcttggccaggccgtgggggtccctgacgactctccgtgtgccacgcctcgtggtacttctaacgtttggatactagttggagtggtactcggggtccnccgtagtccgtaccggaagggggacggggtcgtaggggtaggttcggggaccggacctaacgtacgtacggagggggtagggttacggtaacgggtaaacgtaaaaacgttgtaggtcggtaacctcgtcggggttgggacccggggtccttacgttaccaacccgtagttccgtaccgaaggaaccgaaacccgaaacccggtaaacccctaaaaacgtccgttaaaccgtcggttaactacccggaggtaaccctaaaggtccggacggtcgtaggacgacgtaccggaggaccgtacgtagtacgttagttaagttcgttggaggtagtaagggtacttaacgttagaaaccgttaagttaaacgggttcggaacggttnttacgggttagcgttagtcgttacg

SEQ ID NO: 115565 - DNA, 615 bp, Homo sapiens
  misc_feature: GYAE6OF01C0B75.37.34.D01.1.454.CMB.1.raw
  modified_base (257)..(257): a, c, t, g, unknown or other
  misc_feature (257)..(257): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagcttgggttttccttgttgcttattttagaaggtgtccagtgtgacgtgcaactggtggagtcgtgggggaggcttggtccagccgtggggggtccctgagctctctgtncagcctgtggtattactaacgttttggtagctaagttggatggaccgtgggtcccgccgtagtcgtccgaggggaagggcgtgggaggtgggtcgaccaacgagtacggagggaggtggtaggtaaacgaaaactgtagtcggactgtggtcgggcgggcctagttccaccgtatcgtccgagaacgaacgaaaccgaacctaaaactcgtactagtatccgtagacctaaagtcggacgtccagacgacgtcggacggacgacgcttcgttagtattagttgtcgacggtagtaggtaagttagaaccgttaaagttaaacgttcgacgttacgacgttaggtactggtaagttcgg

SEQ ID NO: 115566 - DNA, 846 bp, Homo sapiens
  misc_feature: GYAE6OF01AEZBC.37.34.D01.1.454.CMB.1.raw
tcagtagtgtagatcacgaccggtgctcgatttagatcgtctgtgttggggtttgggggcaggagtcagacccactcaggacacagcatggacatggacggggtccccgctcagcctccgtgggggcctcctgctgctcgtcggcctcccgaggtcgccagatggtacgccactaccaaactcgaaccctagtcctccactcccttccctcgtctgctatcgtaggtaggacgacgaggtacgtactactacctactaccgtacgttccgggaccgggtacgaacggtcggaacgggtactaaagttaagtaaattggttaagtttacggtcgttaggtactacgacgaacgtaaacggaaaccggaacgggaaccctaccctaacgccttacctacgttactacggttacgtcgggtactacgtaaccgttaccggttaaacgtttaacccggtaaccgggttaccgggttaaaccttaaaggtttaacgtacgttacggacgggtacggtacgtaacgggttacggtaacgttcggtaccggtaacgtaactttaacgttacctttacccgtacccttccgtaacctaccgtaccgtaccgacgtaccggtaactcccgacgtaccgacgtttacggtaagtttacggttacctttataacctttagtttaccgttaactacgttaaccttaaacgttaacttaaccttaacccgttaccgtttaaccggtccgggtttacccggaacggtaaccggggtaaaccgggacggttaacggggtaaccgtaaacggttaaaccggtaacggtaccggttggtaacccggtaccgttccgtcgtacc

SEQ ID NO: 115567 - DNA, 637 bp, Homo sapiens
  misc_feature: GYAE6OF01D1O9O.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctggattcaacgtttggtagtcttagttggatggacgtcggggtcccgccgtagtccgtccggaggggaacgggggctgggaggtggggtgaccaacagtacgaggggtaggtggtaggtaaacgaaaaactgtgtggactcgtggtcggcggggcctattccaacctactcgtaccgaagacgaacgaacgaacccaaaactcactagtactcgtagacctaaagtcgggaccgtacgtgaacgtcgtaccggaggaccacgggtcttggttattagtttagttggtacgtacggtaagtaaggtagttttaacggaacttaaccgtaaaggttttcggaagttacggtaacgtagggttaactggtgtacg

SEQ ID NO: 115568 - DNA, 695 bp, Homo sapiens
  misc_feature: GYAE6OF01BS92C.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgcttattttagaaggtgtccagtgtgacgtgcaacgtggtggagtcgtggggagcttggtccagtccgtgggggtccctgacgctctcctgtcgcagcctgtggtacttcgtaacgtttggtacgtcttagttggagttcgggtacgtcggggtccgccgtagttccgtaccggaagggggtaacggggccgtgggacgggttcggggtacggaccaacgtacgtaacggaggggtaggttggtacggtaaacgaaaacgttgtggtacggacttcgtggtcggccggggtacctagttccgactacgtcctacgagaacgaacaaccgaacccaaaaaccgtcaacttgtaactcgtacgaacgtaaagtccggaccgtaccgtagacgtacgtaccggacggaccgtacggtacgttacgttagttattacgttggtacgtacggtaaggtacgttaaacgtttaacgaacgtttaacgtaaacgtttcggaacggttacgtacggtttaggtacttggtagttacgg

SEQ ID NO: 115569 - DNA, 969 bp, Homo sapiens
  misc_feature: GYAE6OF01DJGHW.37.34.D01.1.454.CMB.1.raw
tcagtagtgtagatcacgaccggtgctcgatttagatcgtctgtgttggggtttgggggcaggagtcagacccactcaggacacagcatggacatgacgggtccccgctcagctcctggggctcctgctgctctggctccaggtgccagatgtgccataccaaatcgacccagtctccatcctcctgtctgcatcgtgtaggagacagagtcatccgatcctacgttcggaccgggactaacggtcgaacgggactaagttaagtaaagttaggtaacttttaacgggtaccgttaggggttaacttaccgaacggaaccgaaacggaaaacccggaacggggtaaaaccgtacccccgtaaggtccctacctactacgttactacggttggtcgaacctactaccgttaacggtttaaccgaaaccggttccggggttaaccctaaagtttaaacggtaacgtttaccgacggaccgggtacggttaacgggtacgggttacttaccgggtacgggtaaccgtaaaccgttacgggtttaacctttttaccccgaacccgtttaaccccgttaacccctaaaccccgttaacgtaacccgtaacgggtacccgtaaccgggttaccccgttaccggaaccggtaaccccggttaccgttaaacgggtaaacgtttttacgggtttttaacctaaaccgttttaaaccgtttttaccgttaaaccggtttacggtttaaacccttaaaacgggttaaacttaacccgttttaaacccgtttaaacccggttttaacccccggtttaccgggttttaaccccggggttaacccggggaaacccggggtttaaaaacccggggaaacccggggttaaacgggttaaacggggtaaaacccgttaaaaccggaaaaccggtttaaccgggttacgggtaacggttacccggtccggtaacccgttaacccgg

SEQ ID NO: 115570 - DNA, 729 bp, Homo sapiens
  misc_feature: GYAE6OF01AX5TX.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgtgggttttccttgttgctattttagaaggtgtccagtgtgacgtgcaactggtggagtcgtgggggagtcttggtccagccgtggggggtccctggagacctctcctgtgcagtcctcgtgattatgtttagcaactctggcatgaacgtgggtccgccaggcctcgaggcaggtggggctgcgaggtcgggttcctacgaaggttactaggtcgtccttccggtaggttaaatcggaagcgaaagtaccttaaccgcgacggtacctcccgggtagggtaaccgggtcccggtttaccacctacttacccgaacccgacggtaacgaaccgtaacgttaacccgtaaacgaacctaaccggtacccttaacttagtccctttaacgacccgtaaaataccgggaaacctacggaccccgttaagggaaccggtaacggacccggaaacggtacccgtaacccgggttacgttaacgtttaaccgttacgttaacgggttcgggtaacggaaaggggtcggttaggggggtaacgggttacggggggaccggtttaacgggtcgggggtaacccgggg

SEQ ID NO: 115571 - DNA, 805 bp, Homo sapiens
  misc_feature: GYAE6OF01DKWD7.37.34.D01.1.454.CMB.1.raw
  modified_base (104)..(104): a, c, t, g, unknown or other
  misc_feature (104)..(104): n is a, c, g, or t
  modified_base (116)..(116): a, c, t, g, unknown or other
  misc_feature (116)..(116): n is a, c, g, or t
  modified_base (519)..(519): a, c, t, g, unknown or other
  misc_feature (519)..(519): n is a, c, g, or t
  modified_base (627)..(627): a, c, t, g, unknown or other
  misc_feature (627)..(627): n is a, c, g, or t
  modified_base (694)..(694): a, c, t, g, unknown or other
  misc_feature (694)..(694): n is a, c, g, or t
tcagtagtgtagatcacgaccggtgctcgatttagatcgtctgtgttgggtttgggctcagagaggagccttagccctggactccaaggcctttccacttggtnatcagcactgancacagaggactcaccagtggaattggggctaggacgtcgttgggttttccttgttagcttaagtttttaggaaggtcgtacctaggtgtgacgtgaccgtaagtgggtaggaggttccggtagggggacgtcggttcgggtaccgagggtccccggttgggggggtacccctaggaacgtaccgttccgtccgtgtcgacggacctccgtcgtaggtactttaccgtaaaggttttgggacgtacttaggtaggtcgtacgacgggttccggtcccgactacggtacgcggaacgggacggttgaggtcggtacggggtaccaacgaaacccgttagggacggtaaggggtacggggttaaggtttaaccggaaaaaaccgttaaaaatggtttaacccgggnggtaacttcggtacggggtacgggcccggggaatttacccaacgggttaccaccttacgaccgaagaaccgaaccgtaaaccgtaaacctaaaaacgtctaacgttanacccgttagtacgaaacggtacgaacgggaccggtatacggacgtaacgaaccgacgacgtaaccgngttggtactagttcggttagtcggataaggtaacgtaagttacgtaaaccgttaaacgtaaacgggttacggaacgttacggtaccgttagggttactagtacgttaacgg

SEQ ID NO: 115572 - DNA, 782 bp, Homo sapiens
  misc_feature: GYAE6OF01AK4MZ.37.34.D01.1.454.CMB.1.raw
  modified_base (585)..(585): a, c, t, g, unknown or other
  misc_feature (585)..(585): n is a, c, g, or t
  modified_base (771)..(771): a, c, t, g, unknown or other
  misc_feature (771)..(771): n is a, c, g, or t
  modified_base (777)..(777): a, c, t, g, unknown or other
  misc_feature (777)..(777): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggcctcccgaggtgccgagatgtcgccactaccaaatcgacccagttccttcccttcccacccttgtctcgactatcgtaggtaaggacgacgagtacgtaccaccgtactaccgtaccgttccgggcccgggaccgtacgggtaccggtaacgtttaacgttttaaccggttaccgtttggggttcggtaccgttaggtaactaacccaaaaccgaaaccggaaaacccggaaggggaaaccccgtaccccggttaaaggtcccgttagtacttacgtagtacgtacgtccgtacccttaaccgttacgggtttaacggggaaaccgggtccccgggttaacctaacggttaacggtaacggttccgaacggccggtactaggttacgtacgtcggtaacgggaactagtaccttaccgtactcctaccgtacctacgtagtacgtcgtccnggtaccacgttcgtagtacgtttaagtttacttccgaacttttaaccgtttattacgtcgtacaccgttacgttaacgtaaggttacggacggttaacgtccggtacccggaacgggtacgggtacggtaggtagtacgtaacgtaaaccggagtggtcgtacggctacgacctagtcttaccgtntccgtntcccg

SEQ ID NO: 115573 - DNA, 945 bp, Homo sapiens
  misc_feature: GYAE6OF01BXH9R.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcgttgggtttttccttgttgtcttagttttggaaggttgtccagtgtgaggtgactaagttgggtggaggttcggtggggggacggtcccgtccggtccgacggtcccggttcgggggggtcccctaggacgtaccttccgttccgttggtgttacgtcccttcgttagtaaactttccgtaacgttttggtacgtcttagtttggtaagtcgggtacgttccgggggtccccgtaccgtacggttcccgtaccgggaaggggggtaacgggggtcggtagggggtacgggttcgggggtaccggacccgtaaacgtaacgttaaccgggaaggggggtaggggttacggggttaagggtaaaaaccggtaaaaaacgttggttacgggtacggtaacccgttcggtttacggggtcggggtacccggggggttacccgtaacggtttaccccgaaacccgttaccgttaccccgtaccggtaaacggaaacccggtaaaccccgaaaacccggtaaaacccctaaaaaaaccccgtccctaaacggttacgttaacccgtacgtacggtaaaccgtaaaacggtaccggggtacccggtacccgtaggtaaccgtaccgtacccggggaagggaacccgtacggggtaccgtttaggttagttacgttttaggttcgggacggttaaccgggagttaaaacggtttagtttaaaccggtaaacgttaaacggtttaaacggttttaccggaaggttacgtacggttaggttaacttgggtaacttggttaacg

SEQ ID NO: 115574 - DNA, 900 bp, Homo sapiens
  misc_feature: GYAE6OF01D83VV.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccagtggaagttggggctgagtcgttgggttttccttgttgcttattttagaagtgtcctagtgtgacgtgacaacgtggtggagtcggtggggagtcgttggtccgacggtccggtggggggtaccctggacgtacctctccgtgtcgcacgtcctctggtactttacgtaaccgttttggttaggtccttaagtttgggattcggggtaccgtcggggtcccgtaccgtaggttccgtccggaagggggtaacgggggtccgttggggaaggtttggggtccgggaacctaaacgtaacgtacggagggggtaagggttggtaacggggttaaaaacgaaaaaacgttgtagggttacggaaaccttcggttcggggtacgggtcccgggggacctaacggtttaccctaaacccgtagttacccgtaaaccccgtaacggaaaccggtaaaccccggtaaaaacccgaaaacccccgttaaaaaaacccggttcccaaaacggtttaccgttaacgttaccccgttaaacggtaacgtaaaaaccgggttccgggaaaacccgggtccccgtttaaagggaacgggtttaacccggaacccggggtaacggtaaacccggtacccggggttaagtttaccggttaaggtttaagttttagttacgggtacgggtacgaaacggtagtttaacgtttaacgtaaaccgtttaaaggtaaaccgttttacggaaggttacttaacggtaggttactagtcgttaacg

SEQ ID NO: 115575 - DNA, 842 bp, Homo sapiens
  misc_feature: GYAE6OF01B2YJF.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgctattttagaaggtgtccagtgtgacgtgcaactggtggagtcgtgggggaggcttggtccaggccgtggggggtccctgacgactctcctgtgcacgcctcgtggtagttactaacgttttggtagtcttagttggagttcgggtacgtcggggtccccgccgtaggttccgttacccggaaggggggtaacgggggtccgttgggggacgggttgggggtaccgggacccaaaacgaacgttaaccgggacgggggtaggggttagggttaacggggtaaaaccggtaaaaaacgttagttacgggtacgggaaccgtttcggtcgggttcggggacccgggggtacccgttaacgtttacccaaccgttacgttaccctcccgaaagggtaaccgaaccgaaacccgtaaacccctaaaaaaccttccgaaccgtttacgttactaccgtacgaaacgtaaacggtcgggaacccggtaccgtaggaacggtaaccgtacccgggaacgggaacccgtaccgggtacgttacgggttacgtttaagtttacggtttggtacggtacgggtaaagtaaggttaacgttttaaacggtaaccggttaaacgtttaaaagggtttaccgtaagggttaccggttaaggttaggttagttaggtagttaaccgg

SEQ ID NO: 115576 - DNA, 745 bp, Homo sapiens
  misc_feature: GYAE6OF01AKGL9.37.34.D01.1.454.CMB.1.raw
tcagtagtgtagatcacgaccggtgctcgatttagatcgtctgtgttgggtttgggggctcagagaggagccttagccctggactccaaggcctttccacttggtgatcagcactgagcacagaggactcaccatggaattggggctgagcttggttttccttgttgctattttagaggtgtccagtgtgacgtgcaactggtggagtcgtggggggaggcgttgggtcccaggccggtcgggggggtccctggacgtacctcctcctggtcgcacgcctcgtggtacttcgtaacgtttggtagcttagttggtagtgggtacgtcggggtacccgccgtagtccgtaccggagggggaacggggtcggtagggagggtcggggtcggacccgaaacgagttacggaggggtagggttagggtacgggtaaaacgaaaacgttagttaggtacggtacttccgtgggtacgggcggggtaccgtacttaccgacctattccctaaccgaggaaccgaaccgaaacccgaaacccctaaaaaccgttactaaccgttaggttaaccttacgtacgtacgtaaacgtacggggaaccgtccgtaggaggtaccgtaccggaacggtaccgtaccggtcgttcggttagtttacttaggttgtgggacgtaagtacggttaacgttagtaaaccttaacgttaaacgttcggtaacggttcgtaacgttaggtacttggtattacgg

SEQ ID NO: 115577 - DNA, 914 bp, Homo sapiens
  misc_feature: GYAE6OF01BMMRX.37.34.D01.1.454.CMB.1.raw
tcagtagtgtagatcacgaccggtgctcgatttagatcgtctgtgttgggtttggggctcagagaggagccttagcccctggactccaaggcctttccacttggtgatcagcactgagcacagaggactcaccatggaattggggctgagctgggttttccttgttgcttattttagaaggtgtccagtgtgacgtgcaactggtggagtcgtgggggaggtcttggtccgaggtcccggtcggggggttcccctggacgtaccttccttcctggtcgcacgcccttcgtaggtactttccgtaaccgttttgggtacgtcttaagttgggagttcgggtaccgttcggggtccccgccgtacggttccgtacccggaagggggaacggggcgttggggtagggttcggggttacggaccccgtaaacgtaagtaaccggaagggggtaggggttagggttaacggggtaaaaccgtaaaaaacgttaggttagggttacgggtaaccgtttcggttgggttccggggacccgggggtacccgttaacgtttaccccgaacccgtaacgttcccgtaacccgtaacggtaaaccggaaaccccgtaaaaccccggaaaccccctaaaaaaaaccgttcccgtaaaccgtttaacggttaccttaccgttaacggaaaccgtaaacgggtacgggtacccgggtaccgtacgggaacggtaaccgtacccggggaacggaacccggtaccggtcgtttaggttacgtttagtttacgtttagggttacggtacgggtaagttaacggtttaaagttttaaccggaaaccgttttaaaaccgggtttaaaacggttttacccgggaacggtttacggttaacggtttagggtttaacgttaggtaacgtttacggg

SEQ ID NO: 115578 - DNA, 508 bp, Homo sapiens
  misc_feature: GYAE6OF01EM2I6.37.34.D01.1.454.CMB.1.raw
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (432)..(437): a, c, t, g, unknown or other
  misc_feature (432)..(437): n is a, c, g, or t
  modified_base (439)..(508): a, c, t, g, unknown or other
  misc_feature (439)..(508): n is a, c, g, or t
tcagtagtgtagatcacgaccggtgctcgattttagatcgtctgtgttgggtttgggggggaacgaaggaagactgacggtcctgccacagggtggtgctgaaggaagagatgggaggtggacgtgtcagcacccagctggggcctgtccctggtcaccgtctcctcagcctccaaccgaaggggcccagttccgggtccctttaccccccgtgggcccgccccgtggcctcccgaagggacgaccacccgtccggaagacgcacgacggccgggcccgtcgggcctcggtcccgtagggtaccgaaaacgggtacctttaacccttaccgactttaccgtaaaccgtacccttaccggttggggaacgggtccgggggtacgttcggggaacgaaacggggtccggacctaagtaagggctgcagntnacnnnnnngnnnnnnnnnnnnnnnnnnnnnnnnnnnnnnnnnnnnnnnnnnnnnnnnnnnnnnnnnnnnnnnnnnnnnn

SEQ ID NO: 115579 - DNA, 831 bp, Homo sapiens
  misc_feature: GYAE6OF01D407T.37.34.D01.1.454.CMB.1.raw
  modified_base (752)..(752): a, c, t, g, unknown or other
  misc_feature (752)..(752): n is a, c, g, or t
tcagtagtgtagatcacgaccggtgctcgatttagatcgtctgtgttgggttgggctcagagaggagccttagccctggactccaaggcctttccacttggtgatcagcactgagcacagaggactcaccagtggaagttggggctgagcgttgggtttttccttgttgcttagttttagaaggtgtccgaggtgtgacgtgcaacgtggtggagtcgtggggaggtcgttggccgaggtccgtcgggggtccctagacgcctctcgtgtcgaccgacgtcctcgtaggtactttaccgtaaacgttttgggtaacgtcgttagtttagggaacgttcgggtaccggttcgggggttaccccgcccgtaaggttcccgttaccgggaaggggggtaacgggggtaccgtgggggtacgggttagggggtaccgggaacccgtaaacgtaacggttaaccgggaagggggttaacggggttaggggttaacgggtaaaccgtaaaaaaacgttggtaagggttcgggtaaaccttcggtagggttacggggccgggggtacccttaacgttacccgtaacccgtaacttcccgttaacccgaacggaaaccggaaccgaaaaccccgtaaaccctaaaaacccgtaccgaacctttaacggtactaccgttagaacgtaagtccgggaaccgtccgtagtaacgtacggtaccggaggaccgtacggtacttggtacttagttagtcgtaggngtaacggtaagttcgtttaaggaacttaacggttaaacgttcgggtaagttacggtacgttaagggtgtagagttacgg

SEQ ID NO: 115580 - DNA, 663 bp, Homo sapiens
  misc_feature: GYAE6OF01DV51S.37.34.D01.1.454.CMB.1.raw
  modified_base (200)..(200): a, c, t, g, unknown or other
  misc_feature (200)..(200): n is a, c, g, or t
  modified_base (313)..(313): a, c, t, g, unknown or other
  misc_feature (313)..(313): n is a, c, g, or t
  modified_base (406)..(406): a, c, t, g, unknown or other
  misc_feature (406)..(406): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtagganacagagtcatcatccacttgccgggacaagtccgagggactattagaaattgtatttaggctggtatcagacaagaaaccgaggaaccgccctaagcctactcatctatggtnctatctattacaacgtggtaccaattaagacttcgagtcgactagtgtatcgtacggacacgtagttacgtttcgacctacctacgtaacctntaccgagaccgacgtcccgttacgccgacgtaccgtaagttaaacgttagtttttaccgacgtttaaactttaacgtttactaccggtttaacttaaccgttaaatttacccgttaaccgttaaaccgttttaccccgttaccggtttaaccggttaccggaaacccggtaacggggtaaaccgtaaaggggttcggtaaaacgtaacccgtaaaacgtaccgttaggttaccggggtccttacgtaccgttaaccg

SEQ ID NO: 115581 - DNA, 948 bp, Homo sapiens
  misc_feature: GYAE6OF01CNN2Q.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtcgtgggggaggcttggtccagccgtggggggtccctgagactctcctgtgcagcctctggattctaactttggtagcttagttggatggacgtcggggtcccgccagtccgtccggaaggggaaggggtcgtagggaggtggggtcggaccaaacagtaacggaggggaggtgggtacggtaaacgaaaaactgtggtggactgtggtcggccggggcctattccgacctactctaccgaagaacgaaccaaccgaacctaaaaactctaactgtactcgtagactaaagtcgggaccgcgtagacgacgtaccggaagaccgtacggcttaggttagttaacgtttaggttggtacggacggtaaaggtaaggtttaaagtttaaacgtaaacgttaaacgttaaagggttttccggaagttacggtaacgttagggttaataggtaacgttcttaacgtttaaggacggtttaaccggtaaccccggggttacgggggaaacccgtaaacggggaccctttaagggttacccgggttacccgttaacccgtttccgtttacccgttacccggaaacccccggtcccccgttaaaccccggaaaccccgggtaaccccgggggttacccccttaaacccgggttttccccccgggggtttaccccccccgttttcccccccgggaccgggggtaacccccccgtttcccccgggttaccccgggttacccccggtaaaccccgggtaaaccggggtaccccccgtaaacccccggttaaacccccggggtaacccggaacgggaacccccggtaaccccggaaccccgggtaaccccgggggg

SEQ ID NO: 115582 - DNA, 821 bp, Homo sapiens
  misc_feature: GYAE6OF01EDWLM.37.34.D01.1.454.CMB.1.raw
  modified_base (252)..(252): a, c, t, g, unknown or other
  misc_feature (252)..(252): n is a, c, g, or t
tcagtagtgtagatcacgaccggtgctcgatttagatcgtctgtgttgggtttgggggtctcagagaggagccttagccctggactccaaggccctttccacttggtgatcagcactgagcacagaggactcaccatggaagttggggctgagtccgttgggtttttccttggttgtcttaagtttttaaggaaggttgtccaggtgtgacgtgcaacgtgggtggagtcggtgggggagtcgttggtccgngtccggtgggggtccctgacgctctcgtgtgccacgtccgtcgtgtactttctaacgttttggatcgttagttgggatgggtaccgttggggtcccctcgtacgtccgtaccgggaagggggacggggtaccgtggggtacggttgggggtccgaaccctaaaacggacgttaacgggaagggggttaggggttacgggtaacgggttaaaaaccgtaaaaaacgttagttggggttaccggtaacgtttcggtagggtccgggacccgggggttacctaacgtttacccgaaccgtaccttcccgtaaccgtaacgggaaaccgaaccgaaaacccgtaaaccctaaaaaccgtccctaaacgttacgttaagttccgtaacgaaaccgtaaaggtaccgggaaccgtccgtaaggtacgtaacgtaccgggaacggacgtacggttacgttgttacggtatttacggttggtacgtacgtaagtaaagttacgttaacggttaaacctaaaggtttaaccgttaaggtaacggtttacgtaaggttaggttacttagtaccgttagg

SEQ ID NO: 115583 - DNA, 392 bp, Homo sapiens
  misc_feature: GYAE6OF01A9SYI.37.34.D01.1.454.CMB.1.raw
  modified_base (215)..(215): a, c, t, g, unknown or other
  misc_feature (215)..(215): n is a, c, g, or t
  modified_base (349)..(392): a, c, t, g, unknown or other
  misc_feature (349)..(392): n is a, c, g, or t
tcagtagtgtagatcacgaccggtgctcgatttagatcgtctgtgttgggtttggggggaaggaggaagactgacggtcctgccacaggtggtgctgaggaagagatggaggtggacgtgtcagcacccagctggggcctgtccctggtcaccgtctcctcagcctccaccaagggcccatcggtccttcccccgtggccgccctgcctccaggngccacctccgagacgcacgaggccggcccgtggggcctcgccgttgggtaccaaagggtaccttaccgttaccaattccgtaaaccaccgttactgggacggccggggtctagggacgaacgggccacaatagnnnnnnnnnnnnnnnnnnnnnnnnnnnnnnnnnnnnnnnnnnnn

SEQ ID NO: 115584 - DNA, 682 bp, Homo sapiens
  misc_feature: GYAE6OF01BMTOK.37.34.D01.1.454.CMB.1.raw
  modified_base (613)..(613): a, c, t, g, unknown or other
  misc_feature (613)..(613): n is a, c, g, or t
  modified_base (676)..(676): a, c, t, g, unknown or other
  misc_feature (676)..(676): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttcttgttgcttattttagaaggtgtccagtgtgacgtgcaactgggtcggagtcggtgggggaggtcttcgggtccacggtccggtcggggggtccctggacgtaccttccgttccgtggtcgcctacgtcccttcgtacgggtatttaccgtaacgttttggtaacttcgttagttagggagtcgggtacgttcggggtccgaccgtcgtccgtacggaggggtaacgggtcgtaggggtaggtgggtcgaccaactagtaacggagggtaggtggtaggtaacaaaacgtgtcggcgtactgtggtcgggcggtcagttccacgtcacgtacagacgtaaccaaccgaactaaacctcgtaatcggtactcgtacgaacgtaaacgccgggtacgcgtaggacgtacgaccggtaaggacccgtaggtcttaggtagttaacttgttaaggngtaacgagtagttaacttagtaacgtaacttaaggttccgtagtacggtagttaggagttcgngttacg

SEQ ID NO: 115585 - DNA, 946 bp, Homo sapiens
  misc_feature: GYAE6OF01AU68P.37.34.D01.1.454.CMB.1.raw
  modified_base (815)..(815): a, c, t, g, unknown or other
  misc_feature (815)..(815): n is a, c, g, or t
  modified_base (841)..(841): a, c, t, g, unknown or other
  misc_feature (841)..(841): n is a, c, g, or t
tcagtagtgtagatcacgaccggtgctcgatttagatcgtctgtgttgggtttggggctcagagaggagccttagccctggactccaaggcctttccacttggtgatcagcactgagcaagaggacgcaccactaggtaggtagggtggcgtagacgtcggttttcggtttcttgtcgtatttagttaagtaggtcacgtgtgtacgagtgaacgtaggtgggaggtcggtggggtgggacgttcggttccggacgccggtcgggggttcccggggtacctaggaccgttcctccgtcggttgcgacgtaccttccgtaggtacgttacgtaaccgttttaaggttcgtacgttacgttaggttacggaaggttcggtacgggttcccgggcccaacggttacttcccggaaggggaaagggggtccggtggtaacggggttcggtagggacccgaaactaacgttaaacgggaggggaagggttacgggggttaaacggttaaacggaaaaaaaaccgttaaaggttcggtacggggtttaaccgtacccggtttagggacccgggggttaccggggggtaccgggtacccgttttaaacctaccggtaaaacccggttcctaaccccggtaacgaaaacggtaaaccccgggaaaaccccgtaaaaaccccgtaaaaaccccgtttaaaccgaccgttaaacgggtttaaacctaccgttaacggttaaacgaaaacccggtagggttaaccccggaacccggtaagtaggtaacccggtaaccgggaaacggtaccggaacccgtagggttnttaaacgggttaactttagtttaggngggttaaaccaggttaaaggttaacgtttaaacggttaaccgtaaaattaaacgggtttaggtaaccggagttaccggttaagtaacgtagttaaggcctttaag

SEQ ID NO: 115586 - DNA, 627 bp, Homo sapiens
  misc_feature: GYAE6OF01DFBI5.37.34.D01.1.454.CMB.1.raw
  modified_base (250)..(250): a, c, t, g, unknown or other
  misc_feature (250)..(250): n is a, c, g, or t
  modified_base (444)..(444): a, c, t, g, unknown or other
  misc_feature (444)..(444): n is a, c, g, or t
tcagtagtgtagatcacgaccggtgctcgatttagatcgtctgtgttgggtttccttgttgctattttagaaggtgtccagtgtgacgtgcaactggtggagtctgggggaggcttggtccagccctggggggtccctgagactctcctgtgcagcctctggattcaactttggagctattggatggactggtccgccaggtctccgagggaaggggctgggagtgggtggccaacatacagggagtggngtacaaaaactgtggactctgtgcgggccgattccactatctcagacgacaacgaccaaaaactccaactcgtagtcctagacaaatgggaacgtcctaggacgaagtccgtaggaccacggtcctagttcgtattagttgtcgcgaagcgtattagactacgaagtttacgagtgactggtatgatgacttancgataccgtgggtaccgaagggaccctagtcggtctaccgttctacgttctacgtccctaccaccgacggcccgaacgttcccggtaccgttccccccgtaggccccgtccccgtagacccgtcccgaagggaccgtaaccgtaccccgttacccggaggtaaccggccgaccggtacccggg

SEQ ID NO: 115587 - DNA, 765 bp, Homo sapiens
  misc_feature: GYAE6OF01EX1FV.37.34.D01.1.454.CMB.1.raw
  modified_base (313)..(313): a, c, t, g, unknown or other
  misc_feature (313)..(313): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctatttagaaggtgtccagtttgacgtgcaacgtggtggagttcgtgggggaggtcttggtccaggccgttggggggtcccctggagacctctcctgtgcagcctctggattcaacttttggagctattggatggactaggtccncagtctccgagggaagggctggagtgggtgaccaagtatacgaggggagtgggtaggtaacgaaaaaacgtgtgtaggaacttcgtagtcggccgggggaccgtatttccgaacctagtccttaccgaagacggtaaccaaaccggtaaccctaaaaaaccctaccaacgttagtattaccgtagaacctaaagtcgggaaccggtaccttacgggaacgtaccgtacccgggtaaacgggacccggtaacccgggtacgttacggtttacgttaacgttttaacggtttacggtacgggtaaccgggtaacgggttaaaaccggttaaagtttttaaccgggtaaaacctttaaacccggtttaaaaaagggttttccccgggtaaagggtttacggtaaacccggttttgggtttaaaaccggtttacgttaagtttcggtttaaacccg

SEQ ID NO: 115588 - DNA, 879 bp, Homo sapiens
  misc_feature: GYAE6OF01CN52S.37.34.D01.1.454.CMB.1.raw
  modified_base (257)..(257): a, c, t, g, unknown or other
  misc_feature (257)..(257): n is a, c, g, or t
  modified_base (396)..(396): a, c, t, g, unknown or other
  misc_feature (396)..(396): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttggttttccttgttgcttatttagaggtgtcagtgtgacgtgcacgtggtggagtcgtggggagtcgttggtccgagccggtcgggggtccctgacgctctccgngtgcagtcctcgtggtacttctaacgtttggtagcttagttggagtgggtacgtcgggtcccgacgtacgtccgtaccgggaggggaacggggtcgtagggtagggttgggtaccggaaccgtaacgacgtaaacgggnggggtacggttaggggtaacggtaaaaacgtaaaaaccgtggttacggtacggtaccgttaggtcgggttaccggggtccggggtaccggttacttacccgtaaccgtacgttaccctaaccggaaccggaaaccgtaaccccgtaaaaccccgtaaaaaccccgtaaaaaaccttaccgtaaaccgtttacgggttaacccttaccggttaaaccggaaaccgttaaaaccggggtaccgggtaaacccggggttaaccgttaccgggaaacggtttaaccccggaaccgggtaaacggggtaaccccggtaccggggttacggtttggtttaaacggttttaccggtttagttacggggttacggaaccggtaaaggtacgttttaaagttttaacgaaaacccggtttaaacgggtttaaacgggtttaccgtagggttaaccgttaacggtttaggtaagtttaggtaagtttaaccgg

SEQ ID NO: 115589 - DNA, 414 bp, Homo sapiens
  misc_feature: GYAE6OF01EGYNZ.37.34.D01.1.454.CMB.1.raw
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (365)..(367): a, c, t, g, unknown or other
  misc_feature (365)..(367): n is a, c, g, or t
  modified_base (369)..(370): a, c, t, g, unknown or other
  misc_feature (369)..(370): n is a, c, g, or t
  modified_base (372)..(373): a, c, t, g, unknown or other
  misc_feature (372)..(373): n is a, c, g, or t
  modified_base (375)..(414): a, c, t, g, unknown or other
  misc_feature (375)..(414): n is a, c, g, or t
tcagtagtgtagatcacgaccggtgctcgatttagatcgtctgtgttggggtttggggggaagaggaagactgacggtcctgccacagggtggtgctggaggaaagagatgggaggtggacgtgtcagccacccagcgtggggtcctcgtccctggtccaccgttctcctcacgccctaccgaacgaacgggcccagtccggttcccttcccccgnggcccgtccctgcctacgaggacncctacccgtcggaagaccgctacgacggccggtccgtcgggacttcggacccgtggaacgaacggtacttacctaccacgttcaaccacttaagtgaggccggntacggacgaagcgnagtaggnnngnncnntnnnnnnnnnnnnnnnnnnnnnnnnnnnnnnnnnnnnnnnn

SEQ ID NO: 115590 - DNA, 382 bp, Homo sapiens
  misc_feature: GYAE6OF01DALXZ.37.34.D01.1.454.CMB.1.raw
  modified_base (334)..(334): a, c, t, g, unknown or other
  misc_feature (334)..(334): n is a, c, g, or t
  modified_base (354)..(382): a, c, t, g, unknown or other
  misc_feature (354)..(382): n is a, c, g, or t
tcagtagtgtagatcacgaccggtgctcgatttagatcgtctgtgttgggtttggggggaagaggaagactgacggtcctgccacagggtggtgctggaggaagagatgggaggtggacgtgtcagcacccagcgtggggcctgtccctggtcaccgtctcctcacgccctaccaaccgaacgggcccacgttcccggttcccttccccccgtggccgcccctgcctaccgagggacgccacccgtccgagacgccaacgacggccgggtcccgtgggcctcggccgtggtaccaaggtacctacttccatcctaacactacgtgacggcgggntcggacaaggcactagtagnnnnnnnnnnnnnnnnnnnnnnnnnnnnn

SEQ ID NO: 115591 - DNA, 923 bp, Homo sapiens
  misc_feature: GYAE6OF01DYQXQ.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcgttgggttttccttgttgcttattttaggaaggtgtccagtgtgacgtgcctaagtgggtggaggtcggtgggggaggtcgttcgggtcccaggtcccggtcggggggtcccctggaactaccttcgtccgtggtgccgacgtcccttcgtaggtactttaccgtaacggttttgggtaagtacctttagttgggtaagtttacgggtaccggttcggggttaccccgtacccgtacggttacccggtaccgggtaagggggggtaacgggggtccggttaggggacggggtttaggggtacccggaaccctaaaaccggtaacgttaaccgggaggggggtaaggggttacgggtttaacggggtaaaaaccggtaaaaacgttaggttcgggttaccggtaaccgtttcgttacgggccgggtacccgggggggtacccttaacgttttcccgaacccgttaccgttacccgtacccgaacggaaaccgaaccctaaaacccgaaaccccgttaaaaaaccgtacctaaacgttacgtttactacgttacggtaaaccgaaacggttacgggaaccggtacgtacgggtaacgtaaaccggttaccggaacgggtacgtacccgggttacgttaggttaacgtttagttacggttaggtccggtacggtaagttaacggtaaacgttttaacgtaacggtttaaaccggttaaaacggtttacggtaacgttacggtaacggtttaggttacgttggtagtttaaccgg

SEQ ID NO: 115592 - DNA, 918 bp, Homo sapiens
  misc_feature: GYAE6OF01DSRG0.37.34.D01.1.454.CMB.1.raw
tcagtagtgtagatcacgaccggtgctcgatttagatcgtctgtgttgggtttgggggtctcagagaggagccttagccctggactcccaaggtcctttccacttggtgatcagcactgagcacagaggactcaccagtggaagttggggctgagtcgttgggttttccttgttgtacttagttttagaaggtgtccagtgtgacgtgctaacgtggtggtaggtcggtgggggagtcttcggtcccgacggtccggtacggggggtccctaggacggtaccttccgttccgtggtcgcctacgtcccgttcgttaggtaactttaccgttaaacggtttttgggtaacgtcctttaaggttggggtaagttcggggtaaccgttcggggggttacccccgacccgtaacggttcccgttacccggggaaagggggggtaaacggggtccggttagggggtacggttcgggggtaccggaaaccccgtaaacgtaacgttaacgggaagggggtaacgggttaggggttaacgggtaaaaacgtaaaaaaacgttggttacgggtacggtaaccgttggtacgggtcggggtacccggggtacccgtacgttacccgaaccgttacgttacccctaaccggaggaaaccgtaacccgaaaacccgtaaaccctaaaaaccgttactaacgttacgttaacttaccgttaggaaaccgttaaaggtccggggtaacccgtccgtaagggaacgtaaccggtacccgggaaaggtacccgtacgggttactttaggttagtttagttaagtttcggaacggtacgtaacggttaagttaacggtttaaacgaaccgtttaaacgtaaaacgggttttcggaaacggtttacgtacgggtttaggtattaggtgtttacgg

SEQ ID NO: 115593 - DNA, 827 bp, Homo sapiens
  misc_feature: GYAE6OF01EDN5C.37.34.D01.1.454.CMB.1.raw
tcagtagtgtagatcacgaccggtgctcgatttagatcgtctgtgttgggtttgggggtctcagagaggagccttagccctggactccaaggtcctttccacttggtgatcagcactgagcacagagactcaccatggaagttgggctgagtcgttgggttttccttgttgtcttaattttaggaaggtcgtccagtgtgacgtgcgtaacgtgggtaggaggtcgggtgggggaggtcgttcgggcccgacggccgggttcggggggtcccctggacgtacctcgtccgtaggtcgcacgtcctgtcggtactttactaacgtttggtaacgtcttagttcggtacgtcggtaccggttccggggtcccggaccgtacggttccggtaccgggaaggggggtaacggggtcggtaggggtacgggttcggggacgtacccgaaacgtaacggtaacggagggggtaggttacggggtaaacgggttaaaaccgtaaaaaacgttcggttaacgggtacggtaaccgttacgggtcgggtacgggggacccggggtaccgttaaccgtttacccgaccgtaccgttcccgtaaccggaaacgtaaaccgaaccgaaaacccgtaaaacccctaaaaacgtcctaacgttacggtactaaccgtacgaaccgtaaggccgggtacgctaacggacgtaacggtacggaccggtacgtaccggtagttacgtagttagttcgttggtacgtaggtaaagtacgttaagttaacgtaacttaaaggttaacggttgaacgtttaggaacgttaggttagtgtagttaacg

SEQ ID NO: 115594 - DNA, 692 bp, Homo sapiens
  misc_feature: GYAE6OF01EPKXB.37.34.D01.1.454.CMB.1.raw
  modified_base (285)..(285): a, c, t, g, unknown or other
  misc_feature (285)..(285): n is a, c, g, or t
  modified_base (346)..(346): a, c, t, g, unknown or other
  misc_feature (346)..(346): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtggggggtccctggagactctcctgtgcagcctctggatttcaacttttggtanctattggatggactgggtccgccagtctccgagggagggctgggagtgggtcgaccaacgntaacgaggggaggtggtggtaacgaaaaacgttgtggtggaacttcgtggttacgggccggggtccgtaagtttccaaccgtacttccgtaccaaggaacggaaaccaaaccgggtaacccaaaaaaccgttccaacgttacggttaacttacgttacgaacgtaaaagtcgggaaccggtcccgttagacgtacgtacccgggaagggaccgtaacgggtcttacggttaggttactttaaggttggtacggtaccggaaggtaaggttacgtttaacgtacgttaaaccgttaaaggtttaccggacggttacggtacgttagggttacgttggtagtttacgg

SEQ ID NO: 115595 - DNA, 596 bp, Homo sapiens
  misc_feature: GYAE6OF01E47S4.37.34.D01.1.454.CMB.1.raw
  modified_base (377)..(377): a, c, t, g, unknown or other
  misc_feature (377)..(377): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatcgtgtaggagacgagagtcatcatcacgttcggccgggacaaggtcgagggcattagaaatgtatttaggcttggtatcagcaagaaaccgaggaaacgtaccccctaagcctcctcatctatggtcgcatccacgttaacaacgtcgggtcctaattaagacttcgagcggacgagtagatcgnggacatagtacttcactctacacctatccaggcagccctgccagtcctagaagttactttgacttactttaattaccttacgtacctaagaaagttacctaacctaaactttaccccgtagttaacccggtccggtaaccgtaaacggtacccggtaaagggttacgggaaacgtaaaccgtaaaacggtacgtacggttaggtcctcggcctaacccg

SEQ ID NO: 115596 - DNA, 791 bp, Homo sapiens
  misc_feature: GYAE6OF01C2Q8E.37.34.D01.1.454.CMB.1.raw
  modified_base (187)..(187): a, c, t, g, unknown or other
  misc_feature (187)..(187): n is a, c, g, or t
  modified_base (226)..(226): a, c, t, g, unknown or other
  misc_feature (226)..(226): n is a, c, g, or t
  modified_base (367)..(367): a, c, t, g, unknown or other
  misc_feature (367)..(367): n is a, c, g, or t
tcagtagtgtagatcacgaccggtgctcgatttagatcgtctgtggttgggtttggggctcagagaggagccttagccctggactccaaggcctttccacttggtgatcagcactgagcacagaggactcaccagtggaagttgggctgagtcgttgggttttcttgttgcttagttttagaaggtntccagtgtgacgtgacacgtgggtggagtcggtgggggnggtcgttcggccacggtccggtcggggggtccctggaacgtcctcctccgtgtcgctagtccctgtaggtaatttaagttgtttacgacctaacttcgtagacagtacggtaaccggttcgggggccccacggacggtccncggaacggtcgaacgggtggggcacgtccgggtaaggttcgggtccaagttaaacggttactacggtccgtaacccttacggttaaggtaaagtggaacgtacgaacgttacgaccgagtaacggtcccgttacggggaacgggtaaccgggtcccgttaaccaaccccgtacgtaccctaaccgggaacgtaaactaaaccgttaaacccttaaccaaaaccggaacccgtaaacgttcccctttactaacgtttccgaacgtaaactaaacgtccgaaacgcgtaccggaaagaccggaaccggaacgaaacggaccgtacccgttaacgttaagtaccggtacgtaggttaaggacggggtaaacgtcgggggtaacgggtacgggggtacggggtacgtacggggacccgggtaaccggg

SEQ ID NO: 115597 - DNA, 689 bp, Homo sapiens
  misc_feature: GYAE6OF01B136W.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtcgtgggggaggcttggtccagccgtggggggtccctgagactctcctgtgcagcctcgtggattcaacgtttggtagctattggatggactgggtccgccagtctccgaggggaaggggctgggagtgggtgaccaaacataacgaggggaggtggtaggtaacgaaaaactgtggtggactcgtgtggcggggcgattcacatctccagagacaacgaccaaaaactcactgtactctagacaagtaggaccggacctagacgacgtacgacggacgacggtcgtgtagtattagtgtgcgaagacgtattaagactaagtaagttcgagtgacgtgtatagatgtcttagtagactaccggtggggaacctaagggacctaggtcggtacctaccgttcgttacctccggtaacgtcccctaaccgtaaccgaaccggtaccccgtaacgttcccgggttacccctttcccccccggttacgggaccccgtccccgttaccggtaccccgttcccggaaacgggttccgtacccccggtacccgtacccgggaaacggacccgacccggaacgggaccccggg

SEQ ID NO: 115598 - DNA, 1017 bp, Homo sapiens
  misc_feature: GYAE6OF01EPGW8.37.34.D01.1.454.CMB.1.raw
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggattgggctgagcttggttttcttgttgtcttattttagaggtgtccagttgtgacgtgactaacgtggtggagtcggtgggggagtcgttggtccaggccggttcgggggtccctaggacncctcgtccgtgtacgcncgctcgtggtacttactaacgtttggtaagtcgttagttgagtcggacggttcgggtcccgcgtacgttccgtaccggaagggggtacgggtcgtcgggaaggttcgggtcggaaccgtaaacgtaacgggtaacgggtaggggtaggggttaacggttaaggggttaaaaaccgtaaaaaacgtttacgggttagggttaccgggtaacgtttcggttaacgggtccgggggtacccgggggtaacccgtttaacgttaccctaaacccgtttaccgtacccgttaaccccgtaaaccggtaaccgggtaaaacccccgaaaaccccggttaaaaaaccccgtaaaaaaacccgtttacccgaacccggttttaaaccggtttaacgttaacccggttaaaccggtaaacccggttaaaacgggttacccgggggtaacccgggttaacccggtttaaagggaaccgggtaacccggtttaaccccggggaacgggtaacccgggtaaaccggggtttcttttaaccgggggtttaaccttttaacggtttacgtttttagggggacccggttaaacggttaaaacggggttaaaggtttttaaaccccggttttaaaaaggtttaaaccccggtttaaaacggttttaaaaaccggggttttacgggttaaaacggttttacccggggtttaaacgtttaccggggtaaaggtttaaacggttagggtttttaaaacccgg

SEQ ID NO: 115599 - DNA, 1026 bp, Homo sapiens
  misc_feature: GYAE6OF01BCHO8.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaacgtggtgggagtcggtgggggacgtcgttcgggtccgacggtcccggtcgggggggttcccctggaacgtaccttccgttcccgttggttcggccgtacgtcccgttaccggtaggtatttccgtaggtttagttaggttggttagttttggttaggggttagggtttcggggggtttccggggttaccccggaccggtacgggtcccggtacccgggaaggggggtaacgggggtccggtggggtaacgggtgggggttacggaacccgtaaacgtaaaggtaaacggcggtaaggtaaggtaaggaaacggaccggaaaaagtaaactttaaccgttaaggttcggtacgggtaacctttcgggtagggttacgggaaccggggggtaccgttaacgtttaccgaacccgttacgttacccgtaacccgtaacgaaacccgggaaacccgaaacccgtaaacccggtaaaaacgttaaaccgttaaccgttttaaaccgttttccgttttttaaacgaaccgtttaaaacggttaaaccgtaaaccgggttacggtttaacgtaacgggttaacgggtaaaccggttacccggggaaacgggtaaacccggtaccccgggttaacccgtaaggtttaaaccggtttaaacccgtttaacgggtttaacccgggtaaaaacgggtaaccgggtaaaacggttaaaacccggtaaccgggggttaaaccgggttacccgggggggaaaacccccggttaacccgggggttaaaccccggtttacccggggtaaccccggttaccccggttccccggttaacccccg

SEQ ID NO: 115600 - DNA, 873 bp, Homo sapiens
  misc_feature: GYAE6OF01BGLKE.37.34.D01.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
tcagtagtgtagatcacgaccggtgctcgatttagatcgtctgtgttgggtttttccttgttgctattttagaaggtgtccagtgtgacgtgcaactggtggagtctgggggaggcttgggtccagccgtggggggtccctgagactctcctgtgcagcctctggtattcaacttttggtagctagttggatggactgggtccgcagtctccgagggaagggctggagtggggtgccaaanatacgagggtaggtggtcggtaacgaaaaactnttgtgggaacttcgtagtggccggggaccgtattccacctatcctacccgaagacgtaaccaaacgaacccaaaaaactcactgtatctagacaaagtcggacgtccgtagaacgtacgtccggaacggaccgtaacggtcgttacggtacggtttaatttaagtttaggtacgggccgtaaaggtagtttaaacgttttaaaggaaccttttaaaaccggtaaaacggttttcggtaaggttcggtaacgttaggggttaatacgtagttagtacgtttaagttacggtaacgttaacccgggttaacgggggtaccccgtaaaacgggggtaaccctaacgttacggggttaccccttaacccgggtttccttacccgttacgtaacccggtacccccttacccggaaccccggtaaaccgggtacccccgttaaccgttttacccggggtccccccgttttaccccccgggtccgggttacccccgtcccccggttaccggtaaccccgtttacccgggaacgggtacccggtccccgtaaacccccggtttaccgggaaaagggacccgtaaccccggtaaccggtaccccgggg

SEQ ID NO: 115601 - DNA, 822 bp, Homo sapiens
  misc_feature: GYAE6OF01D69RK.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttatttagaggtgtccagtgtgacgtgctaacgtgggtggaggtcgtggggggaggtcttgggtcccaggtccggtggggggtccctggacgactctccgtgtcgcacgtccctcgtggtactttacctaacgttttgggtaatcttagttgggaagtcgggtaccgttcggggtacccgaccgtaggttacccgaccgggaagggggtaacgggggtccgtggggacgggttggggtaccggaccaaacgtagtaacggcggtaacgacggtaaggttagggaaggtggaaagtaaagttaaaacttgtggtacgtacgttcggtagggtacgggaaacgggtcccgttataccccgtaacctaacgttccccgtaactaacggggaaacctaaaaccctaaccggttaaacccaaaggttaaccgtttaccgaaggtttacctaaccttaacgtaacccaacttaagtaaacccgaaaaccgttaaccggttaagggtaccggttacgggaaacggtaaccgtacgggtttaacttttaggtttaaacgttaacgtaaagggtaaaaccggtaaaccggaccttaaggtaaggtgggtaccggtcgggtacgggggaaccgtaaccgggacccgttacggtaccctacccgg

SEQ ID NO: 115602 - DNA, 825 bp, Homo sapiens
  misc_feature: GYAE6OF01D4L6K.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattgggctgagcgttgggttttccttgttgcttattttagaaggtgtccagtgtgacgtgcaacgtgggtggagtcgtgggggagtcgttcggtccgacggccggtcggggggttccctggacggtaccttctccgtggtcgccgacgtcccttcgttgggtaactttacctaaacgtttttgggtaacgtctttaagtttgggtaagtcgggaccgttggggtacccccggccgtaggttcccgtccgggaagggggaacgggggcgtggggacggttcggggtacgggacccgaaacgtacgttaaccggaagggggtacggggttggtaacgggtaaaccgaaaaaaacgttcgtagggtacggtaccgttcgtacgggtcgggcccggggggacctaacgtttacccaaccgtacgttcccgtacccgaacggtaaccgaaccgaaaccggaaacccctaaaaaaccgtaccgaaacgttacgttacttaccgtacggtaacgtaaacgtcgggaacccggtcgtaggaacgtacggttaccggacggtaaccgacggtcgttaggttacgttagtttaacgttcggtacggtacggtaagtaagttaacgttaacgtaacgtttaaaccgtaaaggttttaacggaacggttacgtaacgttaggttaagttgtagttacg

SEQ ID NO: 115603 - DNA, 758 bp, Homo sapiens
  misc_feature: GYAE6OF01A2SIB.37.34.D01.1.454.CMB.1.raw
  modified_base (629)..(629): a, c, t, g, unknown or other
  misc_feature (629)..(629): n is a, c, g, or t
tcagtagtgtagatcacgaccggtgctcgatttagatcgtctgtgttgggtttggggctcagagaggagccttagcccctggactccaaggcctttccacttggtgatcagcactgagcacagaggactcaccatggaattggggctgagtcgttgggtttttccttgttgcttatttttaggaaggttcgtccagtgtgacgtgacaacgtggtggagtcgtgggggaggtcgttggtccaggccggttcggggggtccctggacgacctcctccgtgtcgccacggccttacgtggtactttcctaaacgttttggtacgtcttagttgggaagttcgggaccgttcggggtcccctcccgacggttccgtaccgggacgggggtaacggggtcgtaggggtaggttcggggacgacctaaagtagtaacgggtagggggtacgggttgggtaaacggtaaaacgtaaaaacgttgttacgggtacgggaaccttcggtcgggtcgggaccggggtccggtaattccgaacccggtatccgttacgacggaacgaacctaaaccggaaaccctaaaacctacctaacgttagtacgtcgtaacgacgtaaaggtcggaccgtaccgngtacggacgaccggacgaccgacgtcgttaggtacgttatttaggtgtacggacggtaagtacggtaatttaacgtacgttaaacttagggtttagtacgtacgtacggttagttagtcgtaggttacg

SEQ ID NO: 115604 - DNA, 705 bp, Homo sapiens
  misc_feature: GYAE6OF01EO54R.37.34.D01.1.454.CMB.1.raw
  modified_base (161)..(161): a, c, t, g, unknown or other
  misc_feature (161)..(161): n is a, c, g, or t
  modified_base (577)..(577): a, c, t, g, unknown or other
  misc_feature (577)..(577): n is a, c, g, or t
tcagtagtgtagatcacgaccggtgctcgatttagatcgtctgtgttgggttttccttgttgctattttagaaggtgtccagtgtgacgtgcaactggtggagtcgtgggggaggcttggtccagccgtggggggtccctgagactctcctgtgcagcctntggattacaactttggtagtctattggatggacgtgggtccgccagtctccgaaggggaaggggctgggagtgggtcggaccaaacatacgaggggaggttggtaggtaaacgaaaaactgtggtacggacttcgtgtcggacggggaccgtaattccgaaccactcctaccaagacgaaccaaacgtaaccaaaaaactcaacttgtatcgtgaacaaagtcggaccggtactagagtacgtaccggaacggtacgacggtcgttagtgttaattagttggtaggacgaacgtagtaattttaacgaacttaacgtaaagtttcggagtacgtacgtggtatagtagtagtacttagtcgtaactaccgggtagggtacccgaaacgggtacctaaggtccgtacgtacccgttntaccttaccgacgtaccctacccaaccggacggtacccctaggtccccgttccgtccccgtaggtcccgtccctacgcctaccggacgaccgtacctacccgtacgaagaccgtcaaccggtacccgg

SEQ ID NO: 115605 - DNA, 398 bp, Homo sapiens
  misc_feature: GYAE6OF01ASORP.37.34.D01.1.454.CMB.1.raw
  modified_base (358)..(398): a, c, t, g, unknown or other
  misc_feature (358)..(398): n is a, c, g, or t
tcagtagtgtagatcacgaccggtgctcgatttagatcgtctgtgttgggtttgggggggaagaggaagactgacggtcctgccacaggtggtgctgaggaagagatggaggtggacgtgtcagcacccagctggggcctgtccctggtcaccgtctcctcacgccctccaaccgaacgggccccatccgggttccctttccccccgtggggcccgcccccttgcctccgagggacgccaaccctccgagagccacgaggccggcccgtggggcctcggcccgtgggtaccaacggtaccttaccttccataccgtacactacgtggacggcgggctggacaacggcgactataggcnnnnnnnnnnnnnnnnnnnnnnnnnnnnnnnnnnnnnnnnn

SEQ ID NO: 115606 - DNA, 827 bp, Homo sapiens
  misc_feature: GYAE6OF01DJDA9.37.34.D01.1.454.CMB.1.raw
  modified_base (122)..(122): a, c, t, g, unknown or other
  misc_feature (122)..(122): n is a, c, g, or t
tcagtagtgtagatcacgaccggtgctcgatttagatcgtctgtgttgggtttgggggtctcagagaggagccttagccctggactccaaggcctttccacttggtgatcagcactgagcanagaggactcaccatggaattgggctgagtcttggttttccttgttgcttattttagaaggtgtcagtgtagacgtgactaacgtggtggagtcggtgggggagtcgtttcggcccgtaggtcccggttcggggggttcccctaggacgtaccttccgtccgtggtacgccgagtcccgttcgttaggtaactttaccgttaacggttttagggttaagtacgtttaggttagggtaacgtcgggtaccggttcggggttccccgtaccgtaacggttcccgtacccgggaaggggggtaaacgggggtccgttgggggtagggttacgggggtcggaacccccgaaagtaacgtaacgggaggggtaacggggttgggttaaacggtaaaacgtaaaaaacgttgttacggtagtacgttccgtagggtcgggccggggtaccagtttcccaacctacgttacccgtaccgacgggaaaccaaccgaaaacccgtaaaaccccgtaaaacgtacctaacgttcgttaactcgtaacgtaaccgaaagtaccggggaccgtcgtaggacgtaaccgtacggaacggacgtacggtcgtagttacgttaattggttagttacggagtaaggttaacgtaagtttaacgaaacgtttaaacgttaaacgttcgtacgtagtaaccggttagttaacgtagtagttacg

SEQ ID NO: 115607 - DNA, 733 bp, Homo sapiens
  misc_feature: GYAE6OF01B3P8V.37.34.D01.1.454.CMB.1.raw
  modified_base (424)..(424): a, c, t, g, unknown or other
  misc_feature (424)..(424): n is a, c, g, or t
tcagtagtgtagatcacgaccggtgctcgatttagatcgtctgtgttgggtttggggtctcagagaggagccttagccctggactccaaggcctttccacttggtgatcagcactgagcacagaggactcaccagtggtaagttggggctgagtcgttgggttttccttgttgcttaagttttagaaggttcgtcgaggtgtaggacgtgcgaacgttgggtggtaggtcggtaggggggagtcgttcggtaccgacgggtccggttcggggggtccctaggacgtaccgttccgttccgtggtcgaccgtacgccgttcgtcgggtacctttccctaaccgtttcgaagttacgtctaactacggtactagtacggtaccggttcggggtccgaccgaggtccgaccgggaaggggtacgggngtagggcgggtacgggacaccgaacgaagtaacgacgaaaggtagtaaggaaagtaaggacggtagtacgtaggtcgacttcggtaggcggtaacggtccttacgactccttcaccgaagtacccgaacgtaacgacaacggtaccgtgtcgatacgtcgaacgaataacgtcgtaagacttggacggaacggacgtacggaaccgtactacggttatttagttaaccgcgtagggagtacggaagtaggtacgggtccgggttgtttaccgggtacccgaacgtaacggggtgaccccggttaaacgg

SEQ ID NO: 115608 - DNA, 605 bp, Homo sapiens
  misc_feature: GYAE6OF01A3YDZ.37.34.D01.1.454.CMB.1.raw
  modified_base (600)..(600): a, c, t, g, unknown or other
  misc_feature (600)..(600): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtggggggtccctggacgactcctcctgtcgcacgccctcgtggtacttcaaccttttggtagtcttattggatgggactggggtcccgccgagtctccgagggaaggggctgggagtgggtcggaccaacagtacgaggggaggttggtaggtaaacgaaaaactgtgtggactcgtggtcggcggggaccgtattccacctatctccgagacgaacaaccgaacccaaaaactccaactagtactcgtagactaaagtcggacggcctagacgagtaccggaggacgacggtcttgtacgttattagtgtcgagtagtagtatttacgacttaacgtaacgtttgagttacgtacgttaggtatgngtacg

SEQ ID NO: 115609 - DNA, 840 bp, Homo sapiens
  misc_feature: GYAE6OF01EYTFC.37.34.D01.1.454.CMB.1.raw
tcagtagtgtagatcacgaccggtgctcgatttagatcgtctgtgttgggtttgggctcagagaggagccttagccctggactccaaggccctttccacttggtgatcagcactgagcacagaggactcaccatggaagttggggctgaagtcgtgggttttccttgttgtcttagttttagaaggtgtccagtgtgacgtgcaacgtgggtggaggtcggtgggggagtcgttggtccaggtccggtgggggtccctggacgtctctcgtgtagcagcctctgtattacgtaacgttggtatcttagttggacgtcggtacgttcgggtcccgcgtacggttccgtaccggagggggtaacggggtccgtgggtaggtcggggtacggtaccgaaagtacgtaacggaggggtaagggttcggtaacgggtaaacgtaaaaacgttggtacgggtacggtaacgtcggttgggtaccggggaccggggtacccgttagtttacccgaacccttacgtcccgtaaccgtaaaggtaaccgaaacccgaaacccggtaaaacccctaaaaaccgttccgtaacgtttaccgttaagttaccgtaacggtaaacgtaaacggttccggggaaccgtaccggttaagtacggtaacggtaacccggaaggtaccggtaaccggttcggtttacgtaaggtttagttaaccggttgggtaaacggtacggtaaagggttaacgttaaacggttttaaacggaacggtttaaaaccgggttaagttaaacccgggtaaggttaaccggttaacggtaagggttttacgtaacgttggttaaaccg

SEQ ID NO: 115610 - DNA, 911 bp, Homo sapiens
  misc_feature: GYAE6OF01EF258.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcgaccatggagttgggctgagtcgttggttttccttgttgtcttagttttagaggttgtcctagtgtgacgtgacgtaacgtgggtggtagtcggtgggggacgtcgtttcggtccgacggtccgggttcggggggttccctagtacgtaccgttccgttccgttggtcgtacgacggttccgttacggtacgttaacgtttaccgttaacggttttacggtacgtacgttaggttaggtaggttcggtaccggttcccggtaccgtaccgttacggttaccggtaccggggaacggggtacgggtcggttacgggtacggttacggggtaaccgtaaccgtaacggtaacggtaacgggtacgggtaaggggtttacgggttaaacggtaaaacgttaaaacggttacggttacggttacgtaccgtttcggttagggtcccgggtacccgggtaccgttaaccgttaccgtaacccgttaccgttaccgtaaccgtaacggaaaccgtaaaccccgtaaacccgtaaaccctaaaccgtaccgttacggtttaccgttaaccgtacgtaacgtaacgtaacgggtaccggtacccgtaccggtacggtaacgtacgggtaccgggaacggtaccgggttaccggttagttacggtttacgtttagtttacgtcggtacggtaaccggttaagttacgtttaacgtttaacgttaacggtttaaacggttaacggtttcgtacggttacggttaacggttagttacgttggttacgtacg

SEQ ID NO: 115611 - DNA, 923 bp, Homo sapiens
  misc_feature: GYAE6OF01BPIBB.37.34.D01.1.454.CMB.1.raw
tcagtagtgtagatcacgaccggtgctcgatttagatcgtctgtgttgggtttgggctcagagaggagccttagccctggactcccaaggtccctttccacttggtgatcagcactgacgcacaggagacctcaccagtggaagttgggctgagtcgttggttttcttgttgtcttagtttagaaggtgtcgtagtgtgacgtgacgtaacgtggtggacgtcggtggggacgtcgttcggtccgacggtccgggtcgggggtccctaggacgtcctccgtccgtgtcgacgcgtccttcgtagtacttacgttaacgtttggtacgtacgtttagttaggtacgttcggtaccggttccgggtaccccgaccgttaaccggttcccggtaaccggggtaacggggggtaacgggggtcggttcggggtacgggttcggggtacgaaccccgtaaacgtaacggtaacgggtaagggggtacggggttacgggttaaacgggtaaaaaaccgtaaaaaacggttggtttacggtaccgggtaaccgtttccgggtacgggttaccgggggacccgggttaacccgtaaccgtttaaccccgtacccggttacctttacccgtaaccggtaaacggtaaacccggaaaccccgtaaaaacccgtaaacccctaaaaaccgttccgtaaaccgtttaagtaaccgtaacccgtacggaaaccggtaaacggtccgggtacccgtcgtaaggtaaccggaaccggttacggaaaccgggtaccggtacgttccgtttagggtaacgtttaagttggttaccgggagtaccggttaaaggtaacgtttaacggtttaacgaaacgtttaaacggttaaggttcggtaaggtttacgacgggttttaagacggttagtacgggttaac

SEQ ID NO: 115612 - DNA, 606 bp, Homo sapiens
  misc_feature: GYAE6OF01AOXW6.37.34.D01.1.454.CMB.1.raw
  modified_base (601)..(601): a, c, t, g, unknown or other
  misc_feature (601)..(601): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaatgggctgagctgggttttccttgttgctattttagaaggtgtccagtgtgacgtgcaactggtggagtcgtgggggaggcttgggtccagccgtggggggtccctggagactctcctgtgcagcctctggacttcaacttttggtagctagtttggatggactgggtccgccgagtccgtccgaggggaaggggctagggagttggggtggaccaaagagttaacgaggggtaggtggtaggtaaacgaaaaactgtgtaggaactcgtgtacggcggggccgtaagttccaccgtatcctaccagagaacaaccgaccaaaaacctcaacgtgtatctgacaaagtcggacgcgtgacgataccggaggaccgacggcttacgtgtactttagttgtacggtcgagtagtatttaagaacgttaactaaagtttacgaagttacgtacgtaggttatagnttacg

SEQ ID NO: 115613 - DNA, 759 bp, Homo sapiens
  misc_feature: GYAE6OF01DVDPZ.37.34.D01.1.454.CMB.1.raw
  modified_base (732)..(732): a, c, t, g, unknown or other
  misc_feature (732)..(732): n is a, c, g, or t
tcagtagtgtagatcacgaccggtgctcgatttagatcgtctgtgttgggtttgggggtctcagagaggagccttagccctggactccaaggtccctttccacttggtgatcagcactgagcacagaggactcaccagtggtagttgggctggagtcgtttggtttttccttgttgtactttagttttagaggtcgtcgtagtgtgacgtgactaagtggtggtagtcggtggggagtcgttcggtaccgcggtccggtcggggtccctaggacgtcctctccgtgtcgacgtacgccttcgtaggttacttaccgttaacgtttggtagtacgttagttaggatacggtcgtcgggtccaccgtacgtccgtacgggaaggggtagggtcgtgggacggtgggtaccgaaccgtaagtaaggttacggaaggggttagggttacggttaaacgtaaaaccggtaaaaagttggtggtacggtacttcggtagggtccgggtccggggtaaccttacgttacccgaacctcgtaaccgtacccgaaggaacgaaacccctaaaaccggtaaaccccctaaaagttcccgtaacgtttagtaccttacggtaaccgaaacgtaaacggtcggaacccgtgtaacggacgtaacggtaccgaacggacgtacggtgttagttattagttatgagacgtagtacgtttaacgtagtaacgttaacgttaagttanaagtagttacgtagttgcgtagttacg

SEQ ID NO: 115614 - DNA, 846 bp, Homo sapiens
  misc_feature: GYAE6OF01BS21K.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccagtggaagttggggctgagtcgttgggttttccttgttgtcttagtttagaaggtgtccagtgtggacgtgcaacgtgggtggagtcggtgggggacgtcgttcggtccgacggtccggttcgggggtccctggacgtacctctcgtgtcgcgtacgtccttcgtaggttacttaccgttaaaccgttttgggttaacgtacgtttaaggtttagggtaaggttcggggtaaccgggtttccgggggtaccccgtacccgtacggtttacccggtaccgggaagggggggtaaacggggtcggttagggggtacgggttcgggggtaccggaaacccgtaaacggtaacggtacgggaagggggtagggttagggtaacggtaaaaacgtaaaacgtggttacggtacgggtaccgttgtacggggtcgggtaccggggtaccgttaacttacccggacaacgttcccgtacgaacggaaccgtaaccgaaaacccgtaaaccgtaaaaaccgttcgaaccgttacgttactaacgtaccgtaacgtaaacggtccggaaccggtctaacgggacgtaacgaccggtaacgaccggtacgtaccgttggtacgtttagttaggttacggtcgtacggttaggtaagtttaaacgttaacgaacgttaaagttaacggttacggtaggtacgtaggtaggttaatggtattacgg

SEQ ID NO: 115615 - DNA, 753 bp, Homo sapiens
  misc_feature: GYAE6OF01DYQNW.37.34.D01.1.454.CMB.1.raw
  modified_base (260)..(260): a, c, t, g, unknown or other
  misc_feature (260)..(260): n is a, c, g, or t
  modified_base (509)..(509): a, c, t, g, unknown or other
  misc_feature (509)..(509): n is a, c, g, or t
  modified_base (638)..(638): a, c, t, g, unknown or other
  misc_feature (638)..(638): n is a, c, g, or t
  modified_base (747)..(747): a, c, t, g, unknown or other
  misc_feature (747)..(747): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggattgggctgagcgtggtttcgtgtagctatttagaggtgtcagttgacgtgcatggtggagtcgtgggggagtcttggtccaggtccggtcggggggttcccagacgccttcgtcctgttgacncgtacctgtgtacttacctagtttggtactagtagttgaacgttggtcgtcggggtcctccgtagttccgaccggaagggggtacggggtccgttagggcgggtacggggtacgtaaccgaaaccgttaagaaccgggtagggggtacgggttaggggttaaacggtaaaaccggttaaaaacgtttggttccgggtaacggtacttcccgggtggtaacggggtccgggaccttacttacccgaaccncggttttaacctacccgaaagggtaaccaaaccgaaacccgtaaaccctaaaaaccgttctaaaccgtacggttaacctcgtaccgaacctaacggtacgggaaccgtcgttacggacgtaccggaacncggtaaaccgtacggtgttacgttagttaagtttgtacgtaccgtggtaactaaggttaacgttaacgtattaacggttaacgtagtacgtagttcgagttagatagtnttacgg

SEQ ID NO: 115616 - DNA, 520 bp, Homo sapiens
  misc_feature: GYAE6OF01DCZIP.37.34.D01.1.454.CMB.1.raw
  modified_base (135)..(135): a, c, t, g, unknown or other
  misc_feature (135)..(135): n is a, c, g, or t
  modified_base (237)..(237): a, c, t, g, unknown or other
  misc_feature (237)..(237): n is a, c, g, or t
  modified_base (465)..(520): a, c, t, g, unknown or other
  misc_feature (465)..(520): n is a, c, g, or t
tcagtagtgtagatcacgaccggtgctcgatttagatcgtctgtgttgggtttggggggaagaggaagactgacggtcctgccacaggtggtgctggaggaagagatgggagggtgggacgtgtcacgccacccngcgtgggggccctcgtcccgtggtccacccgttcctcctacacgtcccctacccgaaccggaacgggcccctagtttcccgggttcccccttttccccccgngggcccgcccccttggccctaccggagggaaccgccctaaccccgtaccggaagaccgaccaaccggtaccgggccccgggtccccggttggggccccttggacccccgtttagggtaacccgtaaaacgggttacccctttaccccttacccaatttacccctaacgtaacccgttacgggtggacgggtccggggtcgtacgggacgtaacgggcgacctagtcgnnnnnnnnnnnnnnnnnnnnnnnnnnnnnnnnnnnnnnnnnnnnnnnnnnnnnnnn

SEQ ID NO: 115617 - DNA, 826 bp, Homo sapiens
  misc_feature: GYAE6OF01EL5YX.37.34.D01.1.454.CMB.1.raw
  modified_base (213)..(213): a, c, t, g, unknown or other
  misc_feature (213)..(213): n is a, c, g, or t
tcagtagtgtagatcacgaccggtgctcgatttagatcgtctgtgttggggtttgggggcaggagtcagacccactcaggacacagcatggacatgagggtccccgctcagctcctggggctcctgctgctctggctcccgaggtcgccagatgtcgccataccaaatcgacccagtcctccacttccctccctgtctgctatctaggagganacaggagtcatcatcacgttggaccgggataagtcgagggtactaagttaagaaagttgtacgtttaggcttaggtactacgagacaaacggaaccgaagggaaaccgacccctaagtcccgtacctacagttactagtcgggtacactactaccgtaagtttaaccgaacggttcgggtaccctaaggtttaacgtacttacggacggtaccggactaagggtacgggtacgttcggtacggtaccgaaccgttaacgtttaccttttaccgaacccgttccgttaacctaaacccggttataccgtacggtacccgtaaccgtaccccggttcgaacccgtcgggttaacccgtaaggttaaaccgtttaacgttttacggaaacccgttttaaaccctttttaacgttaaccccggtttacgttaaccccttaaagttaaaacggttaccgtttaaaaccctttaaacccgttaaccccgggtttacgggtttaaacccccgggtttacgggaaacccggtaaaaccggggtaccccggttaagggtaaccggtaaacccgtaacgtaaacgggttaccgtagggtacccgacttaccgacgttaacccg

SEQ ID NO: 115618 - DNA, 754 bp, Homo sapiens
  misc_feature: GYAE6OF01C7NTD.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatcggaattggggctgagtcgttgggttttccttgttgcgttattttagaaggtgtcctagtttgacgtgcaacgtggtggagtcgtgggggagtcgttggtccaggtccgtgggggtccctgacgtacctccgtcctggtcgacgtacggtcctcgtggtactttcaaacgttttggaacgtctaaggttggaagtcggacgtcggtccgtcctgtccgtcgaggggaacggggctgggtagtgggtcggaccaagtacgtacgaggggtggtggtacggtaaacgaaaaacttgtgtacggactcggtggttacgggccgggaccgtacttaccgaccagttcctaccggaagaacgaacccaacggaaccccttaaaaagtcctaagtccgtaagttaccgtaggtaacccaaagtacggggtaccgtacgtagggaacgtacggaaccgggagtaacccggtaacggtccttacggttaagttacgtttacgttacggtacggtaccggaagttaaacggttaagtttaccgggaaacctttaaagggtaacgttttaccggaagttaccggttaacggttaagggttacgttaaccgtgttaaggtttaaccggg

SEQ ID NO: 115619 - DNA, 763 bp, Homo sapiens
  misc_feature: GYAE6OF01AI6KZ.37.34.D01.1.454.CMB.1.raw
tcagtagtgtagatcacgaccggtgctcgatttagatcgtctgtgttgggtttggggctcagagaggagccttagccctggactccaagcctttccacttggtgatcagcactgagcacagaggacctcaccagtaggaagttgggctgagtcgttggttttccttgttgtcttagttttagtaggtgtcctagtgtgacgtgacgagtggtggtagtcggtgggggagtcgttcggtccgacggtccggtcgggggtccctggacgtaccgtctccgtgtcgcgacgtccgttcgtggtacttacgtaacgtttggtacgtcgttagttacggtgtcggtaccgtcgggtcccgaccgtacggtccgtaccgggtagggggaacgggtcgtaggggtacggttcgggtaccgaacccgtaaccgtagtaaccgggagggtaggtacggttaacggtaaacgtaaaacgtacggtacggtacggtaccgttcggttaggtccggggcccggtaccgtacttacccgaacgtctacccgtcgaaacgacggtaaaccaaccggtaaactaaaccctcgtaacgttcgtaactcgaacgacgaagtcgggtaactcgagtacggactaccgggtacggtacgcgtcgtttagtacgtttacgtagttcggacgtagtaaggttagttaacggtttaacccgtaagtaacgggtttaaacgtttcggaacgttaccgttaggtaggttacgtaaggttcgttaacg

SEQ ID NO: 115620 - DNA, 749 bp, Homo sapiens
  misc_feature: GYAE6OF01EH13D.37.34.D01.1.454.CMB.1.raw
  modified_base (703)..(703): a, c, t, g, unknown or other
  misc_feature (703)..(703): n is a, c, g, or t
  modified_base (735)..(735): a, c, t, g, unknown or other
  misc_feature (735)..(735): n is a, c, g, or t
tcagtagtgtagatcacgaccggtgctcgatttagatcgtctgtgttgggttttccttgttgctattttagaaggtgtccagtgtgacgtgcaactgggtggagtcgtgggggaggcttggtccagccgtggggggtccctgagactctcctgtgcagcctcgtggattactaacgttttggtagctattggagtggacgtgggtccgccagtcctccgaaggggaagggcgtgggaggtgggtacgaccaaagtaagtacggaggggtaggtggtaggtaaacgaaaaacttagtggtggactcgtaggtcggccggggacctattccaacctatccgtacgaagaaccgaacaaaacccgaaaccctaaaaactcgtaaacgttacgtacgtcgtacgtaaataaaggtacgggaaccgtacctaaggaagtacgttaacccggaggaacgaacgtgttagtttagtaactttagtggtaagcgaagttagtaaacgtttaacgtaaactaaacgtaaaggttttcggaagtaacgtaacggttaagttacgttaagtacgttagtaacgttatacggtaacgtaccgggtagggaacccggtaaagacctaacgtacgtccgagttccttcgtacgaccgtacctacgacccgaaggcccttagcccgttaccctcccgacgtcccgccccgtaggcccncggaagcccgttacccacccgtaacgagaccncgaacgtacccggg

SEQ ID NO: 115621 - DNA, 957 bp, Homo sapiens
  misc_feature: GYAE6OF01BISF1.37.34.D01.1.454.CMB.1.raw
tcagtagtgtagatcacgaccggtgctcgatttagatcgtctgtgttgggtttgggggtctcagagaggagccttagccctggactcccaaggtcctttccacttggtgatcagcattgagcacagaggactcaccagtggaagttggggctgagtcgttgggttttccttgttgcttattttagaaggtgtccagtgtgacgtgcacgtggtggagtcggtggggagtcgttggtccagccggtcggggggtccctggagaccttcctccgttgtcgaccacgtcctacgtggtacttacgtaacgttttggtaacgtcttagtttagggacgtcgggtaccgttcggggtaccccgccgtacggtccgttaccggaagggggtaacggggtcgtggggtaacggggttcggggtacgtaacccgtaaagtacgtaacgggtacggggtacggggttacgggttaaacgggtaaaaccgtaaaaaaccggtttggttacgggtaccggggtaaccttttaccggggtacggggttacccgggggtacccggggggtaccgttaacccggtttacccgaacccgttaccgttacccgttaaccggaaacgggtaaaccgaacccggaaaacccggtaaacccctaaaaaccggttcccgtaacctttaacgggtaaccttaccggttaacggtaaaccgttaaaacggggttccggggaaacccgggttcccgttaagggtaacgggtaccccggttaaccgggaaccggtaacccggggtaacggtccgtttaagggtttaccgtttaggttacggttagggtaccggtaacggtaagggttaaagttaccggttttaaaggaaacccgtttaaaccgggtttaaacgggtttacccggttaaagggttacccggtacgggtttaagggtttacgttaagggttacgtttaaccgg

SEQ ID NO: 115622 - DNA, 618 bp, Homo sapiens
  misc_feature: GYAE6OF01BTM21.37.34.D01.1.454.CMB.1.raw
  modified_base (523)..(523): a, c, t, g, unknown or other
  misc_feature (523)..(523): n is a, c, g, or t
  modified_base (545)..(545): a, c, t, g, unknown or other
  misc_feature (545)..(545): n is a, c, g, or t
  modified_base (579)..(579): a, c, t, g, unknown or other
  misc_feature (579)..(579): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgcttattttagaaggtgtccagtgtgacgtgcaactggtggagtcggtgggggagcgttggtccgaggccgtgggggtccctgagacctctccgtgtcgcacgcctctggtattacctaacgttttacggtagtctttagttcgggtagtcgggtacgtcggggtcccgtaccgacgttccgtaccggaagggggtaacggggcggtgggtaggtcggggtcggaccggtaaggtaaaagcggtaaggttcgtaggtaggacaacgacgacgtacgcgtcgccccgtaggaacgcagactcactactcgtacgagagatagaactaacaaacctacctgtactctacgacacatacanacgcctagacgaacgagacacncgtacgtactattacgtatcgtacatagtagttntacttactagtacgtacgacggtacgttagtgtttacgg

SEQ ID NO: 115623 - DNA, 704 bp, Homo sapiens
  misc_feature: GYAE6OF01E35I1.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgagtcgttgggttttccttgttgcttattttagaaggtgtcagtgtgacgtgcaacgtggtggagtcggtggggggaggtcgttcggtccgacggtcccggtcgggggggttcccctggacgtaccttctccgtggtgccgacgtcctcgtaggtactttaccgtaacgttttgggtacgtcttagttgggacgttgggaccgttcggggtcccgcgtaacgtccgtaccggagggggacggggtcgtggggtagggtcgggtacgacctaaacgaggtaacggaggggtacggttagggtaacggtaaaacgaaaaagttgtaggtacggactgtgggtcgggccgggtctacgttaccaccgtactcctaccgaaggaacgaaccgtaaaccgaaaccctaaaaaccgtctacgtagtactacgtacgaacgtaacgtcggacgcgtagacgacgtaccggacgacgtacgtcgtgttagttagttgtgcgtacggtagtaagtgttaagacgttaagtacgttagacggtacgtacgttaggtactgtgttacg

SEQ ID NO: 115624 - DNA, 715 bp, Homo sapiens
  misc_feature: GYAE6OF01B2E3M.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaagttggggctgagtcgttggtttctgtgctagttttagaggtcgtcagtgtgacgtgcacgtggtcggagtcggtggggacgtcgttggtccaggtcccggtcgggggtccctgacgtcctccgtcgtgtcgcgacgtccctgtggtacttaccttaacgtttggtactacgttaagtgggacgttcggtacgtcgggtccccgcgtacgtcctaccggaaggggtacgggcgtgggtacggtgggtacggacctaacgacgtaacggagggtacgggttggtaacggtaaacgtaaaagtgttcgggtaggtaaccgttcggtacgggttcgggacccgggtaccgtacgtttacccgaactcgtcccgtaccgaacgtaacggaaccaaacccggtaaaccctaaaacgcctaacgtacgtactcgtaacgactaaggtcggaccgcgtaaggcgtaaccgtacgaacgtaccggacgtcgttacgttacgttattacggtgacggtcgaagtacgttaacgttacggaacttaaggtacggttgtagtcgtaacttaggtaactcgtagtacg

SEQ ID NO: 115625 - DNA, 811 bp, Homo sapiens
  misc_feature: GYAE6OF01DYNMY.37.34.D01.1.454.CMB.1.raw
  modified_base (188)..(188): a, c, t, g, unknown or other
  misc_feature (188)..(188): n is a, c, g, or t
tcagtagtgtagatcacgaccggtgctcgatttagatcgtctgtgttgggtttggggctcagagaggagtccttagccctggactccaaggcctttccacttggtgatcagcactgagcacagaggactcaccataggaagttgggctgtagtcgttggttttccttgttgtcttaattttagaggtntccagttgtgacgtgactacgtgggtggagtcggtgggggacgtcgttcggtcccgaggtccgggttcgggggtccctggaacgtccgttctccttgacgccacgtccttgtacgtactttacgtacgtttggtatcttagtggtagttcgggaccgttccgggtaccctaccgtacggttcccgtaccggggaaaggggtaacggggtccgtaggggtagggttcggggaaccggaacccgtaaacgtaacggttacgggtaaggggtaggggtttacgggttaaacggttaaaaccgttaaaaaacgttggttaacgggtaccggtaacgttcgggtttacggacggggtaccccggggtaacccttaacgtacccctaaaccgttccttaacccgtaaccgaacggtaaaccgtaacccgaaaacccgtaaaacccgtaaaacctaccggttaccttagttacttacgtaacgaaccgtaacggtcgggtaaccgtccgaaggtaccggaaccgaccggaagtacgtacgttcgtaggttattacggttagtgttcgacgtagtaagttacgtataaaccgtagttaaacgttgaccgttagacgtttagatagtgtacg

SEQ ID NO: 115626 - DNA, 822 bp, Homo sapiens
  misc_feature: GYAE6OF01C9WKS.37.34.D01.1.454.CMB.1.raw
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgcttattttagaaggtgtccagtgtgacgtgctaactgggtggagtcgtgggggagcttggtccaggccgtgggggtccctgagctctccngtncacgcctcgtggtacttactaacgtttggtagtcttaagttggagtcggtacgtcggggtcccgcctaggtccgtaccggaagggggaacggggtcgttaggggagggttcggggtacggaaccgaaacgtaacgtaacggaaggggtacgggttagggtaacggtaaaacgtaaaaaaacgttgttacggttaggtaacctcggttagggtcggggtaccgggggtaaccgtaacgtttacccaaccgtacttaccgtacccgaacggaaaccgtaaaccgtaaaacccggtaaacccctaaaaaaccttaccgtaacctttacggtttaaccttaccgtaacggaaaccgtaaacggttacccggggaacccggtcccgtaacggtaacgtacccgtaccggggaaacgggtaccgtaccgggtaccgttagggtttaagtttagtttaacggtttggtacggtcggtaaagtaaggtttaacgtttaaacgaacttaaaacggttaaaggtttcgaaggtttacggaacgtttagggttaacgttaggtagtttacg

SEQ ID NO: 115627 - DNA, 980 bp, Homo sapiens
  misc_feature: GYAE6OF01B5KK2.37.34.D01.1.454.CMB.1.raw
tcagtagtgtagatcacgaccggtgctcgatttagatcgtctgtgttgggtttggggctcagagaggagccttagccctggacctccaaggcctttccacttggtgatcagcactgagcacagagactcaccatggagttggggctgagcgttggttttccttgttgcttatttagaagtgtccagtgtgacgtgacaacgtggtggagtcggtgggggagtcgttggtccgaggtccggttcgggggtccctggacgtaccttcgtccgtggtcgccgagcccgttcgtacggtaactttacccgtaaacggttttgggtaacgttacgtttaagtttaggggtaacgttcgggtaaccggttccggggttaccccggcccgtaaacgggtttcccgtaccgggaaagggggggtaaccgggggtaccggttgggggtaacgggttcggggggttaaccggaacccgtaaaacgtaacggtttaaaccggggaagggggtacggggtttaacggggttaaacggttaaaaaaccggtaaaaaacgtttacggttacggggtttaacgggtaacccgtttaccgggtttagggggttaccggggttacggggggttaacccccttaacggtttacccccgtaaacccgttaacgttacccccggtttaaacccgggtaaacggaaaacccgggtaaaaccccgtaaaaacccccggggttaaaaacccctaaaaaaaaacccggtttcccgtaaacgttttaacgggttaacctttaaccggttaaccggaaacgttaaaacggggtttacggggaacccccgttacggttaaccgggaaacggttaacccgttaaccgggggaaccggtaccggtaccggttacgttaggtttacgttacgttttacgtagggtcgacggtaagttaagttacgttaaacgtataaacgttagttgacgtgacgttagtactgtgtacg

SEQ ID NO: 115628 - DNA, 695 bp, Homo sapiens
  misc_feature: GYAE6OF01A8PGU.37.34.D01.1.454.CMB.1.raw
  modified_base (163)..(163): a, c, t, g, unknown or other
  misc_feature (163)..(163): n is a, c, g, or t
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (431)..(431): a, c, t, g, unknown or other
  misc_feature (431)..(431): n is a, c, g, or t
  modified_base (680)..(680): a, c, t, g, unknown or other
  misc_feature (680)..(680): n is a, c, g, or t
tcagtagtgtagatcacgaccggtgctcgatttagatcgtctgtgttgggttttccttgttgctattttagaaggtgtccagtgtgacgtgcaactgggtggagtcgtgggggaggcttggtccagccgtggggggtccctgagactctcctgtgcagccctntggattcaactttggtagctagttggatggacgtgggtcccncagtcctccgaggggagggctggagtgggtcggaccaanagtacgaagggggnggtggtaggtaaacggaaaaacttgtggtaggacttcgtggtcggccgggggacctagttcaaccagtcctaccgagaacgaacgaaccgtaaccaaaaactcaactgtatcagacctaaaggtcggacgctagacgtacgacgacggacgacggcgttagtagtattgttgnggtacgaagtagtagtttaacgaacttacgttaaagtttcgagtacggtagtaggtataggtatcggttattagtacgtaacgtaccggaggggtaacccgaaggactacggtgtaaccgtccgttcctacgttaccgaccgtcccgtacccgaaccggtacccggtactccggtccttcccgtcccccgtcggcccgtcccgtacggcccttaccggacgtaacccgcccgtaccggacgtaccgacncccgcgaccccgggg

SEQ ID NO: 115629 - DNA, 758 bp, Homo sapiens
  misc_feature: GYAE6OF01AU5BG.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtcgccagatgtgccatccaaatcgaccctagtctccactccctccctgtcctgctatcgtgtaggacgacagacgtcatcactctactcggccggactaagtcgacgggctaagttaagaaacttgaagtttggacgttggtatcgagaaccgtaagaaaccggagggaaaccgtccctaacgccttccgtactacgttctaacgtgggtactacgtaacgttaaccttaacggttttaaccgtaaaccgttccggggttaacctaaacggtttaaaggtccttaacggaacgggtccggtagtaacgggttcggtacgtttaccgtacgggaacctaacgtaagtttaccgtttaacctaccgttaccgtacctaacctaacgtaaccgacgtaccggtaacccgtcgttacgaacccgtacgtacgtaacggttaacgtttaatttaacggtaactttaaaccgtttaacttacggtttactaaccttaaacggtaacttaccggttaaccttacccgtttaccgtaccgggttaaccggttaccggaaccggtaaccgggtagaacgggtaacggtaacaacgtaaacggtgtaccgtaggctacgacgtacc

SEQ ID NO: 115630 - DNA, 939 bp, Homo sapiens
  misc_feature: GYAE6OF01CCVTM.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagtcactgagcacaggacggactacaaccagtggaatttggggctgagtcgttgggtttttccttggttcgtactttagtttttaggaaggttcgtacctaggttggttgacggttgaccgtaacgttgggtggacgtccggtagggggacgtcgttcggtccgaggtcccgggttcggggggtaccctggacgtaccttccgtccgtagtcgcgtacggtccttacggtggtaactttaccgtaacggttttcggagtacgttagttggacggtcggtaccggttccggggtaccccgtaccgtacgggttcccgtaaccgggtaaaggggggtaccggggtcggttacgggtaacgggttcggggttacccggaaacccgtaaacggtaacgggttaacggggacgggggttaacggggttaacgggggttaaacggtaaaaaccggttaaaaaccggttggttcggggtttaaccggtaaccgttcgttaggggtccggggaccggggttacctaccgtttaccgaacccgttacgttaccgtaaccgaacggaaaccgtaaaccgaaacccgtaaaaccccgtaaaacttcggaactttaggttaccaccggttacgaaacggtaaccggtacggggtacccggtaccgtagggaacgtaccggtaccgggaaccgggtacgtcccggttagttaaccggttagtttacgttaaggttgggaccgtaggttaagggttaacttacggtttaacgaaaaccgtttacggtttaaacggtaccggttaaggtagttaccggttaggttacgttaacgtgggttaacg

SEQ ID NO: 115631 - DNA, 1066 bp, Homo sapiens
  misc_feature: GYAE6OF01EUKTC.37.34.D01.1.454.CMB.1.raw
tcagtagtgtagatcacgaccggtgctcgatttagatcgtctgtgttgggtttgggctcagagaggagccttagccctggactccaaggtcctttccacttggtgatcagcactgagcacgagaggactcaccagtggaagttggggctgagtcgttgggttttccttgttgtactttagttttaggaaggttcgtccgtagttgtacgtacgtcgacgtacgtggtggtacgttcgggtagggggtacgtcgttcggtccgacggtccgggtcgggggtccctaggtacgtaccttccgttccgttggtacgaccgtaccgtccgttacggttcggttaactttaccgttaacgtttttcggtacttacgtttaggttacggtacgttaccgggtacccgtttccgggggtccccgtaaccggttaccggtttacccgggtaccggggaaggggggtaccggggttaccggtttaggggtacggggtttaccggggtaccggaaacccttaaacggtaacggtaaaccggggtagggggtttaacggggttaacgggtaaaccggttaaaaaccgtaaaagtttcgggtaggtttaaccgggtacccgtttcgggttacggggttacccgggggtacccgggttaacccgttaacggttacccctaacccggttaccgttttacccggaaacccggtaaacggaaacccgttaaaccccggtaaaaaccccgttaaaacccttaaaaccccggttaccgtttaacggttaaaccggtttaccgttaaacccggttaaacgggtaaaccgtttaaccgggcccgggggttaccgttaacccgggttagggaacccggtttacccggaaccccggggtaaggtacccgtacggtttaccggtttagtttaacgtttaacgtttccgggttacggtacgggtaacgttaaagggttttaccgttaaaacggtttaacccggttaaacggtttaaaacgttttacgggttaaccggttaacggtaccggtttaaggtaggtttaccggttaagtaacgttttacccggg

SEQ ID NO: 115632 - DNA, 1200 bp, Homo sapiens
  misc_feature: GYAE6OF01ESGXC.37.34.D01.1.454.CMB.1.raw
tcagtagtgtagatcacgaccggtgctcgatttagatcgtctgtgttggttttccttgttgctattttagaaggtgtccagtgtgacgtgcaactggtggagtcgtgggggaggcttggtccagccgtggggggtccctgacgactctcctgtgcacgccttcgtggtattcctaacgtttggtagtcttagttggatcggacgttcggggtcccgcgtaggtccgtaccggaagggggtaacggggtcgtaggggtacgggttcggggtaccggaacccgtaaacgacgttaaaccgggagggggttaggggtttacggggttaacgggttaaaaccgtaaaaaaacgttggttacggggttaccgggtaaccgttttccggtcggggttaccgggggtaccccggggggtacccgttaaaccggttttaccccgaaaccccttaacgttaccccttaaccgggaaaacggaaaccggtaaaacccctaaaccccggtaaaaacccctaaaaaaccgttccgttaaaccgtttaacggtttaaccgttaccgttaacggaaaccgttaaacgggtaccgggtaacccggttacccggttaagggaacggtaccggtaaccggaacgggaacccgtaaccgggttcgttaggttagtttaacgtttaggtttcggttacggaaccgggttaaaggttaacgtttaacggtttaaacgtaaccgtttaaaacggtttaaacggtttaccggggtaagttaacggttaccgttaaggggtactttaacgggtacgtttaacggttaactttaacgggtccggttaaaccgggttacccgggggtaacccggtaaacccggggtaaacgggtacccgttaacgggtttacccggggtaacccttaacccggtttcctttaaccccggtacccggtaccccggtttaacccccgtaaccccggtaaccgggtaaccccgggtaccccttttcccggggttacccccggttttacccccccggtttaccccccgggtaagggttccccccccccgtttacggggtacccggtttaaaccccccggggaaacccgggttacccggggggtaaaccccccttcccccccggggtaaaacccgggttaaccccggaagggaaaccccccggttaccccgggtaacccccgggttaaccccccgggggg

SEQ ID NO: 115633 - DNA, 950 bp, Homo sapiens
  misc_feature: GYAE6OF01AKSA4.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgaggcgttgggttttccttggttcgtcttattttagaaggtgtccagtgtgacgtgctaacgtggtggaggtcggtggggggaggtcgttggtccgaggccgggtcgggggggtccctggacgtacctcctccgtggtgcgacgcccttcgtcgggtactttccgtaacgttttgggtacgtacgttaaggttgggtacggtcgggtaccggttcggggggtccccctaccggtaacggttcccggtacccggggtaaggggggaaacggggggtccggttaggggtagggggttcgggggttacgggaaccccgaaaaccgtaggtaaaccggggtaaggggggtacggggttacggggttaacggggtaaaaacggttaaaaacgttaggttacggggttacgggtaacgttcggttacggggtccggggacccggggggttacccgtaacgtttaccccgaaccgtaccgtttaacccggaaccggtaacggaaacccggtaaaccccggaaaaccccgtaaaaaccccgtaaaaaaccgttcccgtaaaccgtttaccgttaaccgttacgtaaaccggtacgtaaaacgggttacccggggaacccggtaccgttacgggtaaacggtacccggtaacccgggaccgggtaaacccgggtccgggttacgttagggttaatttaacggtttacggttggtacggacggtaagtagtttaaccgtttaacggtaaccttaaacggttaaacgggtttacgtaacgggtttaggtacgtaggttacgttagagtttacgg

SEQ ID NO: 115634 - DNA, 765 bp, Homo sapiens
  misc_feature: GYAE6OF01DFKP5.37.34.D01.1.454.CMB.1.raw
  modified_base (117)..(117): a, c, t, g, unknown or other
  misc_feature (117)..(117): n is a, c, g, or t
  modified_base (629)..(629): a, c, t, g, unknown or other
  misc_feature (629)..(629): n is a, c, g, or t
  modified_base (713)..(713): a, c, t, g, unknown or other
  misc_feature (713)..(713): n is a, c, g, or t
tcagtagtgtagatcacgaccggtgctcgatttagatcgtctgtggttgggtttgggctcagagaggagccttagccctggactccaaggcctttccacttggtgatcagcactgancacagaggactcaccagtaggtaagttggggctgagtcttgggttttccttgttgacttagttttagaaggttcgtccagtgtgacgtgcaacgtggtggagtcggtagggggacgtcttacgggtccctaggtcccggttcgggggggttccctacggacggtaccttccgttcctacggttcggacctacggtccctcgtaggtacttactaacgtttgggtagtcttagttggatgggacttcggggccacgtgtccgtacggaggggaagggtcgtagggaggtggggtccgaaccaaacgtagtaacggtagggaggttacgggtaagtaaaacggaaaaacttggtggttacgaccgtttggtacggtcgggtaccgggggtcctaaacgttcccgaaccgtattaccccgtaaccgaacggaaaccgaaacccgaaacccgtaaaacctaaacgttaccaacggttagttaactccgtaaacgaacgaaacgtcgggaacccgtntaacggtacggaacctaccggaaggtaccgtaccggtgggttaattcggttattcggtttagcgtaagagtaagttacgttaanaacgtaaacttaaggtttcgaggttactaggtacggttagtgtaattaccgg

SEQ ID NO: 115635 - DNA, 732 bp, Homo sapiens
  misc_feature: GYAE6OF01DEZ1X.37.34.D01.1.454.CMB.1.raw
  modified_base (186)..(186): a, c, t, g, unknown or other
  misc_feature (186)..(186): n is a, c, g, or t
  modified_base (642)..(642): a, c, t, g, unknown or other
  misc_feature (642)..(642): n is a, c, g, or t
  modified_base (683)..(683): a, c, t, g, unknown or other
  misc_feature (683)..(683): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgagtcttgggttttccttgttgcttagttttagaaggtntccagtgtgacgtgcaagtggtggagtcgtgggggagtcttggtcccaggtccggtcggggggtccctggacgtacctcctccgtggtcgacacggtcccttcgtaggtacttacgtaacgttttggtacgtcgttaagtttggaagttcgggtaccggttcggggtacccgtacccgtaacggttcccgtaccgggaagggggaaacggggtcgtagggtagggtgggtacggacctaaacgagtaacggaggggtaggttaggtaaggtaaaaccgaaaaaattgttacggtacggtaaccttcggtggtcggggaccgggtacctacttaccacctacgtacctaccgagaacgtaaccaaacccgtaaacccaaaactacgtaactagttacgtactacgaactaaaggtcggacggtaccgtagaagaaccgtcggaaacggcgtacggtntggttagttattagtcgtaggacgaggtagttaacgttaanaacggttaaactaaaggtttcgagttagtaacgttaggttatgtgtacg

SEQ ID NO: 115636 - DNA, 912 bp, Homo sapiens
  misc_feature: GYAE6OF01BGORQ.37.34.D01.1.454.CMB.1.raw
tcagtagtgtagatcacgaccggtgctcgatttagatcgtctgtgttgggttttccttgttgctattttagaaggtgtccagtgtgacgtgcaacgtggtggagtcgtgggggaggccttggtcccagcccgtggggggtccctgagactctcctgtgcagcctctggattacctaacttttgggtaagtccttaagttcggattgggaccttggggtccccgcctacgtccgtaccggaggggaacggggcctgggaggtgggtacggaccaaacgtagtaccggaggggtaggttacgggttaggtaaaccgaaaaaacttgtaggtacggtacctcggtcgggtacgggtcccgggggacctaccgttaccgaacctacgtccgtacccgaagaccgaaccgaaaccgaaccctaaaaaaccgtccgtaactacgtaaccttcgtacggaactaaacggttacgggaccggtccccggtaaggaacggtaaccggttacccgggaacgggtaccgtaccggcgtttagttacggtttaagtttacgttacggtacggtacgggttaacgtaaacgtttacgttttaaaacgtaaccttaacggttaaaacgggttttccggaaggtttaccggtacggtttagggttaacgttgttaacgtagttaccgtttacggtacccgaacggtttaacccggtaacggggaaccgtaaacggggacctaggttccggtacccttacccgttcttaccgttcctaccgacccttacccgaacggtacccgggaccccgttaggttcccccggttacccgtttccccccgaggtacccccggtcccgttcgtaacccgtcggtacggaaccgtacccgaaccccggtacgaccgaccgggtacccctgggtcccgg

SEQ ID NO: 115637 - DNA, 601 bp, Homo sapiens
  misc_feature: GYAE6OF01BUG6Y.37.34.D01.1.454.CMB.1.raw
  modified_base (196)..(196): a, c, t, g, unknown or other
  misc_feature (196)..(196): n is a, c, g, or t
tcagtagtgtagatcacgaccggtgctcgatttagatcgtctgtgttggggtttgggggcaggagtcagacccactcaggacacagcatggacatgagggtccccgctcagctcctggggctcctgctgctctggctcccaggtgccagatgtgccatccaaatcgacccagtctccatccctcctgtctgcatcngtaggagacagagtcatcatcacttgccgggcaagtcaggcatagaatgatttaggctggtatcagacagaaccagggaaacgccctaagctcctcagtcatgtgcatcctacgttaacaactacgggtccaagttaagacttacaggacgtcagtggatactcggacgacagtacgtttcacgttcctactaccattacagcaacgtccctagtccacgcccttaggaaacgtatttttacgactaaactttaacttacgttacttactaactaaggtaacttacctaaacgttaccccttacggtacccggttaccggtacccggaacgggtaaccgaacgggttacgggtaaacgtaccgaaaacgggtaccgtacggtacgggtactacgggtcctaaccg

SEQ ID NO: 115638 - DNA, 716 bp, Homo sapiens
  misc_feature: GYAE6OF01AE534.37.34.D01.1.454.CMB.1.raw
  modified_base (554)..(554): a, c, t, g, unknown or other
  misc_feature (554)..(554): n is a, c, g, or t
  modified_base (709)..(709): a, c, t, g, unknown or other
  misc_feature (709)..(709): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctggttttccttgttgctattttagaagtgtccagtgtgacgtgcaactggtggagtcgtgggggaggcttggtccaggccgtggggggtccctggacgactctcctggtcgcacgccctcgtggtatttcctaacgttttggtagtcttagttggagtcgggacgttcggggtcccgccgtacggttcctaccggaagggggtaacgggggcgttggggacgggttgggggtcggacctaaacgtacgtaacgggaaggggtacggggttagggttacgggtaaaacgtaaaaacgtggttacggtacggtacttcgttagggtcgggccggggtccgtaacttccgaacctacgttcccgtaccgaaggacgaaccaaccggaaccctaaaacgtcaacgttntacttacgtgaactaaggtcggacccgtcgacgtaggaccgaccggaaggaccgtacggtcttaggttacttagttagttggtacgtacggaagttaggtacgtttaagaacgttaacgttaaggttcgtacgttacgtacgttaggtagttgtntttacgg

SEQ ID NO: 115639 - DNA, 914 bp, Homo sapiens
  misc_feature: GYAE6OF01ATQXZ.37.34.D01.1.454.CMB.1.raw
  modified_base (183)..(183): a, c, t, g, unknown or other
  misc_feature (183)..(183): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttgggttttccttgttgcttattttagaggtntccagtgtgacgtgcaacgtggtggtagtcggtgggggagtcttcggtccgaggtccggttcgggggtccctgacgccttcctccgtgtcgcacgtcctcgtaggtacttaccgtaacgttttgggtaacgtcttagttaggtaagtcgggtaccgtccgggttcccgtaccgtaacgtcccgtaccggagggggaacggggtccgtaggggtacgggtcggggtacggaccccgtaaacgagtaacgggtaggggtaggggttacggtttaaaggggttaaaaccgaaaaacgtttggttcgggtacgtacgtttccggtggggttccgggcccggggttaaccgtctttacccgacctaacgttacccgtcccggtaacggtaaccggaaacccgtaaacccgtaaacccccgtaaaaacttcccgttaacgttacgttaaccgtttaacggaaccgtaaaccgtttaaacggtaccgggtaaccccgggttaaccggttacgtaaacggttaacccggtaccccggggaaccggtaacccgggtaccgggtaaccgttttacgggtttacgttttaggtttaacggtttggtacggggttaccgtaaacgggtttaacgttaaacggttttaaggtaaaacccgtttaaaacgtttaacggtttaacggttaacgggttacggttaaccggttttaagggtacccggtttaaggttcgttaaaccggg

SEQ ID NO: 115640 - DNA, 761 bp, Homo sapiens
  misc_feature: GYAE6OF01E1A44.37.34.D01.1.454.CMB.1.raw
  modified_base (620)..(620): a, c, t, g, unknown or other
  misc_feature (620)..(620): n is a, c, g, or t
  modified_base (626)..(626): a, c, t, g, unknown or other
  misc_feature (626)..(626): n is a, c, g, or t
  modified_base (746)..(746): a, c, t, g, unknown or other
  misc_feature (746)..(746): n is a, c, g, or t
tcagtagtgtagatcacgaccggtgctcgatttagatcgtctgtgttgggtttggggctcagagaggagccttagccctggactccaaggcctttccacttggtgatcagcactgagacacagaggactcaccagtggagttggggctgagtcgtttgggtttttccttggttgtactttaagttttaaggaagggttcgtaccgtaggttgtggacgtgaccgtaacgtggggtggtaggtcggtgggggacgtcgttcgggtccgacgggtcccgggttcggggggtccctaggacgtacctcgtccgtggtcgcgaccggtccttacgttaggtactttaaccgttaacgtttgggtacgtagttagtgggtacgtacggggtaccgtcggggccgaccgtacggtccggtaaccgggagggggacgggtcgttggggaagggttcgggtaacgactaaacgtaggtacggtaggggacgggtaggtaaacggtaaacgtaaaattggtagttacgcgttacgtgggtacggggaccggtactatacccgactacttaccgacgaagaccaacgaactaacaaactcatagtactgaactagacggtacgcggtacngggacncggaccgtaggaccgtatcggttaagtggtttactggttacggacgtacggaaagttagtttaacgttaaccgaaactttaaggttaacgttacgggaacttacgggttataacgggttnttcggagtttaaccg

SEQ ID NO: 115641 - DNA, 709 bp, Homo sapiens
  misc_feature: GYAE6OF01E2OKU.37.34.D01.1.454.CMB.1.raw
  modified_base (316)..(316): a, c, t, g, unknown or other
  misc_feature (316)..(316): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagtctggttttcctgttgctattttagaaggtgtccagtgtgacgtgcaactggtggagtcgtgggggagcttcggtccagccgtgggggtccctgagtactctccgtgtgcacgcctcgtggtacttcctaacgttttggagtctagttggagtgggacgtcgggtccnccgtagtcgtccgaggggaacggggctgggtaggtgggtcgaccaacgtagtaccggaaggggtaggtaggtacggtaaacgaaaaacgttgtaggtcggtactcgtcggtcgggaccgggtaccgtacttccaaccgtacttaccaccgtaacgaacgaaccgtaaacccgaaccctaaaaaacgtctaacttacgtacgtacgtacgtaacgtaaacgtcgggaaccggtaccctagggaacgtaccgtaccggaacggaaccgtacgggttaccgttaggttacggtttaatttacggtggtacgtacggagtaaacgtacgttttaacgaacgtaaacgttaaacggtttacgaaggtttacgaacgttaggttacgtagtagttaacg

SEQ ID NO: 115642 - DNA, 367 bp, Homo sapiens
  misc_feature: GYAE6OF01BS77J.37.34.D01.1.454.CMB.1.raw
  modified_base (318)..(318): a, c, t, g, unknown or other
  misc_feature (318)..(318): n is a, c, g, or t
  modified_base (339)..(367): a, c, t, g, unknown or other
  misc_feature (339)..(367): n is a, c, g, or t
tcagtagtgtagatcacgaccggtgctcgatttagatcgtctgtgttggggtttgggggggaagaggaagactgacggtcctgccacagggtggtgctgaggaagagatggaggtggacgtgtcagccacccagcgtggggcctgtccctggtccacgtctcctcagccctccaccaagggcccagtccggtccttcccccgtggccgccctgcctccagggacgccaccgtccgagacgccaacacgccggcccgtgggctcgcccgttggacaaggtacctaccgttccattcctaacacttactggaggccggtntacggcgaaggccgcaatagnnnnnnnnnnnnnnnnnnnnnnnnnnnnn

SEQ ID NO: 115643 - DNA, 821 bp, Homo sapiens
  misc_feature: GYAE6OF01DQ2ZZ.37.34.D01.1.454.CMB.1.raw
tcagtagtgtagatcacgaccggtgctcgatttagatcgtctgtggttgggtttgggggcaggagtcagacccactcaggacacagcatggacatgagggtccccgctcagctcctggggctcctgctgctctggcctcccaggtcgccagatgtgccataccaatgacccagtcctccactccctccctgtctgctatcgtggtaaggagacgagagtcactcactctaccgttcgggccgggacgaagtacgaggtactaagttaagaaagttgtagtttaggcgttaggtactacgaacggaccgaaacggaaaacccggaagggtaaacccgtacccgtacgtccctacctactacttagagttccgagctactaccgttaagttttaaccgaacggttccggtaaccttaagttacgtacgttacgacgggtcggtacgtagggacgtagtcgtacgactaacggttacttacttacctacctaccgtaccgtaactacggtacgacgaccgtaccggtcacgtaccgaacggtaccgttaacggtttaacgtttaccgttttaacgaaccgtttaaactttttaaccgttacgttaccgtttaaccgttaaacgtttacggttacgttaccgggtaacgggttttaccccgggttacccggggtttacccggggttacccgggtttaaccccggggttaacccccggggtaaacgggtaaacccgggggttaacggggtaaacgggttaaacccggttaaacggtaaccggtaaacggggtaccgttaacgggttccggggtaacggtaccccgg

SEQ ID NO: 115644 - DNA, 901 bp, Homo sapiens
  misc_feature: GYAE6OF01A0MWU.37.34.D01.1.454.CMB.1.raw
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
tcagtagtgtagatcacgaccggtgctcgatttagatcgtctgtgttgggtttggggctcagagaggagccttagccctggactccaaggcctttccacttggtgatcagcactgagcacaggaggacctcaccagtggaagttggggactgaggtcgttgggttttccttgttgtcttatttagaggtgtccgagtgtgacgtgcaacgtggtggagtcggtggggagtcttggtccagtccggtcggggtacctgcgtactctccgtgtcgacncgtcctcgtgtattctaacgtttgngtacttagttggcgtggtacgtcgggtacccncgtacgtccggtaccggaagggggtacgggtcgtaggggacggttcggggtaccgaccgaaacgtcggtaacgggtagggagggtacggtaacgttaaaacgaaaagttcgtaggtacggtacgttcgtacgggtcgggaccgggtctacgttacgaaccgtacgtccgtaccgaacggtaaccgaaccgtaaaccgtaaacccctaaaaacgttccctaacgttacgtaacgttaccgtaacggtacgaaacggttaccggggtaccggtaccggtaacgtaaccggtacggtaacccggggtaaacgggtacccggtaaccgggtttaaccggtttaggggtttaaccgtttagttttaaccggggttacggttaaccgggtaaccgggttaaaccggttaaaaacgggtttaccgttttaaaaccgggtaaaacgggttttaaaaccccgggtttaaaacggggggtttttaaacccggttaaacggggttttacccggtttaaaacgggggttttaacccgggtttaaggttaaaccggggttttaaacgtttaaacccggggg

SEQ ID NO: 115645 - DNA, 902 bp, Homo sapiens
  misc_feature: GYAE6OF01C2PAI.37.34.D01.1.454.CMB.1.raw
  modified_base (156)..(156): a, c, t, g, unknown or other
  misc_feature (156)..(156): n is a, c, g, or t
tcagtagtgtagatcacgaccggtgctcgatttagatcgtctgtgtttggggtttgggggcaggagtcagaccccactcaggacacagcatggacatgacgggtccccgctcagctccgtggggctcctgctgcttcgcggcctacccgagggtcncctaggattggtcgaccctaactacccaaaatcggaaccccctattccctcccaacctttcccgttccccctggtttccaggtacctaagttaccgttagggtaacggaaataaccgaaggtaacttaccaaacttacgaaccttacgttaccggttaccgggacccggggtaacctaaagggtacccgaagggtaacttaaagtaaaagtaaaagtttacggttaagtttaggtaccgttaaggtactacgaaacggacgaaaaccggtaaaaccgggaaacggaaccccggaaccctaacgcccttaccactacttacggtagtcgtaacaaccgttacttaacgtaacgttaacggtaaccggttcgtaaccttaaagttacgtagttacgacggtacgtagtaggtacgtccgtagtacgtcgaacgttatacgttaccgtacctaccgtaccaacgtatccgaagtaacgcgactacgacaaccgtgtaacgttaatttaacgttactaacttaaactttaccggttaaccttaacgttaaccgttaactaaaccgtttaacgttaacccgttaaccgtttaacccccggttaaacggtttaacccgggtaaccggttaaacccccggggaaacggttaaaccggggtaaagggtaacccggtaaaaacggttaaaccgtaaaccgggttaacgggtttaaacggtaccggtaaccggtaccctaaccccgtaaacccggg

SEQ ID NO: 115646 - DNA, 741 bp, Homo sapiens
  misc_feature: GYAE6OF01A43HF.37.34.D01.1.454.CMB.1.raw
  modified_base (253)..(253): a, c, t, g, unknown or other
  misc_feature (253)..(253): n is a, c, g, or t
  modified_base (284)..(284): a, c, t, g, unknown or other
  misc_feature (284)..(284): n is a, c, g, or t
  modified_base (720)..(720): a, c, t, g, unknown or other
  misc_feature (720)..(720): n is a, c, g, or t
  modified_base (727)..(727): a, c, t, g, unknown or other
  misc_feature (727)..(727): n is a, c, g, or t
  modified_base (732)..(732): a, c, t, g, unknown or other
  misc_feature (732)..(732): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagtcgttgggttttccttgttgcttattttaacgaggtctcagtgtgacgtgcaacgtggtggagtcggtggggaggcttggtcccgaggcccggtgggggtcccngacgcctcgtccgtgtcgcgacgccttacgngtacttcgtaacgttggtacgcgttaggttcgagtcggtaacgtcgggtacccgccgtacgtccgaccggtaaggggaacgggtcgtagggtacgggttcgggtacggacctaaacgtacgtagggtaacggggtagggttacggtaacggttaaaacggaaaaagttcggtagggttacgtcgttcggttcggtacgggtcccgggggaccttacgtttacccgaccgtacgttcctaacgacgaacgtaaccccgaaaccgaaacccctaaaaaccgtctaaaccgtttacgtacttaaccgtacggaacctaaagggtccgggtaacgccctaaggacccggtactaccgggaacggacgtacggttacgtagttagtttattagtgggtacgacgagtaagtaccttaagaccttacgtaaacgtgtacgtntaacggngttancgtagtacg

SEQ ID NO: 115647 - DNA, 936 bp, Homo sapiens
  misc_feature: GYAE6OF01AHIIH.37.34.D01.1.454.CMB.1.raw
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
tcagtagtgtagatcacgaccggtgctcgatttagatcgtctgtgttggttttccttgttgctattttagaaggtgtccagtgtgacgtgcaacgtggtggagtcgtggggagcttggtccagccgtgggggtccctgagactctcctgtgcacgcctntggattctaagtttggtancttagttggatggacgtcgggtccgcctagtccgtcgaggggagggctggaggtgggtcgacccaaactgtaacggaggggtaggttcggtacggtaaaaccgtaaaaactggttacggtacggtaccttacgtggtagggacccggggtacctagtttacccaacccgttagtacccgttaccgaacggtaacggaacccgtaaaacccgaacccctaaaaaacgttccgtaaccgttagttaacgtccgtacggaaccgtaaaacggttccgggaaccggttcccgaaggtaacgtacccggttaccggaacggtaccgtacccggttacgttagggttaactttaacgtttagtttacggttcgaacggttaacggtaagtttaaacgtttacggtaaacccgtttaaaggttaacccggtttttaggaacggtttacgaaccggttttagggttaacgtaccggttaagttacgtttacgttaacggttaacggtaccggtaacgggtaccggggtaaacccgtacgggtaaccggtttcggtacccgggtttaccttaaccggtttcccgttacccggtttaacgaccggttacccccgtaacccgtaaccgggtaaaccccgggtcctttaaccggttccccggttaccccccgttccggtacccggttccccggtaccccgttacgggtcccgtaccggacgtacccgttacccgaccggttaccggacgccgaaacgcccggtacccggg

SEQ ID NO: 115648 - DNA, 937 bp, Homo sapiens
  misc_feature: GYAE6OF01E2RUC.37.34.D01.1.454.CMB.1.raw
  modified_base (347)..(347): a, c, t, g, unknown or other
  misc_feature (347)..(347): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagagactcaccatggaattgggctgagtcgttgggtttttccttgttgcttagttttggaaggtgtccagtgtggaggtgtctaaagttggtggagtcggtgggggacggcctcgtccacggtccgtgggggtccctagacgacctctccttgtgtacgtcctcgtacgtaaccttttcccgtttacggctttaagtggtatcggaggtccgtcggggttccccnccgacggccgttacccggaagggggaaacgggggtccggttagggtaacgggttcgggggttaaccggaacccgaaaaccgtaaaagtaaaaacggtaccaaaaggtacggtaaagggtaaaacggtaaaaggtaaagggtaagggttacgtacgggtttcggtaacgttccggttacgggttaacggggtaacccgggtttaccgtttacccgaaaccccgtacgtttacccgtaacccggaaggtaaaccgtaaaccccgaaacccgtaaccccgggaaaacgtaaaccccggtcccgttaaggacctaactttacggacgtttaaaccgaaaagttaccgaaaaccgtggttaccgtaacgggaacggtaacccgggaaccgtaacggggaacccgttacggttaaccgttttaaacgttttacgtaccggttacgggaccgtaacgggaaacggtaaacgggaaccgggttacgggttaggggggttcccccgttttaaacgggtacccggttaaaccggggtccggggggaaaccccggttaaccgggtaaaccccccggtttcggtaaccccgggttacccccg

SEQ ID NO: 115649 - DNA, 681 bp, Homo sapiens
  misc_feature: GYAE6OF01A2315.37.34.D01.1.454.CMB.1.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (309)..(309): a, c, t, g, unknown or other
  misc_feature (309)..(309): n is a, c, g, or t
  modified_base (451)..(451): a, c, t, g, unknown or other
  misc_feature (451)..(451): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
  modified_base (623)..(623): a, c, t, g, unknown or other
  misc_feature (623)..(623): n is a, c, g, or t
tcagtagtgtagatcacgaccggtgctcgatttagatcgtctgtggttgggtttggggcaggagtcacgacccactcaggacacagcatggacagtgacgggtcccccgctcgagtctccgtgggcctccgtgcctgctcgcgaccgtcccgaggtcgccagtagtcgtcgacctactaccaaagtccgaaccctagtcctaccgtccttcccgttccgtggtcncgactgtacgagtagacgtacngactnactacatccgtcgtacgaccgagtacgcgagactaagtaacgtagttcgtagttcgnttagacgtacagaccgaaaccggtaaggaccggtaaccctaccgtacgtcctacgcttacgagtgtaccgtagtacctacggtttaccaaaccgttgaccggagttaaccgtaagttcgaccgtagggcgtacgtgtcgtancggtcaagacttacgtactctaccgcctacgaacncgtaanccgatcgaacgtcgaccgtagtactaaccgttagtccgtttaactaacgtttctttaataacggttccaaacttaactaacgttacaaccgttttaacgaccgttcctacgggttaccaagggtaaccggngtaaccggacggaaacgttaccgaattaggtaccgcgtaagtaccctgttaaccctgg

SEQ ID NO: 115650 - DNA, 591 bp, Homo sapiens
  misc_feature: GYAE6OF01DL2MI.37.34.D01.1.454.CMB.1.raw
  modified_base (174)..(179): a, c, t, g, unknown or other
  misc_feature (174)..(179): n is a, c, g, or t
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (188)..(189): a, c, t, g, unknown or other
  misc_feature (188)..(189): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (582)..(582): a, c, t, g, unknown or other
  misc_feature (582)..(582): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcggtgttcgtgtagctattagagtnnnnnntncatgngnngngggngctgcngcgtgggtccagngctctctgcncgtgcctgagattcgtaatttggactgtgttggattcggcgttgggcccnctagcctaccggagggtaacgggngtggnggtggcacaanagtagagggtcggagtagaacgtaaatgtagtgtntcgtgggtcggccgggtatctacactcgtactacgaagaacgaacgtaaacctaaactaactactataactatcgaactaagtaacggcgacggacgtacgtacgacgtaccggaacgtacggtaccgtacgttagttagttaagttcgttacggagtacggtaagtaaagtttacgtaaacgttaacgtaacgtttaacgggttacttaaggttaggttacgtagggttagngttagtaag

SEQ ID NO: 115651 - DNA, 655 bp, Homo sapiens
  misc_feature: GYAE6OF01A2VK9.37.34.D01.1.454.CMB.1.raw
  modified_base (377)..(377): a, c, t, g, unknown or other
  misc_feature (377)..(377): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgcttattttagaaggtgtccagtgtgacgtgcaactggtggagtcgtgggggaggcttggtccagccgtggggggtccctgagactctccgtgtgcacgcctcgtggtacttactaacgtttggtagtcttagttggagttggacgttcggggtccgccgagttccgtaccggaagggggaacggggcgtgggaggttggggtcgaccgaanagtacggaggggtagggtggtaaggtaaacgtaaaaagtcgtggtacggactcgtagggtcggccggggtcctacgtccaacctatcctaccgtaagaacgaaccgaaaccgaaccctaaaaactcaacgttacgtagtctacgacgtaagtcggacgtccgtagagacgtacggacggacgtaccgtcgttagtagttagtagttgtgacgtaaggagttagttaacgtacgtaacgttaagttcgtagtacggttacgttagttagtagttgtacg

SEQ ID NO: 115652 - DNA, 979 bp, Homo sapiens
  misc_feature: GYAE6OF01EEJMA.37.34.D01.1.454.CMB.1.raw
  modified_base (260)..(260): a, c, t, g, unknown or other
  misc_feature (260)..(260): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttcttgttgctatttagagtgtccagtgtgacgtgcaacgtggtggagtcgtggggagcttggtccaggccgtcggggggtccctagacgactctccgtgtnacgacgtcctacgtaggtactttacctaaaccgttttggtaacggtacttaagtttcgggaaagttcgggaaccgtttcggggtccccgtaccgtaacggttacccgttacccgggtaaagggggggaaaccgggggtccgttaggggtacgggttacgggggtttacggaaccccaaaaccggtaaagttaacccgggaagggggtaagggttttcggggtaaaggttaaaaacccggaaaaaaaccgtttagttacgggggtaaccggtaaccgtttaccggtgggttaccgggggaccccggggggttaacccaaacgtttttccccgaaaacccggtttaagttacccggttaaccaacggggaaaccgttaaacccgaaaacccgggtaaaacccctaaaaaaaccgttcccgtaaaacgtttacggttaacgtttaacccgtacgtaaacccggtaaaaacggtttaccggggaacccgggtacccgttaacgggtaaacggaaacccgtttacccgggaaacgggaaacccggttaaccgggtccgttaacgggttagtttaacgtttacgtttacgggtaacggttacggaacggttaaacgttaaacgttttaaaccggaaaccgtttaaacggttaaaacgggtttacgggtaaaaccggttggttaaaacccggttagggtttaaacgttagggaacgtttaaccggg

SEQ ID NO: 115653 - DNA, 697 bp, Homo sapiens
  misc_feature: GYAE6OF01DYVT7.37.34.D01.1.454.CMB.1.raw
  modified_base (438)..(438): a, c, t, g, unknown or other
  misc_feature (438)..(438): n is a, c, g, or t
  modified_base (608)..(608): a, c, t, g, unknown or other
  misc_feature (608)..(608): n is a, c, g, or t
  modified_base (691)..(691): a, c, t, g, unknown or other
  misc_feature (691)..(691): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagctgggttttcctgttgctatttagaaggtgtcagtgtgacgtgacaactgggtggagttcggtagggggaggtcgttgggtcccgaaggtccggtacgggggggttcccctaggaacggtacctcctaccgttggtcgccacgtcccttcgtagggtaacttaccgtaaaccgttttgggtacgtaccttaaggttacgggagtacgggtacggtcggggttcccgaccgtacgtcgtaccgaaggggacggggcgtggacggtgggtcgaccaaacagtaacggagggnggtaggtaggtaaacgaaaaactgtgtagactcgtaggtcgggccgggtactgttacccaccgtattccgtacaagtaacgaaccaaaccgaaaccaaaaactccgagttacgtaatcgtacgtaacaaagtccggaacgtccgtagagaacgaccggaggactacggtntcgtaagtacttagtggtaggacgtagaagtacttaagtaactaaaggtaaacgttggaacgttacggtaattaggtaatggnttaacg

SEQ ID NO: 115654 - DNA, 727 bp, Homo sapiens
  misc_feature: GYAE6OF01B4CX1.37.34.D01.1.454.CMB.1.raw
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (625)..(625): a, c, t, g, unknown or other
  misc_feature (625)..(625): n is a, c, g, or t
  modified_base (641)..(641): a, c, t, g, unknown or other
  misc_feature (641)..(641): n is a, c, g, or t
tcagtagtgtagatcacgaccggtgctcgatttagatcgtctgtgttggggtttggggctcagagaggagccttagccctggactccaaggcctttccacttggtgatcagcactgagcacagaggactcaccatggaatggggctgagcttgggttttccttgttgcttatttagaaggtgtcagtgtgagtgcaactggtggagtcgtgggggagtcgttcggtccgaggccggtcggggggtccctggacgactctccgtgtcgcgacgtcctcgtagtacttacgtaacggttttggtatacttagttacggatacgggtacgtcggggtccgaccgtaacggtcctaccgggaaggggggtaacggggtcgttggggacgggttacggggttaccggaccgtaaaacgacgttaaaccgggagggggtagggttagggttaaacgggtaaacgtaaaaaacttgtaggtcggtaactcggtaggtacggggaccgggggttacccttaagttacccgaacccgtaacgttacccgtacccggtaacgtaaccgggtaaaacccgaaaacccgggtaaaacccctaaaaaacccgtacccgtttaaanananacncnacanagtacacacacgacgngagtacgacacgactacgacgtacacgacagacgtacgactacgtcgacgtaacgaaccgtacgacgtaacgtacgtacgtagtac

SEQ ID NO: 115655 - DNA, 962 bp, Homo sapiens
  misc_feature: GYAE6OF01AOEG1.37.34.D01.1.454.CMB.1.raw
  modified_base (207)..(207): a, c, t, g, unknown or other
  misc_feature (207)..(207): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaatgtgtccagtgtgacgtgcaacgtggtggngtcgtggggggagcgttcggtccgaggtcccggtgggggggtcccctaggacgtacctcctccgtgtcgctacggccctccgtggactttccgtaaacgttttggtacgcttaagttgggagtgggtaaccgtcggggtcccgcctaacggtccgtcccggaaggggtaagggggtcttcggggtaagggttcgggggtacgggaccccgaaaacgtacgttaaccggaagggggggtaacggttagggggtaacgggtaaaaccggtaaaaaaaaccggttagttacgggtagggtaaacccgtttcgggttacggtcggggtacccgggggggtaccccgttaaacgtttccccgaaaaccccttaccgttacccgtttaacccgaacgggtaaaccgtaaaccccggtaaacccccggaaaaaccccgttaaaaaaaacccgttacccgtaaaccgttaacggtttaaccgttaaccgtttaccggaaacccgtaaaaggtttaccgggggaacccgggtaccccgttaagggaaaccggtacccggttaacccgggaaaccgggtaaccgggtaaccgggttaccggttacggtttaacggttaacgttttaacgggttacggttacgggtaaccgggtaaccgggtaaggtttaaaggtttaacggttaaacccggtttaaacgttaaaaccggttttccggtaaaggtttacgggtaaacccgtttagggttaaccgttgggttaacgg

SEQ ID NO: 115656 - DNA, 882 bp, Homo sapiens
  misc_feature: GYAE6OF01DXYK4.37.34.D01.1.454.CMB.1.raw
  modified_base (233)..(233): a, c, t, g, unknown or other
  misc_feature (233)..(233): n is a, c, g, or t
tcagtagtgtagatcacgaccggtgctcgatttagatcgtctgtgtttgggtttggggctcagagaggagccttagccctggactccaaggcctttccacttggtgatcagcacgtgacgtcacagaggactcaccagtggattgggctgagcgtttcggttttcctgtttgtcttaagttttaggaaggttcgtccaggttgtgtacgtgactaacgtgggtggagttcggngggggtagtcgttcggacccgtacggtccgggttcgggggttccctggacgtaccttccgttccgtggtacggcgtaccggtccgttcgttacggttaactttaccggttaaagttttgggttaacgtacctttaagggttggtaacggttggacccggtttccgggtaccccgacggttacgttccggtaaccggggaagggggtaacgggtcgtaggggtcggttagggtacggtaccgaaccgtaagtaccgggtacgggaaggggtacggttaaacgggtaaccggtaaaaaacttaccgggttagtcgggttaaaccgtcggttcggtcggggaccggggtaccgtacccggtactacccgttaactacccgtaacgtaccggaaacgaacccggaaacccaacccgtaaaactaccggtactaacgttacgtactaacggaaccttaaggtacggtacccgtagtacgtaacggacgtaccggaaccgtacgggaccgttacggttcgttaaggttacgtttagtacgttccgggtagaacggtttacggttaaagtttaacccggttaacggttaaaccttaaaccggtttggaaacggttttgggtaacgtttagggtttacggtaagtttcggttaacgg

SEQ ID NO: 115657 - DNA, 496 bp, Homo sapiens
  misc_feature: GYAE6OF01BNUDW.37.34.D01.1.454.CMB.1.raw
  modified_base (400)..(400): a, c, t, g, unknown or other
  misc_feature (400)..(400): n is a, c, g, or t
  modified_base (429)..(496): a, c, t, g, unknown or other
  misc_feature (429)..(496): n is a, c, g, or t
tcagtagtgtagatcacgaccggtgctcgatttagatcgtctgtgttggggtttgggggggaagaggaagactgacggtcctgccacaggtggtgctggaggaagagagtggagggtggacgtgtccagccacccagctgggggccctggtcccctggtccacccgtctccctcacgcccctacccgaaccgaaacggggcccccacgttcccgggttcccctttcccccccgtgggaccccgtccccctggccctaccgaagggaccggccctaaccccgtccggaaagaccgaccaaccgacgggtccccgggccccgttggggcctcggtcccgttagggtaacaaaggtaccttaccttcccaatacctaacgtacctactcggacggggccgggntacgggacgaacgggctacaagtagcagnnnnnnnnnnnnnnnnnnnnnnnnnnnnnnnnnnnnnnnnnnnnnnnnnnnnnnnnnnnnnnnnnnnn

SEQ ID NO: 115658 - DNA, 760 bp, Homo sapiens
  misc_feature: GYAE6OF01AGNFF.37.34.D01.1.454.CMB.1.raw
  modified_base (282)..(282): a, c, t, g, unknown or other
  misc_feature (282)..(282): n is a, c, g, or t
  modified_base (345)..(345): a, c, t, g, unknown or other
  misc_feature (345)..(345): n is a, c, g, or t
  modified_base (404)..(404): a, c, t, g, unknown or other
  misc_feature (404)..(404): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagccgtgggggggtccctggagactctcctgtgcagcctctggattcaactttggtagctattggatggactgggtccgcagtctccgaggggaagggggctgggaggtgggggtcggaccaacagtacgagggggaggtgggtaggtaacgaaaaactntggtggacctctgtggcggggccgattcaccatctccagacgacaacgaccaaaaactcactntatctgacaaagtcgggaccggctggagactccggaggacacggctgtagtattatggngcgagagtatttagactaacgtaagtttcgagtcgacgtggtatgtattggcttaagtgaacgttaccgggtacgggggacccgtaaaggggacctaggtcgggttaccctaccggttccttacctttccgaaccgttccccgtacccgaaaccccggtaaccggggtccccctaaccggtttcccccgggttaccccctttccccccccgggtacggggtccccccggttcccccggtacccgggttaccccgttcccgggaacccgggggtaaccccgttacccccgtaacccccgggttaacccgggaaacccggttacccgggaaccccgtaaccccgggaaccccgggggg

SEQ ID NO: 115659 - DNA, 294 bp, Homo sapiens
  misc_feature: GYAE6OF02GPQ4V.37.34.D01.1.454.CMB.1.raw
  modified_base (293)..(294): a, c, t, g, unknown or other
  misc_feature (293)..(294): n is a, c, g, or t
tcagtagtgtagatcacgaccggtgctcgatttagatcgtctgtgttgggtttggggaagaggaagactgacggtcctgccacaggtggtgctgaggaagagatggaggtggacgtgtcagcacccagctgggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnn

SEQ ID NO: 115660 - DNA, 491 bp, Homo sapiens
  misc_feature: GYAE6OF02FXZYW.37.34.D01.1.454.CMB.1.raw
tcagtagtgtagatcacgaccggtgctcgatttagatcgtctgtgttgggtttgggcaggagtcagacccactcaggacacagcatggacatgagggtccccgctcagctcctggggctcctgctgctctggctcccaggtgccagatggtgccatccgaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaactgggtcccattaagattcagcggcagtggatctggcacagatttcactctcaccatcagcagcctgcagcctgaagtattttgctaacttattactgtctacaagtattacaattaccctcgttacgttcggacctaagggaccaaggtgaagtcaacgactgtggctgcac

SEQ ID NO: 115661 - DNA, 302 bp, Homo sapiens
  misc_feature: GYAE6OF02HS3W9.37.34.D01.1.454.CMB.1.raw
  modified_base (298)..(302): a, c, t, g, unknown or other
  misc_feature (298)..(302): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagcgtgggcctgtccctggtcaccgtctcctcagcctccaccaaggcccatcggtccttcccctggccgccctgctccaggagcacctccgagagcacagccggcccgtgggctgcctggtcaaggactacttccatctacactactgagcgggctggcaaggcgcatagnnnnn

SEQ ID NO: 115662 - DNA, 487 bp, Homo sapiens
  misc_feature: GYAE6OF02HMJQE.37.34.D01.1.454.CMB.1.raw
tcagtagtgtagatcacgaccggtgctcgatttagatcgtctgtgttgggtttggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaaagctcctcatctatgtgcatccagtttacaaactgggtcccattaagattcagcggcagtgatctggcacagatttcactctcaccatcagcagctgcagcctgaagattttgcaacttattactgtctacaagattacaattacctcgtacgttcgccaagggaccaaggtgaagtcaaacgactagttggcttgctaacc

SEQ ID NO: 115663 - DNA, 298 bp, Homo sapiens
  misc_feature: GYAE6OF02IECI4.37.34.D01.1.454.CMB.1.raw
  modified_base (295)..(298): a, c, t, g, unknown or other
  misc_feature (295)..(298): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctttccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnn

SEQ ID NO: 115664 - DNA, 298 bp, Homo sapiens; identical to SEQ ID NO: 115379
  misc_feature: GYAE6OF02G8Z5V.37.34.D01.1.454.CMB.1.raw
  modified_base (295)..(298): a, c, t, g, unknown or other
  misc_feature (295)..(298): n is a, c, g, or t

SEQ ID NO: 115665 - DNA, 297 bp, Homo sapiens
  misc_feature: GYAE6OF02GWEDO.37.34.D01.1.454.CMB.1.raw
  modified_base (294)..(297): a, c, t, g, unknown or other
  misc_feature (294)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcggctggcaaggcgcatagnnnn

SEQ ID NO: 115666 - DNA, 298 bp, Homo sapiens; identical to SEQ ID NO: 115332
  misc_feature: GYAE6OF02F8O9T.37.34.D01.1.454.CMB.1.raw
  modified_base (296)..(298): a, c, t, g, unknown or other
  misc_feature (296)..(298): n is a, c, g, or t

SEQ ID NO: 115667 - DNA, 296 bp, Homo sapiens
  misc_feature: GYAE6OF02F5AXC.37.34.D01.1.454.CMB.1.raw
  modified_base (295)..(296): a, c, t, g, unknown or other
  misc_feature (295)..(296): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnn

SEQ ID NO: 115668 - DNA, 563 bp, Homo sapiens
  misc_feature: GYAE6OF02HASMV.37.34.D01.1.454.CMB.1.raw
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (236)..(237): a, c, t, g, unknown or other
  misc_feature (236)..(237): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
tcagtagtgtagatcacgaccggtgctcgatttagatcgtctgtgttgggtttggggtctcagagaggagccttagccctggactccaaggcctttccacttggtgatcagcactgagcacagaggactcaccatggaattgggctgagcggcgttcgtcgtaggcgtcttagtagntcngtgtgcgtgcactgtgngtcngggagctgcagcngggtccgtgagctctctgtgcnnctctgatctacttgtagntatgntgngtggtcgcacgtctcgaggaggcgtggnggtggtgcgacgagtacgaggaggtggtaggtaacgtaaacgtaagtagtagtacgtcgtgtcggcgggccgtacgtacgtaccgacgtacgtccgacgacgaaccgaaccgaaccaaaacctactactacgtacgtactacgactaacgtacgacgtacgtacgacgacgtaccgacgacgacggtacgtgtgtagttagttgtcgtacgtagtagtaagttagtacgtaacgttaacgttacgtagtacgtacgtaggtagtagtagtcg

SEQ ID NO: 115669 - DNA, 521 bp, Homo sapiens
  misc_feature: GYAE6OF02IV76U.37.34.D01.1.454.CMB.1.raw
  modified_base (371)..(371): a, c, t, g, unknown or other
  misc_feature (371)..(371): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacaggggaggtggtggtacgaaaaactntgtggactctgtgcggggccgattcaccatctccagagacaacgaccaaaaactcactgtatctgcaaatggacgcctgagatccgagacacggctgtgtattatgtgcgagagtatttagactacaagtttcgagtgactggtatgatg

SEQ ID NO: 115670 - DNA, 312 bp, Homo sapiens
  misc_feature: GYAE6OF02JB76A.37.34.D01.1.454.CMB.1.raw
  modified_base (299)..(312): a, c, t, g, unknown or other
  misc_feature (299)..(312): n is a, c, g, or t
tcagtagtgtagatcacgaccggtgctcgatttagatcgtctgtggttgggtttgggggaagaggaagactgacggtcctgccacaggtggtgctggacggaagagatggaggtgggacgtgtcagcacccagctggggcctgtccctggtcaccgtctcctcagcctccaccaagggcccatcggtcttccacctggcgccctgctccaggagcacctccgagagcacagcggccctgggctgcctggtcaaggctacttccatctacactactgagcgggctggcaaggcgcatagnnnnnnnnnnnnnn

SEQ ID NO: 115671 - DNA, 298 bp, Homo sapiens; identical to SEQ ID NO: 115379
  misc_feature: GYAE6OF02G51TZ.37.34.D01.1.454.CMB.1.raw
  modified_base (295)..(298): a, c, t, g, unknown or other
  misc_feature (295)..(298): n is a, c, g, or t

SEQ ID NO: 115672 - DNA, 298 bp, Homo sapiens; identical to SEQ ID NO: 115379
  misc_feature: GYAE6OF02HAGFB.37.34.D01.1.454.CMB.1.raw
  modified_base (295)..(298): a, c, t, g, unknown or other
  misc_feature (295)..(298): n is a, c, g, or t

SEQ ID NO: 115673 - DNA, 295 bp, Homo sapiens
  misc_feature: GYAE6OF02FLY4D.37.34.D01.1.454.CMB.1.raw
  modified_base (295)..(295): a, c, t, g, unknown or other
  misc_feature (295)..(295): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagn

SEQ ID NO: 115674 - DNA, 490 bp, Homo sapiens
  misc_feature: GYAE6OF02HO2B0.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatgtgcatccagtttacaaactgggtcccattaagattcagcggcagtggatctggcacagatttcactctcaccatcagcagcctgcagcctgaagattttgctaacttattactgtctacaagattacaattaccctgtacgttcggccaagggaccaaggtgaagtcaaacgactgtaggctgctaaccg

SEQ ID NO: 115675 - DNA, 299 bp, Homo sapiens
  misc_feature: GYAE6OF02IC9MD.37.34.D01.1.454.CMB.1.raw
  modified_base (295)..(299): a, c, t, g, unknown or other
  misc_feature (295)..(299): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnn

SEQ ID NO: 115676 - DNA, 299 bp, Homo sapiens
  misc_feature: GYAE6OF02IDV6E.37.34.D01.1.454.CMB.1.raw
  modified_base (294)..(299): a, c, t, g, unknown or other
  misc_feature (294)..(299): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcggctggcaaggcgcatagnnnnnn

SEQ ID NO: 115677 - DNA, 570 bp, Homo sapiens
  misc_feature: GYAE6OF02GEJBX.37.34.D01.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (169)..(169): a, c, t, g, unknown or other
  misc_feature (169)..(169): n is a, c, g, or t
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (185)..(186): a, c, t, g, unknown or other
  misc_feature (185)..(186): n is a, c, g, or t
  modified_base (190)..(190): a, c, t, g, unknown or other
  misc_feature (190)..(190): n is a, c, g, or t
  modified_base (192)..(194): a, c, t, g, unknown or other
  misc_feature (192)..(194): n is a, c, g, or t
  modified_base (201)..(201): a, c, t, g, unknown or other
  misc_feature (201)..(201): n is a, c, g, or t
tcagtagtgtagatcacgaccggtgctcgatttagatcgtctgtgttgggtttgaggtctcagagaggagccttagccctggactccaaggcctttccacttggtgatcagcactgagcacagaggactcaccatggaattggggctgagcggngttcgtntaggcgtnttagagncagtgnagnnatgngnnngggagcngcagcctgggggtcctgagctctcctgtgtagcctctgaatttccccctttaggctttattggatgacgctggtccgccaggctccgagggaggggcgtgggaggtgggtggacgaacgaataagacgaagagtaggaagtaaggaaggagtagtagtaggtacgtcgtgtaggagggtaccgttactacctactctaccgacgacgaacaacgaccgaacgaacctaccgtacgcactacgtacgacaatacgacacgtacgtagagacggacgacggacgacgtacgtattattacgtcgcgacgagaggaaggacggtacggtcggttacgtacgtacggtacgggacggacggtaccgtacgtcg

SEQ ID NO: 115678 - DNA, 497 bp, Homo sapiens
  misc_feature: GYAE6OF02HD4MM.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagccctaagctcctcatctatgtgcatccagttacaaactgggtacccattaagattcagcggcagtgatctggcacagtattcactctcacatcagcagcctgcagcctagaagtatttgctaacttattactgtactaacaagtattaacaattaccctagtacgttcggaccaagggaccgaaggtcggaagtcaaacgtactgtggctcgctaacc

SEQ ID NO: 115679 - DNA, 299 bp, Homo sapiens; identical to SEQ ID NO: 115675
  misc_feature: GYAE6OF02INGDW.37.34.D01.1.454.CMB.1.raw
  modified_base (295)..(299): a, c, t, g, unknown or other
  misc_feature (295)..(299): n is a, c, g, or t

SEQ ID NO: 115680 - DNA, 539 bp, Homo sapiens
  misc_feature: GYAE6OF02GFSG0.37.34.D01.1.454.CMB.1.raw
  modified_base (152)..(152): a, c, t, g, unknown or other
  misc_feature (152)..(152): n is a, c, g, or t
  modified_base (160)..(160): a, c, t, g, unknown or other
  misc_feature (160)..(160): n is a, c, g, or t
  modified_base (166)..(166): a, c, t, g, unknown or other
  misc_feature (166)..(166): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (302)..(302): a, c, t, g, unknown or other
  misc_feature (302)..(302): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgnggttcgtntaggcnttagagtgcntntgagtgcatgtgagtctgggagcttggccagcctgggggtccctgagactctcctgtgcagcctctggattcaacttggttagctattggatgatggtcgccagtctccaggaagggcgtgggnggtggtggcgacagtacgaggaggtaggtaggtaacgtaaaacgtaagtagtggacgtcgtgtggcgggcgactcacactcctacagagacgaacgaaccaaaacctactactacgtatactagacgtaagtacggacgtacgtacgagacgtacgacgacgacgcgtgtgtagttagttgtgtacgagagtagttagtacgtaactaagttagtagtagtagtagtagtagtagtg

SEQ ID NO: 115681 - DNA, 539 bp, Homo sapiens
  misc_feature: GYAE6OF02HSTXW.37.34.D01.1.454.CMB.1.raw
  modified_base (496)..(496): a, c, t, g, unknown or other
  misc_feature (496)..(496): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaatggacggcctgagatccgaggacacggctgtgtattatttgtgcgagagatttagactacaaagtttcagtgactggtatgatgcttatgataccgtggggccaagggaccatggtcaccgtctcttcagcctccaccaagggcccaagtccgtccttccccgnggccgccctgcctccaggacgcacccgtccgagacgcacacgg

SEQ ID NO: 115682 - DNA, 295 bp, Homo sapiens
  misc_feature: GYAE6OF02GEMAD.37.34.D01.1.454.CMB.1.raw
  modified_base (294)..(295): a, c, t, g, unknown or other
  misc_feature (294)..(295): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctgggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnn

SEQ ID NO: 115683 - DNA, 294 bp, Homo sapiens; identical to SEQ ID NO: 115659
  misc_feature: GYAE6OF02GEMFY.37.34.D01.1.454.CMB.1.raw
  modified_base (293)..(294): a, c, t, g, unknown or other
  misc_feature (293)..(294): n is a, c, g, or t

SEQ ID NO: 115684 - DNA, 299 bp, Homo sapiens; identical to SEQ ID NO: 115675
  misc_feature: GYAE6OF02H168Z.37.34.D01.1.454.CMB.1.raw
  modified_base (295)..(299): a, c, t, g, unknown or other
  misc_feature (295)..(299): n is a, c, g, or t

SEQ ID NO: 115685 - DNA, 299 bp, Homo sapiens; identical to SEQ ID NO: 115675
  misc_feature: GYAE6OF02GQ1RT.37.34.D01.1.454.CMB.1.raw
  modified_base (295)..(299): a, c, t, g, unknown or other
  misc_feature (295)..(299): n is a, c, g, or t

SEQ ID NO: 115686 - DNA, 336 bp, Homo sapiens
  misc_feature: GYAE6OF02INAW4.37.34.D01.1.454.CMB.1.raw
  modified_base (190)..(190): a, c, t, g, unknown or other
  misc_feature (190)..(190): n is a, c, g, or t
  modified_base (295)..(295): a, c, t, g, unknown or other
  misc_feature (295)..(295): n is a, c, g, or t
  modified_base (297)..(336): a, c, t, g, unknown or other
  misc_feature (297)..(336): n is a, c, g, or t
tcagtagtgtagatcacgaccggtgctcgatttagatcgtctgtgttgggtttgggggaagaggaagactgacggtcctgccacaggtggtgctgaggaagagattggaggtggacgtgtcagcacccagctggggcctgtccctggtcaccgtctcctcagcctcacaaggccatcgtctcccctggcncctgctccaggagccacctcgagagcacagcggccctgggcctggcctggtccaaggactaacttccatctacactactggacgcggactggcaaggcgcatagngnnnnnnnnnnnnnnnnnnnnnnnnnnnnnnnnnnnnnnnn

SEQ ID NO: 115687 - DNA, 524 bp, Homo sapiens
  misc_feature: GYAE6OF02GTX9G.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaactgggtcccattaagattcagcggcagtggatctggcacagatttcactctcaccatcagcagcctgcagcctgaagtatttgactaactttattactgttactaacgaagtactttaacaactttaccctcgttaccgttcggtacccaaggggtaacccaaggggtagaacgtacaaacggtacgttggtaggctgactacccg

SEQ ID NO: 115688 - DNA, 534 bp, Homo sapiens
  misc_feature: GYAE6OF02JBSNB.37.34.D01.1.454.CMB.1.raw
  modified_base (264)..(264): a, c, t, g, unknown or other
  misc_feature (264)..(264): n is a, c, g, or t
  modified_base (513)..(513): a, c, t, g, unknown or other
  misc_feature (513)..(513): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtacgaaaaactntgtggactctgtgcggggccgattcaccatctccagagacaacgccaaaaactcactgtatctgcaaatggacggcctgagatccgaggacacggctgtgtattattgtgcgagagatttagactacaaagtttcgagtgactggtatgatgcttatgataccgtggggccaagggaccatggtcaccgtctcttcagcctccaccaagggcccagtcgtccttccccgtggccgccctgctccaggcnccacctccgagacgcacacgg

SEQ ID NO: 115689 - DNA, 366 bp, Homo sapiens
  misc_feature: GYAE6OF02HC68G.37.34.D01.1.454.CMB.1.raw
  modified_base (310)..(315): a, c, t, g, unknown or other
  misc_feature (310)..(315): n is a, c, g, or t
  modified_base (317)..(317): a, c, t, g, unknown or other
  misc_feature (317)..(317): n is a, c, g, or t
  modified_base (320)..(366): a, c, t, g, unknown or other
  misc_feature (320)..(366): n is a, c, g, or t
tcagtagtgtagatcacgaccggtgctcgatttagatcgtctgtgttaggggtttggggggaagtaggaagactgacggtcctgccacaggtcggtgctgaggtaagagatggaggtggacgtgtcagcacccagcgtggggcctgtccctggtcaccgtctcctcagcctccaccaagggcccatcggtcttcccccgtggcgccctgctccaggagcacctccgagagcacagcggtccctgggctgacctaggtacaaggtactacttccatctacactactagagcgggctggcaaggcgcatagnnnnnngncgnnnnnnnnnnnnnnnnnnnnnnnnnnnnnnnnnnnnnnnnnnnnnnn

SEQ ID NO: 115690 - DNA, 362 bp, Homo sapiens
  misc_feature: GYAE6OF02F5S8Q.37.34.D01.1.454.CMB.1.raw
  modified_base (306)..(362): a, c, t, g, unknown or other
  misc_feature (306)..(362): n is a, c, g, or t
tcagtagtgtagatcacgaccggtgctcgatttagatcgtctgtgttggggtttgggggaagaggaaggactgacggtccctgcccacaggtggtgctgaggaagagatggaggtggacgtgtcagcacccagctggggcctggtccctgggtcaccgtctcctctagcctccaccaagggcccaatcggtcttcccctggcgccctgctccaggagcacctccggagagcacagcggccctgggctgcctggtcaaggctacttccatctacactactgagcgggctgggcaaggcgcatacggnnnnnnnnnnnnnnnnnnnnnnnnnnnnnnnnnnnnnnnnnnnnnnnnnnnnnnnnn

SEQ ID NO: 115691 - DNA, 519 bp, Homo sapiens
  misc_feature: GYAE6OF02JKO4P.37.34.D01.1.454.CMB.1.raw
  modified_base (367)..(367): a, c, t, g, unknown or other
  misc_feature (367)..(367): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtctgggggaggcttggtccagcctggggggtccctgagactctcctgtgcagcctctggattcaactttggtagctattggatggactgggtccgcagtctccagggaagggctggagtgggtggccaacgatacgagggaggtggtggtaacgaaaactntgtggactctgtgcggggcgattcacatctcagagacaacgaccaaaactcactgtatctgacaaatggacgcctagagatccgaggacacggctgtgtattattgtgcgagagtatttagactaactaagttcgagtgactggtatgatcg

SEQ ID NO: 115692 - DNA, 295 bp, Homo sapiens
  misc_feature: GYAE6OF02FIP96.37.34.D01.1.454.CMB.1.raw
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatag

SEQ ID NO: 115693 - DNA, 300 bp, Homo sapiens; identical to SEQ ID NO: 115346
  misc_feature: GYAE6OF02GDLH2.37.34.D01.1.454.CMB.1.raw
  modified_base (295)..(300): a, c, t, g, unknown or other
  misc_feature (295)..(300): n is a, c, g, or t

SEQ ID NO: 115694 - DNA, 297 bp, Homo sapiens
  misc_feature: GYAE6OF02IIL5V.37.34.D01.1.454.CMB.1.raw
  modified_base (296)..(297): a, c, t, g, unknown or other
  misc_feature (296)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaaggctacttccatctacactactgagcgggctggcaaggcgcatagnn

SEQ ID NO: 115695 - DNA, 302 bp, Homo sapiens
  misc_feature: GYAE6OF02JXRSF.37.34.D01.1.454.CMB.1.raw
  modified_base (296)..(302): a, c, t, g, unknown or other
  misc_feature (296)..(302): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggccgccctgctccaggagcacctccgagagcacagcggccctgggctgcctggtcaaggactacttccatctacactactgagcggctggcaaggcgcatagnnnnnnn

SEQ ID NO: 115696 - DNA, 528 bp, Homo sapiens
  misc_feature: GYAE6OF02GXA4A.37.34.D01.1.454.CMB.1.raw
  modified_base (382)..(382): a, c, t, g, unknown or other
  misc_feature (382)..(382): n is a, c, g, or t
  modified_base (465)..(465): a, c, t, g, unknown or other
  misc_feature (465)..(465): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcggggtcccatcaaggttcagcggcagtgtatctgggacagaattcactctcaccatcagtancctgcagcctgatgattttgactaactttattactgtcagactatataagtgggagtacgttcggccgagggacctagggtanagtacgtacgaaacggtaacctggtacggtctgaccaccgtattccgtagttccttactaccg

SEQ ID NO: 115697 - DNA, 529 bp, Homo sapiens
  misc_feature: GYAE6OF02FI6O6.37.34.D01.1.454.CMB.1.raw
  modified_base (491)..(491): a, c, t, g, unknown or other
  misc_feature (491)..(491): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaatggacggcctgagatccgaggacacggctgtgtattattgtgcgagagatttagactacaaagtttcgagtgactggtatgatgcttatgataccgtggggccaagggaccatggtcactgtctcttcagcctccaccaaggcccatccgtcttccccnggccgccctgcctccaggacgcaccctccgagagcacg

SEQ ID NO: 115698 - DNA, 504 bp, Homo sapiens
  misc_feature: GYAE6OF02FOMXI.37.34.D01.1.454.CMB.1.raw
  modified_base (398)..(398): a, c, t, g, unknown or other
  misc_feature (398)..(398): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgattaggctggtatcagcagaaaccagggaaagcccctaagctcctcatctatggtgcatccagtttacaaactgggtacccattaagattcagcggcagtggatctggcacagtatttcactctcaccatcagcagcctgcagcctgaagtntttgactaacttattactgtactacaagtattacaattaccctcgtacgttcggaccgaagggaccaagggtacggaagtacgaaacgtactgtaggctcgctacc

SEQ ID NO: 115699 - DNA, 296 bp, Homo sapiens; identical to SEQ ID NO: 115667
  misc_feature: GYAE6OF02HAJXL.37.34.D01.1.454.CMB.1.raw
  modified_base (295)..(296): a, c, t, g, unknown or other
  misc_feature (295)..(296): n is a, c, g, or t

SEQ ID NO: 115700 - DNA, 547 bp, Homo sapiens
  misc_feature: GYAE6OF02HXEIE.37.34.D01.1.454.CMB.1.raw
  modified_base (380)..(380): a, c, t, g, unknown or other
  misc_feature (380)..(380): n is a, c, g, or t
  modified_base (447)..(447): a, c, t, g, unknown or other
  misc_feature (447)..(447): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttggtccagccgtggggggtccctgagactctcctgtgcagcctctggattcaacttttggagctattggatggactgggtccgccagtctccaggggaaggggctgggagtggggtggccaacatacgaggggaggttggtagggtaacgaaaaactntggtaggactctgtggcggggccattcaccatctccagagaacaacgaccaaaaactcactgtatcngacaaatcggacgcctgagactaccgagacacggctgtgttattattgtgacgagagtatttagactaacgtaaagtttcgagtgtactggtatgatacg

SEQ ID NO: 115701 - DNA, 363 bp, Homo sapiens
  misc_feature: GYAE6OF02GNOFV.37.34.D01.1.454.CMB.1.raw
  modified_base (304)..(304): a, c, t, g, unknown or other
  misc_feature (304)..(304): n is a, c, g, or t
  modified_base (312)..(363): a, c, t, g, unknown or other
  misc_feature (312)..(363): n is a, c, g, or t
tcagtagtgtagatcacgaccggtgctcgatttagatcgtctgtgttggggttttgggggggaagaggaagactgacggtcctgccacaggtggtgctgaggaaggacgatggaggtggacgtggtcagcacccagctggggcctgtcccctggtcaccgtctcctcagcctccaccaagggcccatcggtccttccccctggccgccctgctccaggagcacctccgagagcacagcggccctgggcctgcctggtcaaggactacttccatctacactactgagcgggctggaccaagggcnccaatagnnnnnnnnnnnnnnnnnnnnnnnnnnnnnnnnnnnnnnnnnnnnnnnnnnnn

SEQ ID NO: 115702 - DNA, 553 bp, Homo sapiens
  misc_feature: GYAE6OF02FUG4U.37.34.D01.1.454.CMB.1.raw
  modified_base (181)..(181): a, c, t, g, unknown or other
  misc_feature (181)..(181): n is a, c, g, or t
  modified_base (283)..(283): a, c, t, g, unknown or other
  misc_feature (283)..(283): n is a, c, g, or t
  modified_base (551)..(551): a, c, t, g, unknown or other
  misc_feature (551)..(551): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcggtggttcgtgtaggctatttagaaggtntcagtgtgacgtgcaactggtggagtcgtgggggaggcttgggtccagccgtggggggtccctgagactctcctgtgcagcctcgtggattcaatttggtanctattggatggactgggtccgccagtctccgagggaggggctggagtgggtggccaactagtacaggggaggtggtggtaacgaaaatgtgtggactctggtgcgggggaccattccaccgatccgtaccagagacaacgaccaaaaactcaactgtatctgcaaagtggacggcctagacgataccgaggacgacggcttgtgttattagttgtagtcgagagtaatttagacttaacgtaagttcgagtacgtacgtggtatggtntg

SEQ ID NO: 115703 - DNA, 296 bp, Homo sapiens
  misc_feature: GYAE6OF02G0HFA.37.34.D01.1.454.CMB.1.raw
  modified_base (294)..(296): a, c, t, g, unknown or other
  misc_feature (294)..(296): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatacactactgagcgggctggcaaggcgcatagnnn

SEQ ID NO: 115704 - DNA, 511 bp, Homo sapiens
  misc_feature: GYAE6OF02HE8O3.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaacgtgggtacccattaagattcagcggcagtgatctggcacagtatttcactctcaccatcagcagcctgcagcctgaagtattttgactaacttattactgtactacaagtattacaacttaccctcgtacgttcggaccgaaagggaccaagggtagaagtacgaaacgtactggtacggcttgacctaaccg

SEQ ID NO: 115705 - DNA, 517 bp, Homo sapiens
  misc_feature: GYAE6OF02GS0WJ.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtccgcatctgtaggagacaaagtcatcatcacttgccgggcaagtcagggcgattagaaatgatttaaggctggtatcagcagaaaccaaggaaagacccctaacgctcctcatctatggtgcatccagtttacaaactggggtcccattaagattcagcggcagtggatctggcacagatttcactctcaccatcagcagcctgcagcctagaagtattttgactaactttattactagttctaacaagtattacaacttaccctacgtacgttcggccaagggtaccaagggtagaacgtacaaacgacgtgtggactcgactaccatcg

SEQ ID NO: 115706 - DNA, 320 bp, Homo sapiens
  misc_feature: GYAE6OF02G4WZC.37.34.D01.1.454.CMB.1.raw
  modified_base (308)..(320): a, c, t, g, unknown or other
  misc_feature (308)..(320): n is a, c, g, or t
tcagtagtgtagatcacgaccggtgctcgatttagatcgtctgtgttgggtttggggggaagaggaagactgacggtcctgccacaggtggtgctgaggaagagagtggaggtggacgtgtcagcacccagcgtggggcctgtccctggtcaccggtctcctcagcctccaccgaagggcccatcggtccttcccctggccgccctgctccgaggagccacctccgagagcgacagccggccctgggctggcctggtacaaaggactacttccatctacactactgagcggctggcaaggcgcatagnnnnnnnnnnnnn

SEQ ID NO: 115707 - DNA, 578 bp, Homo sapiens
  misc_feature: GYAE6OF02IKWLZ.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggagtggtgatacgaaaaaactatgtggactctgtgcggggccgattcaccatctccagagacaacgccaaaaactcactgtatctgcaaatgaacagcctgagtgccgaggacacggccctatattattgtgcgaaatgtgggggagtgggggctacgtcctggcgttttgactacgtggggccagggagcccctgggtccaccggttctcctcagccctaccaacaacgggcccagtccggtccttccccctgggccgccccttcgcctcccgaggtacgccgaaccctccggagacgccacgacggccggcccgtggggcttcggccctacggg

SEQ ID NO: 115708 - DNA, 532 bp, Homo sapiens
  misc_feature: GYAE6OF02ITGFV.37.34.D01.1.454.CMB.1.raw
  modified_base (375)..(375): a, c, t, g, unknown or other
  misc_feature (375)..(375): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctggggggaggcttgggtccagccgtgggggggtcccctggagactctcctgtgcagcctctggattcaactttggtagctattggatggactgggtccgcagtctccagggagggctggagtgggtggccaacatacgagggaggtggtggtaacgaaaaactntgtggactctgtgcggggccgattcacatctccagagacaacgacccaaaaactcaactgtactctgacaatgggacgcctgagatccgaggacacggctgtgtattatgtgcgagagatttagactaacaagtttcgagttgacgtggtatgatcg

SEQ ID NO: 115709 - DNA, 581 bp, Homo sapiens
  misc_feature: GYAE6OF02F49U1.37.34.D01.1.454.CMB.1.raw
  modified_base (502)..(502): a, c, t, g, unknown or other
  misc_feature (502)..(502): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgtggtttcgtgtaggcgtatttagaaggtgtccagtgtgacgtgcaactggtggagtctgggggaggcttggtccagcctggggggtccctgagactctcctgtgcagcctctggattcaacgtttggtagctagttggatggactgggtcccgccagtcctccgagggaaggggctggagtggggtggaccaacagtacgaggggaggtggtagggtaacgaaaaactgtaggtggactcgtgtcggcgggggcctagttccacctatcgtaccagacgaacaaaccgaccaaaaactcaactacgtatctgactaaagtcgggacgctagagtataccggaggacacggntggtagtagttattggtgacgagtaagtagtttacgaacttacgtaaagtttagtacgtggtaacttggtatagattcg

SEQ ID NO: 115710 - DNA, 297 bp, Homo sapiens; identical to SEQ ID NO: 115335
  misc_feature: GYAE6OF02FQ9IG.37.34.D01.1.454.CMB.1.raw
  modified_base (296)..(297): a, c, t, g, unknown or other
  misc_feature (296)..(297): n is a, c, g, or t

SEQ ID NO: 115711 - DNA, 784 bp, Homo sapiens
  misc_feature: GYAE6OF02HAVJY.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctggattcaactttggagctattggagtggtacgtcgggtcccgaccgtacgtccgtccggaagggggaacggggtcgtagggagggttggggtcggacccgaacgtaacgtaacgggaggggtagggttgggtaacgggtaaaaccggtaaaaacgttaggtagggtacgggtaacttcggttgggtcggggcccgggggtacccgtacgttacccgaaccctacgttcccgtaccgaaggaaccgaaaccgaaacccgtaaacccgtaaaaaacctcctaacgttacgttaactaccgtacgtaaaccgaaacggttccggggaccggtacctagggaacgtaccggtacccggaacgggaacccggtaccgggtacgttaggttacggtttaatttacggtttagggttagggttaggtaacgggttaaggtttaacggtttaaccgaaaccttaacggttaaacggttttacggacggttacggtacggtttagggtacgttacggtagttaccgg

SEQ ID NO: 115712 - DNA, 529 bp, Homo sapiens
  misc_feature: GYAE6OF02GZNDA.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgagggaaggggctgggagtgggtggccaacatacgaggggaggtggtagggtaacgaaaaactgtgtggactcgtgtggcggggccattcaccatctccagagacaacgaccaaaaactcactgtatctgacaaatggacgcctgagataccgaggacacggctgtgtattattgtgcgagagtattagactaataagttgagtgatggtatgatg

SEQ ID NO: 115713 - DNA, 533 bp, Homo sapiens
  misc_feature: GYAE6OF02IV516.37.34.D01.1.454.CMB.1.raw
  modified_base (371)..(371): a, c, t, g, unknown or other
  misc_feature (371)..(371): n is a, c, g, or t
  modified_base (472)..(472): a, c, t, g, unknown or other
  misc_feature (472)..(472): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggtttccttgttgctatttagaaggtgtccagtgtgacgtgcaactggtggagtctgggggaggcttgggtccagccgtggggggtccctgagactctcctgtgcagcctctggattcaactttggtagctattggatggactgggtccgccagtctccgagggaggggctggagtgggtggccaacatacgagggaggtggtggtaacgaaaactntggtgactctagtgcggggccgattcaccatctccagagacaacgaccaaaactcactgtatctgacaaagtggacggcctgagataccggaggacacggntagtgtattagttgtgcgagagtatttagactaacgaagtttcgagtgactaggtatgatg

SEQ ID NO: 115714 - DNA, 524 bp, Homo sapiens
  misc_feature: GYAE6OF02F5QJ0.37.34.D01.1.454.CMB.1.raw
  modified_base (371)..(371): a, c, t, g, unknown or other
  misc_feature (371)..(371): n is a, c, g, or t
  modified_base (499)..(499): a, c, t, g, unknown or other
  misc_feature (499)..(499): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctgggagtggggtggccaacatacaggggaggtggtggtacgaaaaactntgtggactctgtgcggggccattcaccatctccagagacaacgccaaaaactcaactgtatctgacaaagtggacgcctggagatccggagcgacggctgtgtattatgtgcgagagtattagactanaagtttcgagtgactggtatgatcg

SEQ ID NO: 115715 - DNA, 606 bp, Homo sapiens
  misc_feature: GYAE6OF02IMMD1.37.34.D01.1.454.CMB.1.raw
  modified_base (302)..(302): a, c, t, g, unknown or other
  misc_feature (302)..(302): n is a, c, g, or t
  modified_base (373)..(373): a, c, t, g, unknown or other
  misc_feature (373)..(373): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagctgggtttccttgtgctatttagaaggtgtccagtgtgacgtgcaacgtggtggagtcgtgggggagcttggtccagccgtgggggtccctgagactctcctgtgcagcctctggattcaacgttttggtagctattggatggacgtgggtccncagtcctccgagggaagggctggaggtgggtcggccaacagtacgagggaggtggtggtaacgaaaaactntagtggactcgtagtggcggggaccgagtttcaccgtatcctaccgagacgaaccaaaccgaccaaaaaacgtcaacgtagtactactagactaaagtacggacgtacctaggacgacgtaccggagtaaccgacggtcgtgttaggtatttaagtcgttaggacgaaggtagtaagtttaagaccgtaaactaaagttttcgaaggttcgaacgttgggtacttagtattag

SEQ ID NO: 115716 - DNA, 297 bp, Homo sapiens; identical to SEQ ID NO: 115335
  misc_feature: GYAE6OF02GULJB.37.34.D01.1.454.CMB.1.raw
  modified_base (296)..(297): a, c, t, g, unknown or other
  misc_feature (296)..(297): n is a, c, g, or t

SEQ ID NO: 115717 - DNA, 505 bp, Homo sapiens
  misc_feature: GYAE6OF02FFTL4.37.34.D01.1.454.CMB.1.raw
  modified_base (154)..(154): a, c, t, g, unknown or other
  misc_feature (154)..(154): n is a, c, g, or t
  modified_base (163)..(163): a, c, t, g, unknown or other
  misc_feature (163)..(163): n is a, c, g, or t
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (177)..(180): a, c, t, g, unknown or other
  misc_feature (177)..(180): n is a, c, g, or t
  modified_base (182)..(182): a, c, t, g, unknown or other
  misc_feature (182)..(182): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcgnggtttcgtntagcnttanagncnnnntncatgngntntgggngctgtcngctggggtccctgagactctcctgtgcagcctctggattcaactttggtagctattggatggactgggtccgcagtctccaggaagggctggagtgggtgccaantacgagggaggtggtggtacgaaaaactgtagtggactctgtgcggggccgattcgaccatctccagagacaacgaccaaaactcactgatctgacaatgacgcctgagacncgaggacacggctcgtntattagttgtagcgtagagtacgttagaacttacgtaagtttcggagttcgaacgttggtatgatacg

SEQ ID NO: 115718 - DNA, 299 bp, Homo sapiens
  misc_feature: GYAE6OF02G0NDD.37.34.D01.1.454.CMB.1.raw
  modified_base (289)..(289): a, c, t, g, unknown or other
  misc_feature (289)..(289): n is a, c, g, or t
  modified_base (295)..(299): a, c, t, g, unknown or other
  misc_feature (295)..(299): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcggctggcaaggcncatagnnnnn

SEQ ID NO: 115719 - DNA, 551 bp, Homo sapiens
  misc_feature: GYAE6OF02FS5A0.37.34.D01.1.454.CMB.1.raw
  modified_base (264)..(264): a, c, t, g, unknown or other
  misc_feature (264)..(264): n is a, c, g, or t
  modified_base (506)..(506): a, c, t, g, unknown or other
  misc_feature (506)..(506): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtacgaaaaactntggtggactctgtgcggggccgattcaccatctccagagacaacgccaaaaactcactgtatctgcaaatggacggcctgagatccgaggacacggctgtgtattattgtgcgagagtatttagactactaaagtttcgagtgactggtatgatgcttatgataccgtggggaccaagggaccagtcggtacaccgtctcttcacgccctccaccgaacgggcccagtccgtccttccccgnggccgtccctgcctccgaggcgccaccgtccgaggacgcacacgg

SEQ ID NO: 115720 - DNA, 312 bp, Homo sapiens
  misc_feature: GYAE6OF02ISRL2.37.34.D01.1.454.CMB.1.raw
  modified_base (300)..(312): a, c, t, g, unknown or other
  misc_feature (300)..(312): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaaggcccatcggtcttccccctggcgccctgctccaggagccacctccgagacgcacagccggccctgggctgcctgtcaaggactactccatctacactactgagcgggctggcaaggccgctaagtagnnnnnnnnnnnnn

SEQ ID NO: 115721 - DNA, 582 bp, Homo sapiens
  misc_feature: GYAE6OF02IOVQB.37.34.D01.1.454.CMB.1.raw
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
  modified_base (345)..(345): a, c, t, g, unknown or other
  misc_feature (345)..(345): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcggtcggtttcgtcgtaggcgtacttagtaaggtgtcagtgtgatgcaatggtggagtctgggggagcttggtccagccgtgggggtccctgagactctcctggtgcagtcctntggattctaactttggagtctgttggatggacttggggtcccgcagttctaccgaggggaagggctggngtcggagaccaanagtacgagggtgtggtagtaaacgaaactgtagtgactgtggtaggcgggactagtaccacactacgacgaagacgaacaaccgtaaaccaaactctacgtagtactacgacgacgacgtacgacgacgagagtacgtacggacgacgacgtcgtagtagtattagttgtacgtagagtagtagttaacgtacgtaacgttaagtagtacgttacgtagtaggtacgtacgtagtag

SEQ ID NO: 115722 - DNA, 488 bp, Homo sapiens
  misc_feature: GYAE6OF02FVKG5.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcaccatcacttgccgggccagtcgaactattagtacctggttggcctggtatcaacagaaaccagggaaagcccctaaggtcctgatctatgatgcctccactttggaagcgggtccatcaaggttcagcggcagtgtatctgggacagaattcactctcacatcagtagcctgcagcctgatgattttgactaacttattactgttcagctactataatgggagattcggcgagggaccagggtgagatcgaaacgactgtgctgcaccatctgtcttc

SEQ ID NO: 115723 - DNA, 510 bp, Homo sapiens
  misc_feature: GYAE6OF02HX0IX.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcaggcattagaaatgatttaggctggtatcagcagaaaccagggaaagccctaagctcctcatctatggtgcatccagttacaaactgggtcccaattaagattcagcggcagtggatctggcacagattcactctcaccatcagcagccctgccagcctagaagtattttgctaactttacttactgtactacaaagtattaacaacttaccctcgttacgttcggaccgaagggtaccaaggtacggaagtacgaaacgactggtacgctgactaacc

SEQ ID NO: 115724 - DNA, 552 bp, Homo sapiens
  misc_feature: GYAE6OF02J0XIW.37.34.D01.1.454.CMB.1.raw
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgcagtctccagggagggctggagtgggtggccaanatacgagggaggtggtggtacgaaaactntgtggactctgtgcggggccgattcacatctccagagacaacgaccaaaactcaactgtactctgacaaagtggacggcctaggacgagtaccggaggaccgacggcttagtgtaattagttgtgacgagagtatttaacgacttaacgtaaagtttcgagttacggacgtaggtactgtatagg

SEQ ID NO: 115725 - DNA, 612 bp, Homo sapiens
  misc_feature: GYAE6OF02H0VYR.37.34.D01.1.454.CMB.1.raw
  modified_base (344)..(344): a, c, t, g, unknown or other
  misc_feature (344)..(344): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttgggtccaggcccgtggggggtccctggagactctcctgtgcagcctctggattaatgtttagcaactctggcatgaactgggtccaccaggctccgaggcagtggggctgcagtgggtctnaagtactagtgctcgtaggtaatagagcagactacgcagacctccggtaggaacgggtccggttcaccatcctaccagacgaactaacttaccaaagaaccacacttactatctagacaaatacgaaactacgacccgtagaacgtaaacgtaggaacgggaacccgaccgggtacttacggtacgttaactaccgtaaccgttacggtacggacccgggtaaacccgggtaagggggggttttacgggaaggttacggtaggaccgg

SEQ ID NO: 115726 - DNA, 297 bp, Homo sapiens
  misc_feature: GYAE6OF02HU8RY.37.34.D01.1.454.CMB.1.raw
  modified_base (292)..(297): a, c, t, g, unknown or other
  misc_feature (292)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggctacttcatctacactactgagcggctggcaaggcgcatagnnnnnn

SEQ ID NO: 115727 - DNA, 698 bp, Homo sapiens
  misc_feature: GYAE6OF02IEJ23.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctttctgcatctgtaggagacagagtcatcatcacttgccgggcaagtcgaggcattagaatgtatttaggcgttggtatcagacaaggaaaaccgaagggaaacgaccccgtaagccgtacctcactacttagtagggtcgactactaccgtaagtttaaacgaaaccgttcggggttaaccctaagttaaacgtacgtttacgacggtacggacgtaaggtacgggtaacttcggtagggacctaacgtaagtaactttcaaccttaccttaccaacccactacgaacgcctaacggtcccttaggacctaacggtacccgttaaggtaaactttacgttttacgaaccttaaacttttaacttaacttacgtacgttaaactaagttaactttaaacctaaacgtttacccttacggttaccgttaccggtaccgtaacgggtaaccctaagggtacggtaaacgtaaccgtaaacggtacgttacggtacggacgtacgtacaacgttaccg

SEQ ID NO: 115728 - DNA, 521 bp, Homo sapiens
  misc_feature: GYAE6OF02IJYC1.37.34.D01.1.454.CMB.1.raw
  modified_base (175)..(175): a, c, t, g, unknown or other
  misc_feature (175)..(175): n is a, c, g, or t
  modified_base (188)..(188): a, c, t, g, unknown or other
  misc_feature (188)..(188): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgtggttcgtgtagctattagaggtncagtgtgacgtgnactgtggagtctggggagcttggtccagcctggggggtccctgagctctcctgtgcagcctctggattcaactttggtagctattggatggactgggtccgccaggtctccgagggaggggctgggagtgggtggccaacagtacgagggaggtggtggtaacgaaaaactgtgtggactctgtgcgggccgattccacatctccagagacaacgaccaaaaactcactgtatctagtacaaagtggacgcctagacgtagtaccggagacgacggtctagtgtattagtgtgcagagtattagactagaagttcggatgtactggtatgatg

SEQ ID NO: 115729 - DNA, 521 bp, Homo sapiens
  misc_feature: GYAE6OF02IQH7M.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtcgccagtctccagggaaggggctggagtgggtggccaacatacagggaggtggtggtacgaaaaactatgtggactctgtgcgggggccgagtttcaccaatctccagagacaaacgccaaaaaaactcaactcgtatctgcaaatggacggctgagatcgagacacgctgtgtattatgtgcagagaattagatacaaagtttcgagtgactggtatgatg

SEQ ID NO: 115730 - DNA, 514 bp, Homo sapiens
  misc_feature: GYAE6OF02F7WLP.37.34.D01.1.454.CMB.1.raw
  modified_base (388)..(388): a, c, t, g, unknown or other
  misc_feature (388)..(388): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgttctggattttccttgttgctgttttagaaggagtccactgtgaggtacagctggtggaatcgtgggggaggcttgggtacagcctggagggtccctgagactctcctgtgcatcgtctggattcaccttccgagcttttgacatgagctgggtccgccgggctccgaggggaagggtctgggagtggggtctcatccatcagttacaatggtacaaaccatatactacgcagtattttgngaagggccgcttcaccatctcagagacaacgccaagagctctctgtttctgcatatggacagcctagagacgccgacgacgcgctctatattactgtgcgagagtgggacggcggtggcgtggtcg

SEQ ID NO: 115731 - DNA, 534 bp, Homo sapiens
  misc_feature: GYAE6OF02GZ5XR.37.34.D01.1.454.CMB.1.raw
  modified_base (352)..(352): a, c, t, g, unknown or other
  misc_feature (352)..(352): n is a, c, g, or t
  modified_base (453)..(453): a, c, t, g, unknown or other
  misc_feature (453)..(453): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttgggtccagccgtggggggtccctgagactctcctgtgcagcctctggattcaactttggtagctattggatggactgggtccgcagtctccgagggagggctggagtgggtgccaacatacgagggnggtggtaggtaacgaaaactgtgtaggactgtgtgcgggcattcgacatctcagagacaacgacaaaactcactgtatctagacaaagtggacgcctaagngactccggagacgacggctgtgtattagttgtagcgtagagtattagactaagtaagttcgagtcgactaggtatgatacg

SEQ ID NO: 115732 - DNA, 312 bp, Homo sapiens
  misc_feature: GYAE6OF02F9XSD.37.34.D01.1.454.CMB.1.raw
  modified_base (302)..(302): a, c, t, g, unknown or other
  misc_feature (302)..(302): n is a, c, g, or t
  modified_base (308)..(312): a, c, t, g, unknown or other
  misc_feature (308)..(312): n is a, c, g, or t
tcagtagtgtagatcacgaccggtgctcgatttagatcgtctgtggttggggttgggggaagaggaagactgacggtcctgccacaggtggtgctgaggaagagatggaggtggacgtgtcagcacccagcgtggggcctgtccctggtcaccgtctcctcagcctccaccgaacgggcccatcggtccttccccctggccgccctgcctccgaggagccacctccgagagcacagccggccctgggctcgcctggtcaaggacctacttccatctacactactgagcgggctggcaaggcncatagnnnnn

SEQ ID NO: 115733 - DNA, 522 bp, Homo sapiens
  misc_feature: GYAE6OF02F8TAT.37.34.D01.1.454.CMB.1.raw
  modified_base (392)..(392): a, c, t, g, unknown or other
  misc_feature (392)..(392): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagcctcctcatctatggtgcatccagtttacaaacgtgggtacccattaagattcagcggcagtggatcgtggcacagtatttcactctcaccatcagcagcctgcngcctgaagtattttgactaacttattactgtactacaagtacttaactaacttacctacgttacgttaccggaccgtaagggacctaagggtagtaacgtacaaacgtacgtggtaggctagactaaccg

SEQ ID NO: 115734 - DNA, 533 bp, Homo sapiens
  misc_feature: GYAE6OF02HO4XU.37.34.D01.1.454.CMB.1.raw
  modified_base (375)..(375): a, c, t, g, unknown or other
  misc_feature (375)..(375): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcgtgggtttcctgttgctatttagaaggtgtccagtgtgacgtgcaactggtggagtctgggggaggcttggtccagcctgggggggtccctgagactctcctgtgcagcctctggattcaactttggtagctattggatggactgggtccgccagtcctccgagggaaggggctgggagtgggtggccaacatacgaggggaggtggtggtaacgaaaaactntggtggactctggtgcggggccgattcaccatctccagagacaacgaccaaaactcactgtatctgacaaatcggacgcctagagactcgaggacacggctgtgtattattgtgcgagagtatttagactactaaagttcgagtgactggtatgatcg

SEQ ID NO: 115735 - DNA, 531 bp, Homo sapiens
  misc_feature: GYAE6OF02GSCLO.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagcctggggggtccctgagactctcctgtgcagcctctggattcaactttggtagctattggatggactgggtccgccagtctccagggaagggctggagtgggtggccaacgatacaggggaggtggtggtaacgaaaaactatggtggactctgtggcggggccgattcaccatctccagagacaacgaccaaaaactcactgtatctgacaaatggacgctggagactaccgaggacgacggctacgtgtattagtgtgcgagagtattagactaataagttcgagtgactggtatgatg

SEQ ID NO: 115736 - DNA, 574 bp, Homo sapiens
  misc_feature: GYAE6OF02H77IL.37.34.D01.1.454.CMB.1.raw
  modified_base (381)..(381): a, c, t, g, unknown or other
  misc_feature (381)..(381): n is a, c, g, or t
  modified_base (500)..(500): a, c, t, g, unknown or other
  misc_feature (500)..(500): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcacgcctctggattcaacttttggtagctattggatggactgggtccgccagtctccgagggagggctggagtgggtggccaacatacgagggaggtggtggtaacgaaaaactgtgtggactntgtggcgggcgattcaccatctcagacgacaacgaccaaaactcactgtactctagacaaagtcgggacgtcctaggagactaccggaggaccacgggcttaggtagttacttagttgngacggtagtaggtactttacggaacttaacgtaaacgtttacggagttacggacgttgggtaatcgtaattcgg

SEQ ID NO: 115737 - DNA, 747 bp, Homo sapiens
  misc_feature: GYAE6OF02GGEWG.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtcctccatccctcctgtctgcatctggtaggagacagagtcatcatccacgttcggccgggacaaggtcgagggactaattaagaaatgtagtttaggcgttaggtatcagacaacgaaaccgaagggaaaccgaccctaagcctcctactatactagtggtacgctactaccgtaacgtttaaaccgaaacggttccggggtaccctaagtttaaacgtattacgacggcggactaaggtggtactcggtacgggacctaacgtacgtacttttaccaccttacctaccctaaccctaacttaccgaacggacctaaccggtcccgttacggacccgtacggtacccgtaacggtaaacggtttacgttttttacggaaccttttaaacctttaactttaccgtttacgttaaccttaacgtaaacgtttaactttaaacccttaaaccgttttaccccttaaccgggtttacccgtttaaccgggaacccggtaaacgggtaaccggtaaggggttaacgggaaacgttaaccggaaacgttacgtacggttacgggacttaccgacctaacccg

SEQ ID NO: 115738 - DNA, 543 bp, Homo sapiens
  misc_feature: GYAE6OF02G61ID.37.34.D01.1.454.CMB.1.raw
  modified_base (374)..(374): a, c, t, g, unknown or other
  misc_feature (374)..(374): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctggattcaactttggtagctattggatggactgggtccgccagtctccgagggaggggctggagtgggtggccaacatacgagggaggtggtagggtaacgaaaaactntggtggactcgtgtggcgggggccgattccacctatcctccagagaacaacgaccaaaaactcactgtactctgacaatggaacggcctgagactccgacggacgacggctgtgtattattgtgcgagagtattagactactaagtttcgagttgacttggtatgatcg

SEQ ID NO: 115739 - DNA, 532 bp, Homo sapiens
  misc_feature: GYAE6OF02GGVE8.37.34.D01.1.454.CMB.1.raw
  modified_base (429)..(429): a, c, t, g, unknown or other
  misc_feature (429)..(429): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccggcaagtcaggcattagaaatgatttaggctggtatcagcagaaaccagggaaacgcccctaagcctcctcatctatggtgcatccagtttacaaacgtcgggtacccaattaagattcagcggcagtggatcgtggcaacagtactttcactctcaccatcagcacgcctgcagcctagaagtattttgactaactttattacgtntactaacaagtacttaacaacttaccctagttacgttcggaccgtaacgggaacctaagggtaggaagtaccgaaacgtacgtagtacggctacgactaaccg

SEQ ID NO: 115740 - DNA, 561 bp, Homo sapiens
  misc_feature: GYAE6OF02GNUNW.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccagccgtggggggtccctgagactctcctgtgcagcctcgtggattcaactttggtagctattggatggactgggtccgccagtctccgagggaggggctgggagtgggtgccaacatacgaggggaggtggtaggtaacgaaaaactgtggtaggactcgtggtgcgggggcctagttccaccatctaccagagacaacgaccaaaaacctcactagtatctagacaagtcggacgcctagagacgtaccggaggacgacggcttagtgtattattgtgcgagagtatttagaactaacgtaagtttcgagtacgtacgttggtatgattacg

SEQ ID NO: 115741 - DNA, 527 bp, Homo sapiens
  misc_feature: GYAE6OF02HXT2Z.37.34.D01.1.454.CMB.1.raw
  modified_base (455)..(455): a, c, t, g, unknown or other
  misc_feature (455)..(455): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccaggggagggctgggagtgggtggccaacatacgagggaggtggtggtaacgaaaaactatgtggactcgtgtggcggggccgattcacatctccagagacaacgaccaaaactcactgtatctagacaagtggacgcctgaganccggaggacacggctgtgtattagttgtgcgagagtatttagactactaagtttcgagtgactggtatgatg

SEQ ID NO: 115742 - DNA, 532 bp, Homo sapiens
  misc_feature: GYAE6OF02F0SZK.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaagggctggagtgggtggccaacgatacgaggggaggtggtaggtaacgaaaaactagtgtggactctgtgcggggccattcacatcctcagagacaacgaccaaaaactcactgtatctgacaaagtggacgctaggagagtccggaggacacggcttgtgtattagttgtgcgagagtattagactaacgtaagttcgagtggactggtatgatg

SEQ ID NO: 115743 - DNA, 300 bp, Homo sapiens
  misc_feature: GYAE6OF02IW0BU.37.34.D01.1.454.CMB.1.raw
  modified_base (296)..(300): a, c, t, g, unknown or other
  misc_feature (296)..(300): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcagtagnnnnn

SEQ ID NO: 115744 - DNA, 552 bp, Homo sapiens
  misc_feature: GYAE6OF02HYCU7.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctggggggaggcttggtccaggccgtggggggtccctgagactctcctgtgcagcctctggattcaacttttggtagctattggatggactgggtccgccagtctccgaggggagggctgggagtgggtggccaacgatacgagggaggtggtaggtaacgaaaaactgtaggtaggactcgtggtggccggggccgtattccacctatcctccagacgacaacgaccaaaaactcactgtatctagacaaagtggacgctagagactccggagacgacggctgtgtattagttgtgcgagagtatttagactaacgtaagtttcgagtagtactggtatgatg

SEQ ID NO: 115745 - DNA, 641 bp, Homo sapiens
  misc_feature: GYAE6OF02IRS48.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctatttggaggtgtccagtgtgaggtgcaattggtggagtcgtgggggaggcctcgtccagccgtggggggtccctggagactctcctgtgtagcctctgaattcccctttacggcttattggatgagctgggtccgccaggctccgagggaagggctggaggtgggtggccaaacgataaagcaagagtaggaaagtaagaaggagtatggtaggactcgtgtagaaggggtcccgtttacacctatctaccgagaacgaacaaccgccaaagaactccggtagacatcctgacaaatcgaaactgtctaggaagtacggccgtaagggaactaccgggtactttaagttttaacttacgtagccgacggtaaggaaggtaaacgggtaccgttggggggtaccgtttttaccgaaccgttaacgggtcgggggaccctaacgggggtaacccccttgggtaccctaccccggg

SEQ ID NO: 115746 - DNA, 526 bp, Homo sapiens
  misc_feature: GYAE6OF02H041G.37.34.D01.1.454.CMB.1.raw
  modified_base (369)..(369): a, c, t, g, unknown or other
  misc_feature (369)..(369): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggagctattggatggactgggtccgccagtctccgagggaagggctggagtgggtggccaacatacgagggaggtggtggtaacgaaaaactntgtggactctgtgcggggccgattcaccatctcagagacaacgaccaaaaactcactgtatctgacaaatggacggcctgagatccgaggacacggctgtgtattattgtgcgagagaatttagactaactaagtttcgagtgacgtggtatgatcg

SEQ ID NO: 115747 - DNA, 563 bp, Homo sapiens
  misc_feature: GYAE6OF02GI2SZ.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtaacgaaaaactatgtggactctgtgcggggcgattcaccatctccagagacaacgaccaaaaactcactgtatctgacaaatggacggcctgagatccgaggacacggctgtgtattattgtgcgagagtatttagactaactaaagtttcgagtgactggtatgatgacttagtgataccgtgggaccgaacgggaccagtcgtacaccgttctcttcgagcctccaccgacggcccagtccgtccttccccgtcggccgtcccgtgccctaccgaggacgcccgaccgtccgagacgaccacgccggg

SEQ ID NO: 115748 - DNA, 543 bp, Homo sapiens
  misc_feature: GYAE6OF02HDE6H.37.34.D01.1.454.CMB.1.raw
  modified_base (433)..(433): a, c, t, g, unknown or other
  misc_feature (433)..(433): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtggggggtccctgagactctcctgtgcagcctctggattcaactttggtagctattggatggactgggtccgccagtctccgagggaagggctgggagtgggtggccaacatacgaggggaggtggtaggtaacgaaaaacgtagtggtaggactcgtgtggcggggccattcaccatctcagagacaacgaccaaaacncactgtatctgacaaagtcggacgtcctaggacgagtccgaggacacggctgtcgtattagttgngngagagtattagactaactaagtttgagtgactaggtatgatcg

SEQ ID NO: 115749 - DNA, 749 bp, Homo sapiens
  misc_feature: GYAE6OF02JDD1M.37.34.D01.1.454.CMB.1.raw
  modified_base (215)..(215): a, c, t, g, unknown or other
  misc_feature (215)..(215): n is a, c, g, or t
  modified_base (334)..(334): a, c, t, g, unknown or other
  misc_feature (334)..(334): n is a, c, g, or t
tcagtagtgtagatcacgaccggtgctcgatttagatcgtctgtgttgggtttggggtcgtcagagaggagccttagccctggactccaaggccttccacttggtgatcagcactgagcacagaggactcacccatggaattggggctggagcgtgggttttccttgttgtctattttagaaggttgtccgagtgtgacgttgctaactgggtgnggtctgggggaggcgttgggtccaggtcccgtggggggtcccctgggacgtatccgtcctggtgcgagcctcgtggacttcaacgtttggtagtctagttggattggacttggggtccncgagtctccgaggggagggctgggacggttgggacggccgaacagtaccgaggggtacggtggtagggtaaacgaaaaacgtagtaggtagggacttacgtggtagggccgggggaccgtagttccgaacccgtagtaccttaccgaggtaacgacgaaaccgaccctaaaaacgtccaacgtggtaactcgtacggtaacctaaaagtcggaaccggtacccgtaggtaaacggtcgttaacccgggaaggaacccgtaacgggtaccgtttaggtaggtttaacgttaacgtttgggttacggaccggttaggtaacggttaaggttttaacggaaccgtttaaaccgttaaaggggtttttaccgaaggttttacggaacgttttcggggttaattacggtaagtttacggg

SEQ ID NO: 115750 - DNA, 555 bp, Homo sapiens
  misc_feature: GYAE6OF02GIWU6.37.34.D01.1.454.CMB.1.raw
  modified_base (434)..(434): a, c, t, g, unknown or other
  misc_feature (434)..(434): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcccctttacggcttattggatgagctgggtccgccaggctccgaggggaaggggctgggagtggggtggccaacataaagcaagataggaagtaagaaggagtatggtggactctgtgaagggtccgtttcaccatctccagagacaacgccaagactccgngcatctgacaaatgaacagtctgagacgaccgaggacacggcttatttatactgcgcgagaggaaggctggggtcggtttcgacgttacggtcgggggaccacggggtaccctggtacccg

SEQ ID NO: 115751 - DNA, 523 bp, Homo sapiens
  misc_feature: GYAE6OF02F5RNI.37.34.D01.1.454.CMB.1.raw
  modified_base (368)..(368): a, c, t, g, unknown or other
  misc_feature (368)..(368): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatgtactgggtccgccagtctccaggaaggggctggagtgggtggccaacatacagggagtggtggtacgaaaaactntgtggactctgtgcggggccgattcaccatctccagagacaacgccaaaaactcaactgtatctgcaaatggacggcctgagatccgaggacacggctgtgtattattgtgcgagagtatttagactaacaaagtttcgagtgactggtatgatg

SEQ ID NO: 115752 - DNA, 537 bp, Homo sapiens
  misc_feature: GYAE6OF02IMZ4F.37.34.D01.1.454.CMB.1.raw
  modified_base (358)..(358): a, c, t, g, unknown or other
  misc_feature (358)..(358): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcaggcattagaaatgatttaggctggtatcagcagaaaccagggaaagcccctaagctcctcatctatggtgcatccagtttacaaacgtgggtccctattaagtattcagcggcagtgatcgtgacncagatttcactctacacatcagcagcctgcagcctagtaatattttgactaaactttattactgtactaacgaagtattaaccaatttaccctacgttaccgttaccggaccgaacgggtaaccgaagggttaggaacgtaaccaaacggaacttcggtacggtcgttcgagtaacccg

SEQ ID NO: 115753 - DNA, 302 bp, Homo sapiens
  misc_feature: GYAE6OF02I9ORJ.37.34.D01.1.454.CMB.1.raw
  modified_base (290)..(290): a, c, t, g, unknown or other
  misc_feature (290)..(290): n is a, c, g, or t
  modified_base (296)..(302): a, c, t, g, unknown or other
  misc_feature (296)..(302): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcncatagnnnnnnn

SEQ ID NO: 115754 - DNA, 504 bp, Homo sapiens
  misc_feature: GYAE6OF02FKKKS.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgttgctctggctcccaggtgccagatgtgccatccaaatgacccagtctccatcctccctgtctgcatctgtaggagacagagtcatcatcacttgccgggcaagtcggactattagtacctggttggcctggtatcaacagaaaccagggaaagcccctaaggtcctgatctatgatgcctccactttggaaagcggggtccatcaaggttcagcggcagtgtatctgggacagaattcactctcaccatcagtagcctgcagcctgatgattttgactaacttattactgtcagcaactataagtgggatattcggccggagggacctagggttgaagtagtacaaacgaacttgtggctgcacctatctagtcttac

SEQ ID NO: 115755 - DNA, 296 bp, Homo sapiens; identical to SEQ ID NO: 115667
  misc_feature: GYAE6OF02IMH90.37.34.D01.1.454.CMB.1.raw
  modified_base (295)..(296): a, c, t, g, unknown or other
  misc_feature (295)..(296): n is a, c, g, or t

SEQ ID NO: 115756 - DNA, 543 bp, Homo sapiens
  misc_feature: GYAE6OF02GI8IK.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctggggggaggcttggtccagcctggggggtccctgagactctcctgtgcagcctctggattcaactttggtagctattggatggactgggtccgccagtctccgagggagggctgggagtgggtggccaacatacgaggggaggtggtagggtaacgaaaaacgtatggtggactcgtgtggcggggccgattccaccatctccagagacaacgaccaaaacctcactctatctgacaaatcgggacggcctagagatccgaggacacggctgtgtattagttgtgcgagagtatttaagactaactaagtttcgagttgacgtggtatgatcg

SEQ ID NO: 115757 - DNA, 313 bp, Homo sapiens
  misc_feature: GYAE6OF02IMJQI.37.34.D01.1.454.CMB.1.raw
  modified_base (298)..(298): a, c, t, g, unknown or other
  misc_feature (298)..(298): n is a, c, g, or t
  modified_base (304)..(313): a, c, t, g, unknown or other
  misc_feature (304)..(313): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggccccatcggtccttccccctggccgccctgcctccaggacgcacctccgagacgcacagccggccctgggctgcctggtcaaggctacttccatcctacactactgacgcgggctggcaaggcncatagnnnnnnnnnn

SEQ ID NO: 115758 - DNA, 559 bp, Homo sapiens
  misc_feature: GYAE6OF02FR1D6.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaatggacggctgagatccgaggacacggctgtgtattattgtgcgagagatttagactacaaagtttcgagtgactggtatgatgcttatgatacgtggggaccaagggaccagtggtccaccggtctcttcagccctaccaccaacgggcccagtccggtccttcccccgtggcccgtcccctcggcctcccgaggcgaccacccgtccggacgacgccacgtaccgg

SEQ ID NO: 115759 - DNA, 540 bp, Homo sapiens
  misc_feature: GYAE6OF02H8PX9.37.34.D01.1.454.CMB.1.raw
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (486)..(486): a, c, t, g, unknown or other
  misc_feature (486)..(486): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctggattcaacttttggtagctattggatggactgggtccncagtctccgagggagggctggagtgggtcgccaanatacgagggaggtggtaggtaacgaaaaactntggtagactcgtgtgcggggccattcaccatctcagacgacaacgacaaaactcactgtatctgacaaagtggacgcctagagatccggagaccacggctagtgtattagtgtnacgagtagtatttagactaacgtaaagtttcgagtcgacgttaggtatgattcg

SEQ ID NO: 115760 - DNA, 571 bp, Homo sapiens
  misc_feature: GYAE6OF02IJYO9.37.34.D01.1.454.CMB.1.raw
  modified_base (468)..(468): a, c, t, g, unknown or other
  misc_feature (468)..(468): n is a, c, g, or t
  modified_base (540)..(540): a, c, t, g, unknown or other
  misc_feature (540)..(540): n is a, c, g, or t
tcagtagtgtagatcacgaccggtgctcgatttagatcgtctgtgttgggttttccttgttgctatttagaaggtgtccagtgtgacgtgcaactggtggagtctgggggaggcttggtccagcctggggggtccctgagactctcctgtgcagcctctggattcaactttggtagctattggatggactgggtccgccagtctccagggagggctggagtgggtggcaacatacagggaggtggtggtacgaaaaactatgtggactctgtgcggggccgattcaccatctccagagacaacgaccaaaaaactcaactgtatctgacaaagtggacggcctgagatccgagacacggctgtgtattattgtgcgagagtatttagacttaacaaagtttcgagtgactggtatgatgcttatgataccgtgggaccaagggacagtcggtctacgtctcttcgacncctaccaccgaacgggccctaagtccggtacccttccccgtcggccgtccctcgtcccgtccgacgggaccnccgaaccctccggaacgtacggcacgacggg

SEQ ID NO: 115761 - DNA, 627 bp, Homo sapiens
  misc_feature: GYAE6OF02JLPF0.37.34.D01.1.454.CMB.1.raw
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
tcagtagtgtagatcacgaccggtgctcgatttagatcgtctgtgttgggtttgggggtcgaggagtcagaccactcaggacacagcatggacatgagggtccccgctcagctcctgggctcctgctgctctggctccaggtgccagatgtgccatccaatgacccagtctccatcctccctgtctgcatctgtaggnacagagtcatcatcgattgccgggacaagtcaggcattanaatgattagctggtatcagcagtaaaccagggaacgaccctaagaccgtctacgatccgttaatggtacgctataccctagtttaacaaacgttcgggttaccctaacgtttaaacggtactttacgaagtccgggactaacggttacgggaacttaccgttagggacctacgaaggttactttacctacgttaccctactaccacttaccacgtactacgaccgttgaccacgtcccgtagaacgtattttcgactaactttacttacttacgtactaactaagtaactttactaaacttcccgttacgtccgttttacggacctaaccgggtacgaaggtacggaacgttacgaaacggtacgtacgttacggacttaggccgtacc

SEQ ID NO: 115762 - DNA, 546 bp, Homo sapiens
  misc_feature: GYAE6OF02G3GV7.37.34.D01.1.454.CMB.1.raw
  modified_base (264)..(264): a, c, t, g, unknown or other
  misc_feature (264)..(264): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtacgaaaaactntgtggactctgtgcggggccgattcaccatctccagagacaacgccaaaaactcactgtatctgcaaatggacggcctgagatccgaggacacggctgtgtattattgtgcgagagatttagactacaaagtttcgagtgactggtatgatgcttatgataccgtggggccaagggaccagtggtcaccgtctcttcagcctccaccgaacgggcccagtccggtccttccccgtggccgcccctgcctcccgaggacgccaccgtccgagacgcacgacgg

SEQ ID NO: 115763 - DNA, 623 bp, Homo sapiens
  misc_feature: GYAE6OF02J19XX.37.34.D01.1.454.CMB.1.raw
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttgggtccagccgtgggggggtccctggagactctcctgtgcagcctctggattcaactttggtagctattggatggactgggtccgcagtctccagggaagggctgggagtgggtggccaacatacgagggaggtggtgggtaacgaaaaactagtaggtggaacgtctggtggcgggggccgattccaccatcctccagganacaacgaccaaaaactccaactagtanctgacaaagtcggacggtcctggacgaagtccgaacgggtaccaacgggccgttacggttagttaacgtttagtttaggtcgacggaggtaaggtaacgttttaagaaccgttaaacgttaaagttttacggaaggttcggtaccgttagggttaacttgggatttaacgg

SEQ ID NO: 115764 - DNA, 663 bp, Homo sapiens
  misc_feature: GYAE6OF02GCP1I.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctggttttccttgttgctatttagaaggtgtccagtgtgacgtgcaactggtggagtcgtgggggaggcttggtccagccgtcggggggtccctgagactctcctgtgcagcctcgtggattccaacgttttggtagcttattggatggacgtgggtcccgcagtctccgagggacgggcgtgggaggtgggtcgaccaacgagtaacgaggggaggtggtaggtaaacgaaaaacgtgtaggtaggactcgtggtcggccggggaccgtattccgaacctatcctaccgaaggacgaaccaaccgaaaccctaaaaactccgtaacgtagtaactccgtacgaacgtaaacgtcgggtaaccggaccgtaggaacgtaccgtaccgggaaggaaccgacggtcgttgttagttactttagttggtacgtacggaagtaggttaactttaacggaaccttaaccgttaaaggttttcggaggttacgtaacgttaggtaacgttagtagttacg

SEQ ID NO: 115765 - DNA, 548 bp, Homo sapiens
  misc_feature: GYAE6OF02IVZKT.37.34.D01.1.454.CMB.1.raw
  modified_base (342)..(342): a, c, t, g, unknown or other
  misc_feature (342)..(342): n is a, c, g, or t
  modified_base (478)..(478): a, c, t, g, unknown or other
  misc_feature (478)..(478): n is a, c, g, or t
  modified_base (545)..(545): a, c, t, g, unknown or other
  misc_feature (545)..(545): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtgggggtccctgagactctcctgtgcagcctctggattcaacttttggtagctattggatggactgggtccgccagtctccgaggggaggggctgggagtgggtggccaanatacgagggaggtggtaggtaacgaaaaactagttagtggactcgtgtggcggggccgattccgaccatcctccagacgacaacgaccaaaactcaactgtatctgacaaagtggacgcctgagataccggagacncgctagtgtattagttgtgacgtagagtattaagacttaagtaagtttcgagttggactgggtatgntcg

SEQ ID NO: 115766 - DNA, 546 bp, Homo sapiens
  misc_feature: GYAE6OF02IZ18B.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtctgggggaggcttggtccagccgtggggggtccctgagactctcctgtgcagcctctggattcaactttggagctattggatggactgggtccgccagtctccaggggaagggctggagtgggtggccaacagtacgaggggaggtggtaggtaacgaaaaactgtaggtggactcgtgtgcggggccattcaacatctccagagacaacgccaaaaactcactgatctgacaaatggacgcctagagacgtaccgaggacacggctcgtgtaattagttcgtgccgaaggtagtaatttagaactaactaaagtttcgagttgacttggatgatcg

SEQ ID NO: 115767 - DNA, 597 bp, Homo sapiens
  misc_feature: GYAE6OF02JXCHX.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggagctattggatggactgggtccgccagtctccagggagggctggagtgggtgccaagagtacgaggggaggtggtaggtaacgaaaacgtagtggtggactcgtaggtggcggggccgattccaccatcgtccaggacacaacgaccaaaactcactagtactctgacaaagtcgggaaccgcctaggaacgtacgtaccgagggaccaaccgggtctacgttagttaatttacgttagggagtcgaaggttaggtaacgtttaacgaacttaacgtaagtttacggagttacggacttggtagttaggtattacg

SEQ ID NO: 115768 - DNA, 297 bp, Homo sapiens; identical to SEQ ID NO: 115364
  misc_feature: GYAE6OF02F4A7F.37.34.D01.1.454.CMB.1.raw
  modified_base (295)..(297): a, c, t, g, unknown or other
  misc_feature (295)..(297): n is a, c, g, or t

SEQ ID NO: 115769 - DNA, 609 bp, Homo sapiens
  misc_feature: GYAE6OF02IP99B.37.34.D01.1.454.CMB.1.raw
  modified_base (259)..(259): a, c, t, g, unknown or other
  misc_feature (259)..(259): n is a, c, g, or t
  modified_base (353)..(353): a, c, t, g, unknown or other
  misc_feature (353)..(353): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtcgtgggggaggcttggtccagccgtggggggtccctgagactctcctgtgcngcctctggattctaactttggtagtctagttggatggacgtggggtcccgccagtctccgagggggaaggggcgtgggaggtgggtcggccaanagtacgagggaggtggtggaacgaaaaactgtgtaggactcgtgtcggcggggcgtatccacctntcnccagagacaacgaccaaaactcactgtatctagactaaagtcggaccgcctaggagacgtacccggaggaaccgaccggtcttaggttgttatttaaggtttgtacgggtcgtaaggtacgtaatttaacgtaacgttaaacgttaaaggtttcgaggttacgtaccggttaggttattgtattacgg

SEQ ID NO: 115770 - DNA, 522 bp, Homo sapiens
  misc_feature: GYAE6OF02ICU1Y.37.34.D01.1.454.CMB.1.raw
  modified_base (336)..(336): a, c, t, g, unknown or other
  misc_feature (336)..(336): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaacttttggagctattggatggactgggtccgcagtctccagggagggctggagtgggtgccaanatacgagggaggtggtaggtaacgaaaaactntgtggactntgngcggggccattcacatctcagagacaacgaccaaaaactcaactgtatctgacaaatggacgcctagagactaccgaggacacggctgtgtattatgtgcgagagattagactaacaagtttcgagtgacgtggtatgatcg

SEQ ID NO: 115771 - DNA, 994 bp, Homo sapiens
  misc_feature: GYAE6OF02F0RN5.37.34.D01.1.454.CMB.1.raw
tcagtagtgtagatcacgaccggtgctcgattagatcgtctgtgttgggtttggggctcagagaggagccttagccctggactccaaggcctttccactggtgatcagcactgagcacagaggactcaccatggaattgggctgagctgggtttcctgtgctatttagagtgtccagtgtgacgtgcaacgtgtggagtcgtgggtacgcttggtccagccgtgggggttcccctgacgaccttctccctggttcgccaggcccctctgggatttccaaccgttggttaacgccttatttgggaatcggggtaaccttcggggttcccgccgtagttacctccgaggggtaaacgggtccttggggtaagttcgggttaggggaccccaaaccgacgtaaccgacggggggtaacgggttcggggttacgggttaacccggaaaaaccttacggttacgggttacgggtaaacccgttccgttcgggttaacggggtccccggggggggtaccccgtaacgttttacccaaccccgtacgtttaccccgttaccccgaaacggttaaaccggaaaccccgtaaaacccccggggaccccctaaaaaaacccccgttcccggaaaccccgttttaccgggttaaaccgttacccggtttaacggtaaccccgttaaaaacggttacccgggggtaaaccccggggtaccccggtttaaccgggaaaccgggttaaaccggttaccccgggtaaacggggtaaacccgtaacccgggggttaccttttaacggggttacgttttaaaaccgttttaagtttaccgggttacgggtacccgggtaaacgggttaaccgggttaaaacggtttttaaccgggaaaaccccgttttaaacccggtaaaacccggggttttaccgggttaaacgggttaccgggttaaacccggtttacggggtttaaccggttacgggttaaccggttttaacccgggg

SEQ ID NO: 115772 - DNA, 564 bp, Homo sapiens
  misc_feature: GYAE6OF02F7KXM.37.34.D01.1.454.CMB.1.raw
  modified_base (370)..(370): a, c, t, g, unknown or other
  misc_feature (370)..(370): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctgggagtgggtggccaacatacgagggaggtggtggtacgaaaaactntgtggactctgtgcggggccattcacatctccagagacaacgccaaaactcactgtatctgacaaagtcggacgcctggagactaccggaggaccacgggcttggtgtaatttagttggtgacgaggtagtaatttacgaacttaactaaacgttttcggaagttcggtaaccttagggtacttggagttacgg

SEQ ID NO: 115773 - DNA, 558 bp, Homo sapiens
  misc_feature: GYAE6OF02F89Z1.37.34.D01.1.454.CMB.1.raw
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
tcagtagtgtagatcacgaccggtgctcgatttagatcgtctgtgttgggttttccttgttgctattttagaaggtgtccagtgtgacgtgcaactggtggagtcgtgggggaggcttggtccagccgtgggggtccctgagactctcctgtgcagcctctggattcaactttggtagctattggatggactgggtccgccagtctccagggaaggggctggagtgggtggccaacatacgagggaggtggtggtaacgaaaaactatgtggactctgtgcggggcgattcaccatctccagagacaacgaccaaaaactcactgtatctgacaaatggacgcctgagatccgaggacacggctgtgtattattgngcgagagatttagactaactaaagtttcgagtgactggtatgatgtcttangataccgtggggaccaagggaccagtggtccaccgtctcttcacgcctccaaccgaacgggcccagtccgtcccttccccgtggcccgtccctgccctccgaggacgccacccgtccggagacgcacgcgg

SEQ ID NO: 115774 - DNA, 553 bp, Homo sapiens
  misc_feature: GYAE6OF02GMW37.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggtagctattggatggactgggtccgccagtctccgagggaaggggctgggagtgggtggccaacatacgaggggaggtggtaggtaacgaaaaactgtgtggactcgtgtgcggggccattcaccatctccagagacaacgaccaaaactcactgtatctgacaaagtgggaaccggcctaggagacgtacccggaggaaccacgggcttggttgtatttagttgtgcgagagtatttaagactaacgtaagtttcgagttgactggtatgatcg

SEQ ID NO: 115775 - DNA, 585 bp, Homo sapiens
  misc_feature: GYAE6OF02HBBZM.37.34.D01.1.454.CMB.1.raw
  modified_base (200)..(200): a, c, t, g, unknown or other
  misc_feature (200)..(200): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtagganacagagtcatcatcacttgccgggcaagtcaggcattagaaatgatttaggctggtatcagcagaaaccagggaaacgccctaagctcctacatctatggtgctatccagttacaaacgtgggtacccattaagattcgagcggacagtgatcgtggacacagatttcactctactaccatcagcgtacgcctgacagtcctagtaacgtattttcgactaatttacttactacgttactaactaaagtaactttaaaccgtaaactttaaccccttacggttacccggtttacggtaacccgtaaacggggtaaccctaaggggtaacggaaccgtttaacgaaaaccggttaacgtaggttacggacttacggacctaacccg

SEQ ID NO: 115776 - DNA, 591 bp, Homo sapiens
  misc_feature: GYAE6OF02F1JWX.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctggggggaggcttggtccagcctgggggggtccctgagactctcctgtgcagcctctggattcaactttggtagctattggatggactgggtccgccagtctccagggaaggggctgggagtgggtggccaacatacagggaggtggtggtacgaaaaactatgtggactctgtgcggggccgattcaccatctccagagacaacgccaaaaaactcactgtatctgcaaatggacggcctgagatccgaggacacggctgtgtattattgtgcgagagtatttagactacaaagtttcgagtgactggtatgatgcttatgataccgtggggaccaagggaccagtggtccaccgttctcttcgacgtccctaccaaccgaacgggcccaagttcccggttcccttccccccgtgggtcccgtccccttcggtccctcccgagggtacgaccaccccggttacccgaaggtacgccacgaccggg

SEQ ID NO: 115777 - DNA, 538 bp, Homo sapiens
  misc_feature: GYAE6OF02GVG9W.37.34.D01.1.454.CMB.1.raw
  modified_base (344)..(344): a, c, t, g, unknown or other
  misc_feature (344)..(344): n is a, c, g, or t
  modified_base (468)..(468): a, c, t, g, unknown or other
  misc_feature (468)..(468): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcaccatcacttgccggcagtcgactattagtacctggttggcctggtatcaacagaaaccagggaaacgcccctaaggtcctgactctatgatgcctcctactttcggaaagccgggtcccagtcaaggttcagcgnagtgtatcgtgggacagaattcactctacaccatcagtacgctgcagcctgatgtatttcgactaactttattactgtacatctattataagtgggaattcgttcgggaccggaagggtaccgngggtttagagtaacgtacaaaccggtacgtgttacggtcgtacgcgaccgtatacgttcgttacttcccg

SEQ ID NO: 115778 - DNA, 570 bp, Homo sapiens
  misc_feature: GYAE6OF02G9G7G.37.34.D01.1.454.CMB.1.raw
  modified_base (470)..(470): a, c, t, g, unknown or other
  misc_feature (470)..(470): n is a, c, g, or t
tcagtagtgtagatcacgaccggtgctcgatttagatcgtctgtgttgggtttggggctcagagtggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtggggggtccctgagactctcctgtgcagcctcgtggattcaacttttggtagctattggatggactgggtccgccagtctccgagggaagggctgggagtggggtgaccaagataacgaggggacggtggtagggtaaacgaaaaacgtgtggtaggactcgtagtgggcggggccgattccaaccatctccagagaaccaacgacccaaaaactcactagtactctagacaaagnggacgcctgaagactaccggaggacacggcttagtcgttattagttgtagcgagagtattagactaagtaacgtttagagtacgtacgtaggtatgatcg

SEQ ID NO: 115779 - DNA, 537 bp, Homo sapiens
  misc_feature: GYAE6OF02G4A95.37.34.D01.1.454.CMB.1.raw
  modified_base (201)..(201): a, c, t, g, unknown or other
  misc_feature (201)..(201): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtagganacagagtcatcatcacttgccgggcaagtcagggcattagaaatgatttaggctggtatcagcagaaaccgagggaaacgcccctaagcctcctcatctatggtgcatcctagtttacaaacgtcgggtacccaattaagattcgagcggacagtgatctggcacagtattcactctacacatcagcacgtccctgcacgccgtagaagttatttacgacttaaacttattactgtactacaagtacttaacaactttacctacgttacgttccggaccgaacgggtacctaagggtaggtaacgtacgaacgtacgtgtaggctacgactaaccg

SEQ ID NO: 115780 - DNA, 300 bp, Homo sapiens
  misc_feature: GYAE6OF02GKISL.37.34.D01.1.454.CMB.1.raw
  modified_base (296)..(300): a, c, t, g, unknown or other
  misc_feature (296)..(300): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnn

SEQ ID NO: 115781 - DNA, 302 bp, Homo sapiens
  misc_feature: GYAE6OF02JUOXH.37.34.D01.1.454.CMB.1.raw
  modified_base (223)..(223): a, c, t, g, unknown or other
  misc_feature (223)..(223): n is a, c, g, or t
tcagtagtgtagatcacgaccggtgctcgatttagatcgtctgtgttggtttggggtaagaggaagactgacggtcctgccacaggtggtgctgaggaagagatggaggtggacgtgtcagcacccagctgggcctgtccctggtcaccgtctcctcagcctccaccaaggcccatcggtctcccctgcgccctgctcccaggagcacctcccgagagcaccngccgggccccttgggggctgcctgggtcaagggactacttccatcctacactactgagcggggctggcaaggcgcatag

SEQ ID NO: 115782 - DNA, 297 bp, Homo sapiens
  misc_feature: GYAE6OF02GD6GW.37.34.D01.1.454.CMB.1.raw
  modified_base (294)..(297): a, c, t, g, unknown or other
  misc_feature (294)..(297): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaaggcccatcggtcttcccctggcgccctgctccaggagcacctccgagagcacagcggccctgggctgcctggtcaaggactacttccatctacactactgagcgggctggcaaggcgcatagnnnn

SEQ ID NO: 115783 - DNA, 295 bp, Homo sapiens
  misc_feature: GYAE6OF02F16X8.37.34.D01.1.454.CMB.1.raw
  modified_base (288)..(288): a, c, t, g, unknown or other
  misc_feature (288)..(288): n is a, c, g, or t
  modified_base (294)..(295): a, c, t, g, unknown or other
  misc_feature (294)..(295): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggccatcggtcttcccctggcgccctgctccaggagcacctccgagagcacagcggccctgggctgcctggtcaaggctacttccatctacactactgagcgggctggcaaggcncatagnn

SEQ ID NO: 115784 - DNA, 567 bp, Homo sapiens
  misc_feature: GYAE6OF02IJ83X.37.34.D01.1.454.CMB.1.raw
  modified_base (308)..(308): a, c, t, g, unknown or other
  misc_feature (308)..(308): n is a, c, g, or t
  modified_base (516)..(516): a, c, t, g, unknown or other
  misc_feature (516)..(516): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgagttttccttgttgctattttagaaggtgtccagtgtgacgtgcaactggtggagtcgtgggggagcttggtccagccgtggggggtccctggagactctcctgtgcagcctctggattcaacgtttggtagtctaagttggatggactgggtccncagtctccgagggaagggctgggagtggggtggccaaacagtacgaggggaggtggtaggtaaacgaaaaactgtggtaggactcgtgtggcggggccgattccacatctcagacgaacaacgaccaaaaacgtcacgtagtactctgaactaaagtcgggacggccttagacgactccggaaggacacggtctgtgtacttagttgngacgagtagtattacgaactaacgtaagtttcgagtcgagtagtatgtacg

SEQ ID NO: 115785 - DNA, 523 bp, Homo sapiens
  misc_feature: GYAE6OF02JAAK2.37.34.D01.1.454.CMB.1.raw
  modified_base (264)..(264): a, c, t, g, unknown or other
  misc_feature (264)..(264): n is a, c, g, or t
  modified_base (339)..(339): a, c, t, g, unknown or other
  misc_feature (339)..(339): n is a, c, g, or t
  modified_base (401)..(401): a, c, t, g, unknown or other
  misc_feature (401)..(401): n is a, c, g, or t
  modified_base (454)..(454): a, c, t, g, unknown or other
  misc_feature (454)..(454): n is a, c, g, or t
  modified_base (486)..(486): a, c, t, g, unknown or other
  misc_feature (486)..(486): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtctgggggaggcttggtccagccgtggggggtccctgagactctcctgtgcagcctcnggattcaactttggtagctattggatggactgggtccgccagtctccgaggggagggctggagtgggtggccaanatacgagggaggtggtaggtacgaaaaactgtagtggactcgtagtgcggggccattcaccntctcagagacaacgacaaaactcactgtatctgacaatcggacgcctgacganccgagacacgctgtgtattatgtgcgagagtnttacgactactaagttgagtgacgtggtatgattacg

SEQ ID NO: 115786 - DNA, 554 bp, Homo sapiens
  misc_feature: GYAE6OF02IC69S.37.34.D01.1.454.CMB.1.raw
  modified_base (506)..(506): a, c, t, g, unknown or other
  misc_feature (506)..(506): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctcgtggattcaactttggtagctattggatggactgggtccgccagtctccgagggaggggctgggagtgggtgccaacataccgaggggaggtggtagggtaacgaaaaacgtgtagtggaactcgtggtgcggggcctattccgacctatctccgagacgacaacgaccaaaaactcaactgtactcgtgacaaagtggacgcctagagataccgaggaccacggcttgtgtattagttgngacgagagtaagttagactaataagttgagtcgagttggtatagatcg

SEQ ID NO: 115787 - DNA, 622 bp, Homo sapiens
  misc_feature: GYAE6OF02IA7OR.37.34.D01.1.454.CMB.1.raw
  modified_base (238)..(238): a, c, t, g, unknown or other
  misc_feature (238)..(238): n is a, c, g, or t
  modified_base (337)..(337): a, c, t, g, unknown or other
  misc_feature (337)..(337): n is a, c, g, or t
  modified_base (388)..(388): a, c, t, g, unknown or other
  misc_feature (388)..(388): n is a, c, g, or t
  modified_base (460)..(460): a, c, t, g, unknown or other
  misc_feature (460)..(460): n is a, c, g, or t
tcagtagtgtagatcacgaccggtgctcgatttagatcgtctgtgttgggtttgggggcaggagtcagacccactcaggacacagcatggacatggacgggtccccgctcagctcctggggctcctgctgctctggctcccaggtcgccagatgtgccataccaaatcgacccagtcctccactccctcctgtctgcatcgtagtaggagacaggtatcatcatcacttcgccggganaaggtcgagggactaagttaagaagtgtagtttaggcttggtatccaagacgaaagaaaccgaggaaacgccctaagctccactactcgtagttcgganactactactaagttaacaacggtcgggtacctaagttacgtattacgacgngacaggtgtaatcgtacggatacgtatcgtttacacgtccacacctagtcgaagaccgcgccctgaccgtanccgtagagtttactcgtacccgttaaatttaggtacccttgtaacctaaacgtaagtaactttaaactacccgttacctacggttaccgtacggaaccgtaaacggacgtaaggtaagtaaccgaaagtaacgtaacgttcgggaagtctacggtatacccg

SEQ ID NO: 115788 - DNA, 568 bp, Homo sapiens
  misc_feature: GYAE6OF02F0WG3.37.34.D01.1.454.CMB.1.raw
  modified_base (422)..(422): a, c, t, g, unknown or other
  misc_feature (422)..(422): n is a, c, g, or t
  modified_base (507)..(507): a, c, t, g, unknown or other
  misc_feature (507)..(507): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctgggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaatggacgcctgagatccgaggacacggctgtgtattattgtgcgagagatttagactactaaagtttcgagtgactggtatgatgcttangattacgtgggccaagggccagtcggtcaccgtctcttcgcgtccctccgaccgaacgggccctaagtccggttccttcccccgnggtcccgtcccctcggcccttaccgagggaccgccgacccgtccgacgacgccacgaccgg

SEQ ID NO: 115789 - DNA, 301 bp, Homo sapiens
  misc_feature: GYAE6OF02FL5ZT.37.34.D01.1.454.CMB.1.raw
  modified_base (298)..(301): a, c, t, g, unknown or other
  misc_feature (298)..(301): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggcccatcggtcttccccctggccgccctgctccaggagcacctccgagagcacagcggccctgggctgcctggtcaaggactacttccatctacactactgagcgggctggcaaggcgcatagnnnn

SEQ ID NO: 115790 - DNA, 851 bp, Homo sapiens
  misc_feature: GYAE6OF02G1I7D.37.34.D01.1.454.CMB.1.raw
tcagtagtgtagatcacgaccggtgctcgatttagatcgtctgtgttgggtttgggggggtctccagagaggtagccttagtccctggactccaaggcctttccacttggtgatcagcactgagcgactaggaggactcaccagttggaattggggcttgtaagcggtcggtttcgtgttaggcgtattagaaggtgtcaggtgttggacgtgcgtacggtcggggtcggaaggtcgtgggggcgtcgttcggtccgtagtccgtcgggggtacccctaggtagactcgtcctgtgctagcctcgtggacttcaacgtttcggtacgacgtaagttcggtagtaggtacgtcgggtccgccgagttcgtaccgaggggtaacgggtcgtagggtagtcgggtacggtaccgtaaaccgtagttaaccggacggggtacgggttacggggtaacgggtaaaccggtaaaaaacgttgtacgggttacggtaaccgttccgttacggtacgggaccgggggtaacccgtaagtttacccgaacccgtaacgttccgtaaccgtaaggtaaacgaaccgtaaacggtaaaccctaaaaacgtctaaacggtacgttaacgtacgtacgaaccgtaaacgtgggtaacccgtccttaggtacggtacgttaccgggacggtaaccgtaacgggttcgttagtttaaccggttagtttaacgggtttaggtacgggttacccggttaagggtaaccgtttaacggtttaaccggtaaaccggttaaccggttaaaacggttttcccggtaaggttcggttaaacccgttgggttaacctaccgggtaacgttccgg

SEQ ID NO: 115791 - DNA, 546 bp, Homo sapiens
  misc_feature: GYAE6OF02GBBM1.37.34.D01.1.454.CMB.1.raw
  modified_base (339)..(339): a, c, t, g, unknown or other
  misc_feature (339)..(339): n is a, c, g, or t
  modified_base (406)..(406): a, c, t, g, unknown or other
  misc_feature (406)..(406): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggtagctattggatggactgggtccgccagtctccgagggagggctggagtggggtgccaanagtacgaggggaggtggtaggtaacgaaaaactgtagtggactcgtgtggcggggccgattccaccntctcagagacaacgaccaaaactcactagtatctgacaagtggacgctaggacgagtaccggaggaccacggcttgtagttattgttgtgacgagagtattaagactaacgtaagtttcgagtgacgtaggtatggatcg

SEQ ID NO: 115792 - DNA, 301 bp, Homo sapiens
  misc_feature: GYAE6OF02IUBQ0.37.34.D01.1.454.CMB.1.raw
  modified_base (296)..(301): a, c, t, g, unknown or other
  misc_feature (296)..(301): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggctacttccatctacactactgagcgggctggacaaggcgcaatagnnnnnn

SEQ ID NO: 115793 - DNA, 588 bp, Homo sapiens
  misc_feature: GYAE6OF02IFSOQ.37.34.D01.1.454.CMB.1.raw
  modified_base (238)..(238): a, c, t, g, unknown or other
  misc_feature (238)..(238): n is a, c, g, or t
  modified_base (271)..(271): a, c, t, g, unknown or other
  misc_feature (271)..(271): n is a, c, g, or t
  modified_base (536)..(536): a, c, t, g, unknown or other
  misc_feature (536)..(536): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaacttttggtagcttattggatggactgggtccgccagtctccgagggaaggggctggagtgggtggccaanatacgaggggaggtggtaggtaacgaaaaactntgtggacttctgtggcgggcgattcacatctcagagacaacgaccaaaactcactgtatctgacaagtggacgctgagatcgagacacggctgtgtattgttgtgcgagagtatttagactaataagtttcgagtgacgtggtatgatgacttatgtactaccggtcgggaccaagggaccctagtcggtaccgtacgttccttcgttacgaccgtccctaccaccgaacgggtccctagttcccgtccttccccgtcggtcccnccgtcgccgtaccgaggacgtcccaccgtaccgacgtacgccgtacgaccgg

SEQ ID NO: 115794 - DNA, 536 bp, Homo sapiens
  misc_feature: GYAE6OF02HXHSD.37.34.D01.1.454.CMB.1.raw
  modified_base (443)..(443): a, c, t, g, unknown or other
  misc_feature (443)..(443): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggagctattggatggactgggtccgccagtctccaggggagggctggagtgggtggccaacatacgagggaggtggtggtaacgaaaaactgtgtaggactcgtggtcggcggggccgattccaccatcctccagagacaacgaccaaaaactcactgtatctaganaaagtggacgctggagacgtaccgaggacacggctgtgtattagttgtgagagagtatttagactaataagtttcgagtgactggtatgatcg

SEQ ID NO: 115795 - DNA, 311 bp, Homo sapiens
  misc_feature: GYAE6OF02G2ACO.37.34.D01.1.454.CMB.1.raw
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (304)..(311): a, c, t, g, unknown or other
  misc_feature (304)..(311): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggcccatcggtccttcccccgtggccgcccctgcctccgaggacgcacctccgagagcacagccggccctgggctgcctggtcaaggactacttccatctacactactgagcgggntggcaggcncatagnnnnnnnn

SEQ ID NO: 115796 - DNA, 602 bp, Homo sapiens
  misc_feature: GYAE6OF02FH7KS.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtcccctgagactctcctgtgcagcctctggattcaactttggtagctattggatggactgggtccgcagtctccgagggagggctgggagtgggtgccaacatacgaggggaggtggtagggtaaacgaaaaactgtggtggactcgtggtggacgggggccattccacctatcctaccacagaacaacgaccaaagaaactacaattcttttagacaatacgaactagtctaggagagtacggagacgacggacctagttgtacttacgtagtaacgagaacgaacgaacggtacggttacgggggaccgaacgggtaacccgtcggtaccacccggttcctcccgtacaccgtaccccg

SEQ ID NO: 115797 - DNA, 590 bp, Homo sapiens
  misc_feature: GYAE6OF02JZC37.37.34.D01.1.454.CMB.1.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (397)..(397): a, c, t, g, unknown or other
  misc_feature (397)..(397): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgcagtctccagggaggggctggagtgggtctcaggttattacgtggtagtggtaataccgcatactacgcagactccgtgacgggccggttcaccgtctccagagacaattccaagaatacggtctatctaggaaatgaacagcctgagagccgagacacggccctntattacngtgcgagagatcgaggaacggagtanagcagcgagctcgtcgactacgtcggggaccgaccggaacccgtggtccaccgtcctcctcacgccctaccgaccgacggcccacgtccgtccttccccgtcggaccctacccgtcctaccacgacgaccgaccgtccgtcggggaccaccgacggcccggtcccgtacgggccgtacggtcccgtggtaccg

SEQ ID NO: 115798 - DNA, 560 bp, Homo sapiens
  misc_feature: GYAE6OF02GD2SH.37.34.D01.1.454.CMB.1.raw
  modified_base (201)..(201): a, c, t, g, unknown or other
  misc_feature (201)..(201): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtagganacagagtcatcatcacgttgccgggcaagtcagggcattagaaatgatttaggctggtatcagcaagaaaccgaaggggaaacgacccctaagcctcctcatctatggtgcatcctagtttaacaaacgtcgggtacctaagttaagattcgagcggcagtgatcgtggacatagtacttacactcctcaacctatacacgcacgcctgcacgctagagttatttcgactaacttattactcgtactacgtaatacttaactaaccttaccgtacgttacgttacggaccggtaagggtaaccgtaagggtacgtaaggtaaccaaacgtaccgttaggtacggtctacgacctaaccg

SEQ ID NO: 115799 - DNA, 628 bp, Homo sapiens
  misc_feature: GYAE6OF02IVWVS.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttggccgggcaagtcgaggcattagaaatgatttaggctggtatcagcaagaaaccaagggaaacgacccctaagcctcctcatctagtggtcgcattcctaagtttaacaaacgttcgggtaccctaagtttaacgtattacgaggacggacgagtggatcgtggcactagtactttaccactctacacctatcacgcacgtcctcgacacgtcctagtaacgttattttcgaccttaacttttacttaacttcgttacttaacgtaacgttaacttaacctaaacgtttaccccttacggttacccggtttccggtaacccggtaaacggggtaacccgtaaaggggtaacggtaaacggttaaccgtaaaaccggtacttacgggtggtaccgttaccggactaacccg

SEQ ID NO: 115800 - DNA, 638 bp, Homo sapiens
  misc_feature: GYAE6OF02HX6I5.37.34.D01.1.454.CMB.1.raw
  modified_base (261)..(261): a, c, t, g, unknown or other
  misc_feature (261)..(261): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgtggtttcgtcgtagcgtatttagaaggtgtcagtgtgacgtgcaactggtggagtctgggggagcttggtccagccgtgggggtccctgagactctccgtgtgcagcctntggattcaacgttttggagctatggatggactgggtccgcagtctccgaaggggtagggctgggagtggggtcggccaagacgtaacgaggggagggttacggtgggtaacgaaaaaactgtaggtggacgtactggtagcgggggtccattccgaactacgtcgtacccgaggaacgtaaccaaccggacaaaaaccgtcactacggttaactcttagacaaagttcgggaccgccgtaggacgaactacccgggaggaccgaacggtcgtacgttacggttattacgtttaggcgtacggagtagtaacgttttaaggacttaaacgttaaaggtttccgtaaggttcgaaccgtttagggtatgggtattacgg

SEQ ID NO: 115801 - DNA, 577 bp, Homo sapiens
  misc_feature: GYAE6OF02GLX5T.37.34.D01.1.454.CMB.1.raw
  modified_base (306)..(306): a, c, t, g, unknown or other
  misc_feature (306)..(306): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtagagacagagtcatcatcacttcgccgggcaagtcaggcattagaaatgatttaggctggtatcagcaagaaaccagggaaacgacccctaagcctcctcatctatggtncatcctaagtttaacaaacgttcgggtacccaatttaagacttacgagcggcgtaggtgatctggcactagtactttcactctcaccatccagcacgcctgactacgccgtagaacgttattttcgacttaaactttacttacttgttaactaactaagtaacttaaccttaacttacccgtacgttaccgttccggaccgtaaacgggtacctaagggtacggaaacgttaacgaaacggtacgtacggtaggtactacggacctaaccg

SEQ ID NO: 115802 - DNA, 791 bp, Homo sapiens
  misc_feature: GYAE6OF02IU7XT.37.34.D01.1.454.CMB.1.raw
  modified_base (111)..(111): a, c, t, g, unknown or other
  misc_feature (111)..(111): n is a, c, g, or t
  modified_base (120)..(120): a, c, t, g, unknown or other
  misc_feature (120)..(120): n is a, c, g, or t
  modified_base (762)..(762): a, c, t, g, unknown or other
  misc_feature (762)..(762): n is a, c, g, or t
tcagtagtgtagatcacgaccggtgctcgatttagatcgtctgtgttgggtttgggctcagagaggagccttagccctggactccaaggcctttccacttggtgactacgngcacgtagngcacgagacgtactcacctagtagtaggttgggactgtaggttccttgggtttttcctgttgttactaagttttagaacggttgttccgagtcgttgaccgtagtcgtaagtggttcggtagggtcgtgggggtggtccgttaggtcccgtaggggtcccttggggggacccttggacgtcccgttcgttcccgtgtacgcctacggccgttacgttgaacttttcggaacgttttggtaacgtcgttaatttgggaacttcgggaccgtcggttcccgctagtaccggtacggagggtaggcgttgggacggtcggacgaccctaagaggttacggagggttcggtaaggtaacgttaaacgaaattggacgttggtacgttcggtcgggtccggtaggttccgtacctcgtaacccgtaccgtcgtaccgaacgaccgaaaccgtaaaccctaaccgtaaaactcgtaacttacgtactcgttaacggtaacgtaacggtcgtaacggcgtaagtcggaacctaccggaacggtaccgtaggttacgttagttttgtacgttgttaggtagacgtttaagaccgttaaacgttaaccggtttaacgtaacggtttaaacgttccgtaacgggttttaacncggtttataacggttctttaagttaccgg

SEQ ID NO: 115803 - DNA, 586 bp, Homo sapiens
  misc_feature: GYAE6OF02HE8D2.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacagggaggtggtggtacgaaaaactatgtggactctgtgcggggccgattcaccatctccagagacaacgccaaaaactcactgtatctgcaaatggacgcctgagatccgagacacggctgtgtattattgtgcgagagtatttagactacaaagtttcgagtgactggtatgatgcttaatgaattaccgtggggaccgaaggggacctagtggtacctaccgtccttcttcacgccctcccaaccgaacgggcccaacgttccggtcccttcccccgtggcccgtcccctcggcctcccgacgggaccgcctacccgtccggaacggtacgaccgacgtaccggg

SEQ ID NO: 115804 - DNA, 651 bp, Homo sapiens
  misc_feature: GYAE6OF02ISLJP.37.34.D01.1.454.CMB.1.raw
  modified_base (252)..(252): a, c, t, g, unknown or other
  misc_feature (252)..(252): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagctggttttccttgttgcttatttagaggtgtccagtgtgacgtgcaacgtggtgagtcgtggggagcttggtccagccgtgggggtcctgagctctcctgtgcngcctctggattcgaacgtttggtagcttagttggattggacttcgggtcccgctagtcgtccgaggggaagggtctgggagtgggtcgaccaaagagtacggagggtaggtcggtacggtaaacgaaaaactgtacggtacgacttcgtggtcggcggggtcccgaattccaaccacgtcctaccgacggaacgaaccgaaaccgaaccctaaaaaccgtctaacgttagtactaccgtacgaacgtaaaggtacggaccggtcctaggacgaacgtaccggaacggaacgaccggtacttaggttacgttaagttagttagtcggacgtaggtaagtaacgtttagaaccgttaacgtaaaggtttcgagttacgtacgttaggtagtagtagttacg

SEQ ID NO: 115805 - DNA, 537 bp, Homo sapiens
  misc_feature: GYAE6OF02GA6XE.37.34.D01.1.454.CMB.1.raw
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (404)..(404): a, c, t, g, unknown or other
  misc_feature (404)..(404): n is a, c, g, or t
  modified_base (473)..(473): a, c, t, g, unknown or other
  misc_feature (473)..(473): n is a, c, g, or t
  modified_base (488)..(488): a, c, t, g, unknown or other
  misc_feature (488)..(488): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctggggggaggcttggtccagccgtggggggtccctgagactctcctgtgcagcctctggattcaactttggtagctattggatggactgggtcccncagtctccgagggagggctggagtgggtgccaanatacgagggaggtggtggtaacgaaaaactgtggtggactctggtgcgggggccattccaccntctccagacgacaacgaccaaaactcactgtatctgacaaagtggacgctgagactccggagacacggnttgtgtattagttgngcgagagtattagactaagtaagtttgagtgacgttggattagattacg

SEQ ID NO: 115806 - DNA, 627 bp, Homo sapiens
  misc_feature: GYAE6OF02IGHZ7.37.34.D01.1.454.CMB.1.raw
  modified_base (281)..(281): a, c, t, g, unknown or other
  misc_feature (281)..(281): n is a, c, g, or t
  modified_base (390)..(390): a, c, t, g, unknown or other
  misc_feature (390)..(390): n is a, c, g, or t
  modified_base (611)..(611): a, c, t, g, unknown or other
  misc_feature (611)..(611): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaacttttggtagctattggatgggactgggtccgccagtctccgaggggaaggggctggaggtgggtggccaacatacgagggaggtgggtggtaacgaaaaactatgtggactntgtggcggggccgattcaccatctcagagacaacgaccaaaaactcactgtatctgacaaagtcggacggcctaggagacgtccggaggacgacggtctagtgttattnttgtgacgagagtattagactaagtaagtttcgagtgacgtggtatgatgtcttataggtacttaccggtcgggaaccgaagggcctaggtcggcctaccgttcctacttaccgacgtccctaccgaacccgaacgggtccctagttcccgttcccttacccccgcggtcccgtcccgtcgacccgtaccgaacggccgtccgtacccgtaccgacggacncccgaacgtacccggg

SEQ ID NO: 115807 - DNA, 605 bp, Homo sapiens
  misc_feature: GYAE6OF02HLWTU.37.34.D01.1.454.CMB.1.raw
  modified_base (420)..(420): a, c, t, g, unknown or other
  misc_feature (420)..(420): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctcgtgggttctaacgttttggtagctagttggatggactgggtccgccagtcctccgagggagggctgggagtgggtgaccaacatacgaggggaggtggtaggtaacgaaaaactgtggtaggactcgtggtggccgggggccagttccacctntcctcagacgaacaacgaacccaaaactcactagtatctagactaaagtcgggacgccgtgacgtactaccggaaggaccgacgggtctaggttagttagtttagttgtcgacgagtagttaacgtttaacgacgttaacgttaaaggtttcggaagttcgtacgttggtaagtgtagtagttac

SEQ ID NO: 115808 - DNA, 638 bp, Homo sapiens
  misc_feature: GYAE6OF02GK14G.37.34.D01.1.454.CMB.1.raw
  modified_base (235)..(235): a, c, t, g, unknown or other
  misc_feature (235)..(235): n is a, c, g, or t
  modified_base (384)..(384): a, c, t, g, unknown or other
  misc_feature (384)..(384): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaggggctgggagtgggtggccaanatacgagggaggtggtaggtaacgaaaaactatgtaggactcgtagtggcggggccagttccacatctccagagacaacgaccaaaactcactgtatctagacaaagtggacgctagagagtccgaggacacggctgtagtattattgngcgagagtatttagactaacaagtttcgagtagactaggtatagatgtacttagtagtacgttaccggtaggggaccgaacggggtaccaggtacggtccgtacgttcctacgttcaccgtcccgtaccgaaccggtaaccggaccttaccggttcccgtccccgtttccccggtccggtaccccgtcccgtaccgtaccctaccggacggtaccgacccgtacccgtaccggaacgcgtaccacgtacccggg

SEQ ID NO: 115809 - DNA, 581 bp, Homo sapiens
  misc_feature: GYAE6OF02GZ89K.37.34.D01.1.454.CMB.1.raw
  modified_base (500)..(500): a, c, t, g, unknown or other
  misc_feature (500)..(500): n is a, c, g, or t
  modified_base (577)..(577): a, c, t, g, unknown or other
  misc_feature (577)..(577): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaacttttggtagctattggatggactgggtcccgcctagtctccgagggaaggggctgggagtgggtggccaacgagtacgaggggaggtggtaggtaaacgaaaaacgtgtaggtggactcgtggtcgggcggggccgtagttccaccgtatccgtccaagacgaaccaaaccgaacccaaaaacctcaactagtatcgtacgacaaagtcggacgtctaggagtacnccggaacgacgacggcgttgttagtatttagtgtgagtagagtagttacactaataagttgagtgacgtggtatgtntacg

SEQ ID NO: 115810 - DNA, 661 bp, Homo sapiens
  misc_feature: GYAE6OF02HVP4U.37.34.D01.1.454.CMB.1.raw
  modified_base (586)..(586): a, c, t, g, unknown or other
  misc_feature (586)..(586): n is a, c, g, or t
tcagtagtgtagatcacgaccggtgctcgatttagatcgtctgtgttgggtttggggcgtcagagaggagccttagccctggactccaaggcctttccacttggtgatcagcactgagcacagaggactcaccatggaattggggctgagctgggttttccttgttgctattttagaaggttgtccagtgtgacgtgcaactggtggagtcgtgggggagcttggtccagccgtgggggtccctgagactctcctgtgcagcctctggattcaacttttggagctatggatggactgggtccgccagtcctaccgaggggagggctgggaggtgggtcggccaacgagtacggaggggtagggtaggtagggtaaaacgaaaaacgtgtaggtacgtactcgtggtcgggccggggaccgtacgttaccgacctacgtccctacgaaggaacggtaaacaaaccggtaaacccaaaaaacgttcctaacgttagtactacgttacgaactaaaggtcgggaccggtcctaggacgtaccgtaccggaaggaaccgtacggtcgtacgttaggttaaacttgttagngacggaagtagtaagtttaacgaacgttaacttaaggtttcgtagttacggtaccgttagggtactggtatacgg

SEQ ID NO: 115811 - DNA, 553 bp, Homo sapiens
  misc_feature: GYAE6OF02GSDIH.37.34.D01.1.454.CMB.1.raw
  modified_base (502)..(502): a, c, t, g, unknown or other
  misc_feature (502)..(502): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttgggtccaggccgtgggggggtcccctggagactcctcctgtgcagcctctggattcaactttggtagctattggatggactgggtccgccagtctccgaggggagggctggaggtgggtggccaacatacgaggggaggtggtaggtaacgaaaaactagtggtaggactcgtggtggcgggggccattcaccgatctcagagacaacgaccaaaactcactgtatctgacaagtggacgctgagctaccggaggacgacggctgtagttattagttgngcgagagtattagaactacgtaagttcgagttgtacgttggtatagtatcg

SEQ ID NO: 115812 - DNA, 596 bp, Homo sapiens
  misc_feature: GYAE6OF02I8RAF.37.34.D01.1.454.CMB.1.raw
  modified_base (283)..(283): a, c, t, g, unknown or other
  misc_feature (283)..(283): n is a, c, g, or t
  modified_base (333)..(333): a, c, t, g, unknown or other
  misc_feature (333)..(333): n is a, c, g, or t
  modified_base (480)..(480): a, c, t, g, unknown or other
  misc_feature (480)..(480): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccagccgtggggggtccctgagactctcctgtgcagcctctggattcaactttggancttattggatggactgggtccgcagtctccgagggagggctggagtgggnggccaacgatacgaggggaggtggtaggtaacgaaaactgtggtacggacttcgtggtacggccgggggaccgtattccgaccatacctccgagacgacaaccgaccaaaactcaactcgtaatctagactaagtcgggaccgtcgngagtacgtaccgaggaccacggcttaggtacgttattacgttgtcgacgtagtacgtagtttaacgacgtaacgtaaacggtttcgaggttacgacgttaggtactggtattacgg

SEQ ID NO: 115813 - DNA, 588 bp, Homo sapiens
  misc_feature: GYAE6OF02GIWOL.37.34.D01.1.454.CMB.1.raw
  modified_base (424)..(424): a, c, t, g, unknown or other
  misc_feature (424)..(424): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctgggggggtccctgagactctcctgtgcagcctctggattcaactttggtagctattggatggactgggtccgccagtctccagggaaggggctggagtgggtggccaacatacagggaggtgggtggtaacgaaaaactatgtggactctgtgcggggcgattcaccatctccagagacaacgccaaaaactcactgtatctgacaaatggacggctgagatccgaggacacggctgtgtattattgtgcgagagtatttagactacaaagtttcgagtgactggtatgatgcttangatacgtcggggaccaagggaccagtcggtacaccgttctcttcacgtccctaccaccgaacgggcccaagttcccggttcccttcccccgtggtcccgtccccgtcggtccctccgtacggaccgtccgacccttcccggaaggacggacccaacgtaccggg

SEQ ID NO: 115814 - DNA, 564 bp, Homo sapiens
  misc_feature: GYAE6OF02FNRQT.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccaggctccgagggaaggggctgggagtgggtggccaacataaagcaagatagggaagtaagaaggagtatggtggactctgtgaacgggtccgtttcaccatctccagagacaacgccaaagaacctccgtgcatctgacaaatgaacagtctagagaggccgaggacacgctaatttatacgtgcgacgagaggaaggacgtggggtcggtttacgacgttacggtggggacccacggggtacccgtggtcctacccg

SEQ ID NO: 115815 - DNA, 358 bp, Homo sapiens
  misc_feature: GYAE6OF02FZ7CH.37.34.D01.1.454.CMB.1.raw
  modified_base (306)..(306): a, c, t, g, unknown or other
  misc_feature (306)..(306): n is a, c, g, or t
  modified_base (312)..(358): a, c, t, g, unknown or other
  misc_feature (312)..(358): n is a, c, g, or t
tcagtagtgtagatcacgaccggtgctcgatttagatcgtctgtgttggggtttggggggggaagaggaagactgacggtcctgccacaggtggtgctgaggaagagactggaggtggacgtgtcgagcacccagctggggcctgtccctggtcaccgtctcctcagcctccaccgaagggcccatccggtcttccccctggcgccctgctccaggagcacctccgagagcacagccggccctgggctgcctggtcaaaggacctacttccattctacactatagaggcgggactcggacaaggcncatagnnnnnnnnnnnnnnnnnnnnnnnnnnnnnnnnnnnnnnnnnnnnnnn

SEQ ID NO: 115816 - DNA, 582 bp, Homo sapiens
  misc_feature: GYAE6OF02GZ2VH.37.34.D01.1.454.CMB.1.raw
  modified_base (319)..(319): a, c, t, g, unknown or other
  misc_feature (319)..(319): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtgggggggtcccctggagactctcctgtgcagcctctggattcaacttttggtagcttagttggatggacgtgggtccgccagtcnccgaggggaaggggctggaggtggggtcggaccaacgatacgaggggaggtggtacgggtaaacgaaaaacgtagtggtaggactctggtcggcggggccagttcaccatctcgagagacaacgaccaaaactcaactgtatctagacaaagtggacgcgtagagacgtccggaggaccgacggtctagttacgtatttagttgtaggacgagtagtaagttagaacttaacgtaagttcgtagtgtacgtggtatgtattcg

SEQ ID NO: 115817 - DNA, 563 bp, Homo sapiens
  misc_feature: GYAE6OF02I0NE4.37.34.D01.1.454.CMB.1.raw
  modified_base (334)..(334): a, c, t, g, unknown or other
  misc_feature (334)..(334): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttctgttgctatttagaaggtgtccagtgtgacgtgcaactggtggagtcgtgggggaggcttggtccagccgtggggggtccctgagactctcctgtgcagcctctggattcaactttggagctattggatggactggggtcccgccagtctccgaggggaaggggctgggagtgggngccaacatacgaggggagtggtaggtacgaaaactgtgtggactcgtggtgcggggccgattccgaccatcctccagacgacaaccgaccaaaactcactagtactctagacaaagtggaccgtcctgagatccggaggaccaggccgttgtagttatttaagtggtagcggtaagtagtagtttagaactaacgtaagtttcgagtcgtacgttggtagtgtatacgg

SEQ ID NO: 115818 - DNA, 302 bp, Homo sapiens; identical to SEQ ID NO: 115353
  misc_feature: GYAE6OF02GQ8KD.37.34.D01.1.454.CMB.1.raw
  modified_base (297)..(302): a, c, t, g, unknown or other
  misc_feature (297)..(302): n is a, c, g, or t

SEQ ID NO: 115819 - DNA, 539 bp, Homo sapiens
  misc_feature: GYAE6OF02JJ7O1.37.34.D01.1.454.CMB.1.raw
  modified_base (420)..(420): a, c, t, g, unknown or other
  misc_feature (420)..(420): n is a, c, g, or t
  modified_base (481)..(481): a, c, t, g, unknown or other
  misc_feature (481)..(481): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggtagctattggatggactgggtccgcagtctccagggaagggctggagtgggtggccaacatacgagggaggtggtggtaacgaaaactatggtggactgtgtgcggggccgattcacatctcagagacaacgaccaaaacncactgtatctgacaaatcgggaacgctagagagtccgagacgacggctgtgtattagttgngacgagagtagttagaactaacgtaagtttcgagttacgaccgttggtaatgtagtcg

SEQ ID NO: 115820 - DNA, 551 bp, Homo sapiens
  misc_feature: GYAE6OF02IQ73E.37.34.D01.1.454.CMB.1.raw
  modified_base (313)..(313): a, c, t, g, unknown or other
  misc_feature (313)..(313): n is a, c, g, or t
tcagtagtgtagatcacgaccggtgctcgatttagatcgtctgtgttggggtttgggggcagggagtcagacccactcaggacacagcatggacatgagggtccccgctcagctcctgggggctcctgctgctctggcctcccaggtgccagatgtgccatccaaatgacccagtctccatcctccctgtctgcatctgtaggagacagagtcatcatcacttcggccgggcagtcgaggcattagaaatgatttaggctggtatcagcagaaaccgagggaaacgcccctaagcctcctcactctagtggtncatacctagtttaaccaaacgtcgggtaccctaattaagattcacggcgcgtagtgatcgtggcacgagtatttcacttcacaccatcagcacgcctgctacgccttagaagttattctactaactttattactgtactaacaagtatactaaacttacccgtcgttacgtacgaccgaacgggtaccgaagggtacgaacgtaacgtaacgtacgttggacgtcgtcgacctaaccg

SEQ ID NO: 115821 - DNA, 546 bp, Homo sapiens
  misc_feature: GYAE6OF02GIZOO.37.34.D01.1.454.CMB.1.raw
  modified_base (379)..(379): a, c, t, g, unknown or other
  misc_feature (379)..(379): n is a, c, g, or t
  modified_base (502)..(502): a, c, t, g, unknown or other
  misc_feature (502)..(502): n is a, c, g, or t
  modified_base (520)..(520): a, c, t, g, unknown or other
  misc_feature (520)..(520): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctggggggaggcttggtccagccgtgggggggtccctggagactctcctgtgcagcctctggattcaactttggtagcttattggatggacttgggtccgccagtctccgaggggaaggggctggagtgggtggccaacatacgagggaggtggtaggtaacgaaaaactntgtggactctgtgcggggcgtattcaccatctcagagacaacgaccaaaaactccaactgtatctagacaaagtggacgctagagactaccggacggacgacggtctgtagtatttagtgtgngagtagtattagactaanaagtttgagtgacgtggtatgatcgg

SEQ ID NO: 115822 - DNA, 572 bp, Homo sapiens
  misc_feature: GYAE6OF02JWDJ7.37.34.D01.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagtagtgtagatcacgaccggtgctcgatttagatcgtctgtgttgggtttggggctcagagaggagccttagcccgtggactccaaggcctttccacttggtgatcagcactgagcacagaggactcaccatggaattggggctgagcgtggtttcctgtagcgtatttagaaggtgtccagtgtgacgtgcaactgtggagtcgtgggggngcttggccagccgtgggggtccctagagctctccgtgtgcngcctntggattcaacgtttggagctagtggatggacttgggccgactgtcctccgagggaggctgggagtgggngccaagntacgagggngtggtaggtaacgaaaatgtggtagactntggnggacgggcgtattcaccgtatcctaccgagacgaacgaacggtaacccaaaaacttcgaatagtacttgacgtacaaagtcggaacgtcncgagtaccncggacggacncgggtctgtagtaacgttgtgtcgaggtagagttaatacgtagtaaacgtagtttccggaagtccgtagtgtagtagtacttgg

SEQ ID NO: 115823 - DNA, 660 bp, Homo sapiens
  misc_feature: GYAE6OF02GGZZB.37.34.D01.1.454.CMB.1.raw
tcagtagtgtagatcacgaccggtgctcgatttagatcgtctgtgttgggtttcctgttgctatttagaaggtgtccagtgtgacgtgcaactggtggagtctggggagcttggtccagcctgggggtccctgagactctctgtgcaacctctggattcagttgtagtgattgtggatgggttggtccgcaggtctccgagggaagggctggagtgggtcgccaacataaacgcgtagatagggaagcggtagaaatacgtagtggtaggtactcgtgtggacgggctactcgactgtcctcgacacgacaacgacctaagtaactactaacgttcgtttacgactaagtagtaaccgtagtacgtagtaggtacgtacggacggacgtacgtctagttagtacttacgtacgtacgagtacgtacgacggtacggtcgggaccgtacggtaccgtcggtaccgtaccgtccgtacgtacgtaccgtacctaccgacgtacggtaccgtacgttccggttacccttccgcgtccgtccgtcgtccgtacgtacggacgtccgtaccgtcgtacgacgtaccgtacgtcgtaccggtcgtcggtccgtacgtccgtacggtacgtaacggttaccttacgtaccgtacgtccgtagtaccg

SEQ ID NO: 115824 - DNA, 742 bp, Homo sapiens
  misc_feature: GYAE6OF02JE5LA.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctgggggggtccctgagactctcctgtgcagcctctggattcaacttttggtagctattgggatggactgggtccgccagtcctccgagggaaggggctgggagtggggtggaccaaacatacgaggggaggtggtacggtaacgaaaaaactgtaggtaggactcgtgtggcggggccgattcaccatctccagagaacaacgaccaaaactcactgtatctgacaaagtggacggcctagagacgtaccggaggaccgacggcgtggtagttattagttgtgacggagtaagtaagttttacgaacttaacgtaaagttcggtagtacgtacgtagttagtagtagttgtacttagtagtacgttaccggtacgggtaaccgaacggggtacctacggttacggtccgtaaccgttccgttaccgttaccgtaacccgtacccgttaccccgaaacccggtaaccggggtccccgtaaccggttacccgggtttacccccgtttcccccggtccgggtacccccggttccccggtccgttacccggacccggtaaccgggaccggtaccccgtacccggtacccggagtaacccggtaccgacccggtacccggg

SEQ ID NO: 115825 - DNA, 524 bp, Homo sapiens
  misc_feature: GYAE6OF02FFCZ2.37.34.D01.1.454.CMB.1.raw
  modified_base (401)..(401): a, c, t, g, unknown or other
  misc_feature (401)..(401): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctatttttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctgggagtggggtggccaacatacaggggaggtggtgggtacgaaaaactatgtggactctgtgcggggccgattcacntctccagagacaacgaccaaaaactcactgtatctgactaaatggacgcctgaganccgagacaggcttgntattntgtgcgagagtattagactaacaagtttcgagtgacgtggtatgatg

SEQ ID NO: 115826 - DNA, 553 bp, Homo sapiens
  misc_feature: GYAE6OF02JE3EF.37.34.D01.1.454.CMB.1.raw
  modified_base (374)..(374): a, c, t, g, unknown or other
  misc_feature (374)..(374): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgcagtctccgagggaggggctgggagtgggtggccaacgatacgaggggaggtggtaggtaacgaaaaacgtntggtggactcgtgtggcggggccgattccacctatcctaccagacgacaacgaccaaaaactcactgtactctgacaaatcggaacgcctgacgatccggagaccgacggtctgtagtattagttgtgcgagacgtatttagacttaacgtaagtttcgagtgtacgtggtatgtatcg

SEQ ID NO: 115827 - DNA, 529 bp, Homo sapiens
  misc_feature: GYAE6OF02FJ13U.37.34.D01.1.454.CMB.1.raw
  modified_base (474)..(474): a, c, t, g, unknown or other
  misc_feature (474)..(474): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaacttttggtagctattggatgggactggggtccgccagtctccagggaaggggctgggagtgggtggccaacatacaggggaggtggtgggtaacgaaaaactatgtggactctgtgcggggccattcaccatctcagagacaacgaccaaaaactcactgtatctgacaaatggacgcctgagactcgaggacacggctgtntattattgtgcgagagtattagactacgtaagtttcgagtgacgtggtatgatcg

SEQ ID NO: 115828 - DNA, 830 bp, Homo sapiens
  misc_feature: GYAE6OF02JZ0TA.37.34.D01.1.454.CMB.1.raw
  modified_base (238)..(238): a, c, t, g, unknown or other
  misc_feature (238)..(238): n is a, c, g, or t
  modified_base (304)..(304): a, c, t, g, unknown or other
  misc_feature (304)..(304): n is a, c, g, or t
tcagtagtgtagatcacgaccggtgctcgatttagatcgtctgtgttgggtttgggggcaggagtcagacccactcaggacacagcatggacatgagggtccccgctcgagctcctggggctcctgctgctctggctcccaggtgccagatgtcgccatccaatcgacccagtcctccatcccgtcctgtcctagcatcgtggtagagacagacgtccatcactcgacttggccgganaagtcgaggcagttagaatcgtattaaggctaggactacgacgacgaacgaaaccgacgggaaacnccccgtaagcctacctcgaacttcgttaacgtcgggtactacctaacgttaccgtaacgtttaacgaaccggtttacggggttacccctaaagtttaacgtacctttaaccggaacggtccggtacgtaaggtacggtaaacttcccgggttcgggaacttaaccgtaaggttacctttccaaaccggtttcctaacctaaccgtacgttaaccgacgtacctaaccggttccgtacggtaacccgtacggttaccgtttaaggtaaacgtttaccgttttaccggaaaccctttaacggttttaaaccttaacccgtttacgttaacccgttaaacgttaaaccggttaacctttaaacccggttaaccgtttaacccccgggttaccgggtttaacccgggttaaccggttaaccccgggtaaaacggggttaaaccccgttaacggtaaccgggttaaccgtaaacccggtaaaccgttacgggttacgtaccggggtacccttaccggtaccctttaaccgg

SEQ ID NO: 115829 - DNA, 299 bp, Homo sapiens; identical to SEQ ID NO: 115675
  misc_feature: GYAE6OF02GR7O9.37.34.D01.1.454.CMB.1.raw
  modified_base (295)..(299): a, c, t, g, unknown or other
  misc_feature (295)..(299): n is a, c, g, or t

SEQ ID NO: 115830 - DNA, 295 bp, Homo sapiens
  misc_feature: GYAE6OF02H6YH0.37.34.D01.1.454.CMB.1.raw
  modified_base (288)..(288): a, c, t, g, unknown or other
  misc_feature (288)..(288): n is a, c, g, or t
  modified_base (294)..(295): a, c, t, g, unknown or other
  misc_feature (294)..(295): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagccggccctgggctgcctggtcaaggactactcatctacactactgagcgggctggcaaggcncatagnn

SEQ ID NO: 115831 - DNA, 537 bp, Homo sapiens
  misc_feature: GYAE6OF02HKN0B.37.34.D01.1.454.CMB.1.raw
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (369)..(369): a, c, t, g, unknown or other
  misc_feature (369)..(369): n is a, c, g, or t
  modified_base (488)..(488): a, c, t, g, unknown or other
  misc_feature (488)..(488): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctggattcaactttggtagctattggatggactgggtccgcagtctccgagggagggctggagtgggngccaacntacgagggagtggtagtaacgaaaaacgtntgtggactgtgtggcggggccgtatccacctatcctccgagagaacaacgaccaaaactcactgtatctgacaagtggacgctgagacgtacgaggacacggcgttgtgtattagttgngcgagagtattacgactaacgtaagtttcgagtgtacgtggtatgatcg

SEQ ID NO: 115832 - DNA, 542 bp, Homo sapiens
  misc_feature: GYAE6OF02FJVFV.37.34.D01.1.454.CMB.1.raw
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccccgagactctcctgtgcagcctctggattcaactttggagctattggatggactgggtccgccagtctccgagggagggctggagtggggtggccaacatacgagggaggtggtggtaacgaaaactntgtggactcgtgtgcggggccattcaccntctcagagacaacgaccaaaactcactagtatctagacaaagtcgggacggcctgacgatccgaggacgacggctgtgtattagttgtgcgagagtagtttaagacttaacgtaaagtttcgagtgacgtaggtatgtatgtac

SEQ ID NO: 115833 - DNA, 670 bp, Homo sapiens
  misc_feature: GYAE6OF02JCWGJ.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaggtgtccagtgtgacgtgcaactggtggagtcgtgggggaggcttggtccagcctggggggtccctgagactctcctgtgcagcctctggattcaactttggtagcttattggagtggactgggtccgccgagtcctaccgaggggaagggctgggagtgggtgaccaacatacgaggggaggtggtagggtaacgaaaactagtggtaggactgtggtggcgggggcccgtaagtttcccgacctacgtcctaccgaaggtaacgaaccgaaaccgaacccgaaaaactcaaccgtagtaacgtcttacgacgaaagttcgggaaccggtccgtaggaacgtacgtacccggaagggaaccgtaaccgggtccttagggttagttacgtttagttagggttagacggtaaggtaacggttagttttaacgtaacttaacgttaaacggtttcggaaggttaggtaccggttaggttacgttaggtagttacgg

SEQ ID NO: 115834 - DNA, 535 bp, Homo sapiens
  misc_feature: GYAE6OF02G960B.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggagctattggatggactgggtccgccagtctccagggaagggctggagtgggtggccaacatacgagggaggtggtaggtaacgaaaaactgtgtggactcgtgtggcggggccgagttcaccatctccagagacaacgaccaaaactcaactgtatctagacaaagtcggacgcctgagacgtccgaggacacggctgtagtattattgtgcgagagtatttagactaactaagttgagtgactggtatgatcg

SEQ ID NO: 115835 - DNA, 615 bp, Homo sapiens
  misc_feature: GYAE6OF02F7S0T.37.34.D01.1.454.CMB.1.raw
  modified_base (259)..(259): a, c, t, g, unknown or other
  misc_feature (259)..(259): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
tcagtagtgtagatcacgaccggtgctcgatttagatcgtctgtgttgggttttccttgttgctattttagaaggtgtccagtgtgacgtgcaactgttggagtctgggggaggcttggtacagcctgggggggtccctgagactctcctgtgcagcctctggtttcatctttagcaactacgccatgagctgggtccgccaggctccgagggaagggctggagtgggtctcaggtattactggtagtggtaataccgnatactacgcagactcgtgacgggccggttcaccgtctccagagacaattccaagaatacggtctatctaggaaatgaacagcctaggagagccgaggacaccggcctctattacngtgcgagagntcgaagacggagtaatagcagcagctctgactacgtcgggacccgaccggaaccgtcggtaccaccggttcctcccgtacacgcctcccaaccgaccgggaccctagtcccggtacccttcccccgtcggaccctaccccgtaccctaccgaacggaccgcccgtaaccttcccgggtcggggaccacggaccggccggcccggtgggaccgtccggtcccggttaccggg

SEQ ID NO: 115836 - DNA, 631 bp, Homo sapiens
  misc_feature: GYAE6OF02IE3MP.37.34.D01.1.454.CMB.1.raw
  modified_base (614)..(614): a, c, t, g, unknown or other
  misc_feature (614)..(614): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctatttttagaaggtgtccagtgtgacgtgcaactgggtggagtcgtggggggaggtcttgggtccagccgtggggggtccctgagactctcctgtgcagcctctggattcaactttggagcttagttggatggacgtgggtcccgccaggtctccgagggggagggcgtgggagtggggtcgaccaaacagtacgaggggaggtggtacggtaacgaaaaacttgtggtggacttcgtggtagggccggggaccgtattaccgacctagttcctccgaaggtaacgaaccaaacccgaaccaaaaacctccaaccttagtaacttacttacgaacgtaaacgtgggaaccggctaggaagtacgtccggaaggacccgacgggtcttgttagttaattagttgtcggacgaggtagtagtttaacgtactaacgtaacgtttgagtntacgttggtatgtatcg

SEQ ID NO: 115837 - DNA, 616 bp, Homo sapiens
  misc_feature: GYAE6OF02HBIF2.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttggtccaggccgtggggggtccctggagactctcctgtgcacgcctctggattcaactttggtagctattggatggacgtggggtcccgccagtcctccgaaggggaaggggcgtgggaggtggggtcggccaacgagtacgaggggaggtggtaggtaacgaaaaactgtggtaggactcgtggtgggtccggggaccgtagttccgaacctacgtcctaccaggacgaacaaaccgaaccaaaaactcactagtactcgtgactaaagcggacgcctaggacgacgtaccggagaccgacggtcgttgtagttaatttgtgtcgagagtaggtatttaaggaacttaacgtaaggtttacggagttacggtacgttaggtattgtattacgg

SEQ ID NO: 115838 - DNA, 669 bp, Homo sapiens
  misc_feature: GYAE6OF02JBBA6.37.34.D01.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
tcagtagtgtagatcacgaccggtgctcgatttagatcgtctgtgttggggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtagganacagagtcatcatcacttgccggnaagtcgaggctatagaaatgtatttaggctggtatcagacaagaaacaagggaaacgccctaagctacctacgattactatgtgacactccgtaagtttacaaacgtcgggttaccctagttaaacgtattacacggacggtctagggtaggtacttccgtaggaccgtaactaagttaacgtttctaacccgttccttaacgtaccctagtaccgacgtccgtaacgggaccctcggacgtaccgtccgttacggtaaacgttagttttacgaacttaaacgttttacttacgttaccgttacgttaactaaacgtaactttaaaccttaactttaacccgtacggtttaccggttaccgaccggtaacgggaaccgtagggtaacggaacgttaaccgtaaaacgttaccgtacggtacggtaccgtacggactaacccgg

SEQ ID NO: 115839 - DNA, 711 bp, Homo sapiens
  misc_feature: GYAE6OF02H7YR4.37.34.D01.1.454.CMB.1.raw
  modified_base (295)..(295): a, c, t, g, unknown or other
  misc_feature (295)..(295): n is a, c, g, or t
  modified_base (321)..(321): a, c, t, g, unknown or other
  misc_feature (321)..(321): n is a, c, g, or t
  modified_base (362)..(362): a, c, t, g, unknown or other
  misc_feature (362)..(362): n is a, c, g, or t
tcagtagtgtagatcacgaccggtgctcgatttagatcgtctgtgttgggtttgggggtcgtcagagaggagccttagccctggactccaaggcctttccacttggtgatcagcactgagcacagaggactcaccatggaattggggctgagctgggtttcctgttgctatttagaaggtgtccagtgtggacgtgtcaactggtggagtcgtgggggagcttggtccagccgttggggggtccctaggagacctctccgtagtcgcagcctctaggtacttctaacgtttggancttagttggactggtactgggtcccnccaggtcctaccgaggggtacgggcttaggggagttggggngacccgaaagacgtaacggaggggtagggtgggtaagggttaaaccgaaaaaacgttgtaggtaggaccttggtaggttcgggacggggtaccggatttaccgacctaatccgtaccgaggaacgaaccctaaacggaaacctaaaaaccgctaacctaggtaactaccgttagaactaaacgcgggtaacgaccgttagaaccgagttacccggaacgggaccaacgggtactcggtttaggtaatttacggttagttacgaccgggtaagttacgtaagtttaaccggactaaacgttaaaggtttacgtaggtcggtaacgttaagggtattaccggagttaccgg

SEQ ID NO: 115840 - DNA, 587 bp, Homo sapiens
  misc_feature: GYAE6OF02HEL7M.37.34.D01.1.454.CMB.1.raw
  modified_base (326)..(326): a, c, t, g, unknown or other
  misc_feature (326)..(326): n is a, c, g, or t
  modified_base (390)..(390): a, c, t, g, unknown or other
  misc_feature (390)..(390): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaagggctggagtgggtggccaacatacagggaggtggtggtaacgaaaaactatgtggactctgtgcggggccgattcacatctccagagacaacgccaaaaactcactgtatcngcaaatggacgcctgagatccgagacacggctgtgtattattgtgcgagagtatttagaactanaaagtttcgagtgtactggtatagatgtacttagtgacttaccggtggggaccgaaaggggacctagtggtccgaacgttccttcttcgacgtccctaccaaccgaacgggccctagtcccgttcccttccccgtgggcccgtcccgtcgtcctcccgaggacgcctacccgtccggaggtaccgacgactaccggg

SEQ ID NO: 115841 - DNA, 680 bp, Homo sapiens
  misc_feature: GYAE6OF02H2E0F.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtcccagcccgtggggggtccctgagactctcctgtgcagcctctggattcaacttttggtagctattggatgggactgggtccgccagtctccgaggggaagggggctgggagtgggtggccaaacatacgaggggaggtgggtggtaaacgaaaaactagtggtggacttctggtggcggggccgattccacatctccagacgacaacgaccaaaactcactagtatctgacaagtggacgctgagatccggagacacggctgtgtattagtgtgcgtagagtattagactaacgtaagtttcgagtagtacgtaggttagtagtagttgtacgttagtacggtacgttaaccgggtacggggtaaccggaaacgggaaccgtacgtacgggtacctacccggttaccgtttaccgttaccgaaccgtaccctacccgaacccgaaaccggggtcccaacggttccgttcccgttcccccgtcggcccggtcccgtacgaccgtaccggtaaccggccgtaccgtacccgtaccggacgtaacgcccgtaacgacccggg

SEQ ID NO: 115842 - DNA, 640 bp, Homo sapiens
  misc_feature: GYAE6OF02HPCF7.37.34.D01.1.454.CMB.1.raw
  modified_base (338)..(338): a, c, t, g, unknown or other
  misc_feature (338)..(338): n is a, c, g, or t
  modified_base (371)..(371): a, c, t, g, unknown or other
  misc_feature (371)..(371): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccagcctggggggtccctgagactctcctgtgcagcctctggattcaactttggtagctattggatggactgggtccgcagtctccagggaagggctggagtgggtgccaanagtacgaggggaggtggtggtaacgaaaaactntaggtggactctgtggcgggggcctattcaccatcctacctagagtaacgaaccgacccaaaaaactcaaccgtgtaatccttagacctaaaagttacgggaaccggcctagaacgagttacccggagggtaaccgaccgggcgtagttacgttaaattagtttacgtgggacgtaaggtaacggtaagttttaacggaactttaaacgtaaaacggttttaccgtaagggtttacgaaccggtttagggtaactttagggatttacgg

SEQ ID NO: 115843 - DNA, 523 bp, Homo sapiens
  misc_feature: GYAE6OF02HFBBS.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttgccgggcaagtcagggcattagaaatgatttaggctggtatcagcagaaaccagggaaacgcccctaagctcctcatctatggtgcatcctagtttacaaactcgggtacccattaagattcagcggcagtggatcgtggcacagtatttcactctcaccatcagcacgcctgcacgcctgtaagtatttgactaactttattactcgtactaactaagtaacttaactaactttaccctacgtacgttcggaccgaacgggaccaagggtagaacgtacgaacgacgtgtggctacgctaaccg

SEQ ID NO: 115844 - DNA, 627 bp, Homo sapiens
  misc_feature: GYAE6OF02FF5W0.37.34.D01.1.454.CMB.1.raw
  modified_base (262)..(262): a, c, t, g, unknown or other
  misc_feature (262)..(262): n is a, c, g, or t
  modified_base (423)..(423): a, c, t, g, unknown or other
  misc_feature (423)..(423): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggagggctggagtgggtggccaacatacagggaggtggtggtacgaaaaactntgtggactcgtgtggcggggccgattcaccatctccagagacaacgccaaaaactcactgtatctgacaaatggacggctgagactccgaggacacggctgtgtattatgtgcgagagtatttagacttaacaagtttcgagtgactgtatgatgtcttangtagttaccgtcgggaccgaacggggacctagtcggtaccgtacccgttctcgtttccacgtcccctaccgaacccgaacgggacccctacgttaccggttccctttacccccggtcggtacccgtcccccgtacgtccccgtacccggacgggtaccgccgtaaccccggttcccgaacgggacgtacccgaacgtacccggg

SEQ ID NO: 115845 - DNA, 694 bp, Homo sapiens
  misc_feature: GYAE6OF02HR997.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaacgtggtggagtcgtgggggagcttggtccagccgtgggggtccctgacgactctcctgtgcagcctctggatttcaacttttggtagcttagttggatggactcggggtcccgccgtagtcctccgaggggaacggggcgtgggaggtggggtgaccaaacgtagtacgaggggaggtggtacgggtaaacgaaaaaacgtgtaggtacggaacttcgtggtgggccgggggtaccgtacgtttaccgaacccgtacttccgtacccgaaggtaacgaacccaaaccggaaccctaaaaaaacgtccaaacgttgttaactcgtacgactaaagtcgggaaccggtcctaggacgtacgtaccggacggaccgacggcgttacgttgttaaactttagttggtacggacgtaaggtaacgttagttttaacgaaacgttaacgttaaacggttttacggaagtttacggacgtttagggtaatttgagtttcgg

SEQ ID NO: 115846 - DNA, 721 bp, Homo sapiens
  misc_feature: GYAE6OF02IQZNZ.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattgggctgagcgttgggttttccttgttgcttattttagaaggtgtccagtgtgacgtgacaactggtggagtcgtgggggagtcttggtccagccgtgggggtccctgagactctcctgtcgcacgcctctggacttcgtaactttggtagtctagttggatggacgttcgggtcccgcctagtctaccggaggggaaggggctagggagtgggtcgaccaagtacgtacgagggcggttggtacggtaaacgtaaaaacgtgtaggtcggactcgtaggtcggaccggggcgtataccacctagtaccgtaccgaagaacgtaaccgaaaccgaaacccgtaaaaaacttccgaaccgttacgttaacttaccgtaacggtaacctaaacggttcgggaacccggtacccgtaggaaccgtaacggttaccggaacggtaaccggtaaccggtccgttaggttaacgttagttttaacgttgtacggaccgtaaggtagttaagttttaacgaactttaaaccgtaaaggttttacgaacggttacgtaccggttaggttaacgttacggtatttaacg

SEQ ID NO: 115847 - DNA, 544 bp, Homo sapiens
  misc_feature: GYAE6OF02HH0J5.37.34.D01.1.454.CMB.1.raw
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttggtccagccgtggggggtccctgagactctcctgtgcagcctctggattcaacttttggtagctattggatggactgggtccgccagtctccgagggaggggctggagtgggtggccaanatacgaggggaggtggtggtaacgaaaaactntgtggactcgtgtgcggggccattcacatctccagagacaacgaccaaaactcactgtatctagacaaagtggacgctgagactcgagacacggctgtagtattagttgtgcgtagtagtattacgacttaacgtaagtttcgagttacgacgttaggtatagattacg

SEQ ID NO: 115848 - DNA, 626 bp, Homo sapiens
  misc_feature: GYAE6OF02GPM0I.37.34.D01.1.454.CMB.1.raw
  modified_base (198)..(198): a, c, t, g, unknown or other
  misc_feature (198)..(198): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccnccagtctccagggaaggggctgggagtggggtggccaacatacgagggaggtggtggtaacgaaaaactatgtggactctgtgcggggccgattcaccatctccagagacaacgaccaaaaactcactgtatctgacaaagtggacggcctgagagtccgagacacggctgtgttattagttgtgacgagagtatttagactaacgaagtttcgagtagacgtggtatgatgtacttagtgacgttaaccggtggggacccgaaagggaccctagtcgggtacccaccgttccttacttccgacgtccctacccaccgaaccggtcccaacgttcccggtccctttccccgacggtcccgccccgttacgcccgtaccggaaccggtacgcccgtacccgtaccgaacggacgaccgtaccgaccggg

SEQ ID NO: 115849 - DNA, 669 bp, Homo sapiens
  misc_feature: GYAE6OF02H8ZEN.37.34.D01.1.454.CMB.1.raw
  modified_base (301)..(301): a, c, t, g, unknown or other
  misc_feature (301)..(301): n is a, c, g, or t
  modified_base (505)..(505): a, c, t, g, unknown or other
  misc_feature (505)..(505): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgcttattttagaaggtgtccagtgtgacgtgcaactggtggagtcgtgggggagcttggtccagccgtggggggtccctggacgactctcctgtgcacgcctctggacttctaacgtttggtagtcttattggntgggacttgggtcccgctagttccgtccgaggggaaggggctcgggagtggggtcggcctaaacgagtacgaggggagggttggtacggtaaacgaaaaactgtggtaggacctcgtggtcgggccgggggccgtattccacctattccgtaccgaagacgaaccgaaacgaaacccaaaaactccaactgttactcgtacganaaagtcggacgccgtaggacgacgtaccggaacggaccgacggtcgttagttagttagttttaacgttgtacggtacgaacggtaaggttacgttttaacggaaccttaacgttaaacggtttacggtaggttacggtacgttaggttagttaggtagttacgg

SEQ ID NO: 115850 - DNA, 600 bp, Homo sapiens
  misc_feature: GYAE6OF02IHFAF.37.34.D01.1.454.CMB.1.raw
  modified_base (338)..(338): a, c, t, g, unknown or other
  misc_feature (338)..(338): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagcccgtggggggtccctgagactctcctgtgcagcctctggattcaacgttttggtagctattggatggactgggtccgccagtctccgagggagggctggagtgggngccaacatacgagggaggtggtaggtaacgaaaaacgtatgtggactcgtggtgcggggccgtattcgaccatcctaccagagaaccaaaccgaccctaaaaactccaacttagtacttctgaccaaagtcgggaacgccgtagagacgttaccggacggacaccggtcgttaggtgttaatttagttggtgacgaggtagtaagtttagaacgttaactaacggtttacgagttaggaacgttggttaactggtattacgg

SEQ ID NO: 115851 - DNA, 301 bp, Homo sapiens
  misc_feature: GYAE6OF02GYLBK.37.34.D01.1.454.CMB.1.raw
  modified_base (272)..(272): a, c, t, g, unknown or other
  misc_feature (272)..(272): n is a, c, g, or t
  modified_base (296)..(301): a, c, t, g, unknown or other
  misc_feature (296)..(301): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaaggcccatcggtcttccccctggccgccctgctccaggagcacctccgagagcacagcggccctgggctgcctggtcaaggactactccatctacactacngagcgggctggcaaggcgcatagnnnnnn

SEQ ID NO: 115852 - DNA, 619 bp, Homo sapiens
  misc_feature: GYAE6OF02H4WO5.37.34.D01.1.454.CMB.1.raw
  modified_base (340)..(340): a, c, t, g, unknown or other
  misc_feature (340)..(340): n is a, c, g, or t
  modified_base (392)..(392): a, c, t, g, unknown or other
  misc_feature (392)..(392): n is a, c, g, or t
  modified_base (447)..(447): a, c, t, g, unknown or other
  misc_feature (447)..(447): n is a, c, g, or t
tcagtagtgtagatcacgaccggtgctcgatttagatcgtctgtgttgggtttttccttgttgctattttagaaggtgtccagtgtgacgtgcaactggtggagtctgggggaggcttggtccagcctggggggtccctgagactctcctgtgcagcctctggattcaacttttggtagctattggatggactgggtccgccagtctccgaggggaaggggctgggagtgggtggaccaacatacgaggggaggtgggtaggtaacgaaaaactagtgtggaactcgtgtggcggggccgattcaccatcctcagagacaacgaccaaaactcactgtanctgacaagtcggaccgcagacgactccgaggacacggtctgtgtattattgngcgagatattagactaacgtaagtttcgagtgtacgtaggtatagtatgtcttangtaactacgttcgggacaagggaccagtcggtacctacgttctccttacgaccgtaccctaccgaaccgtaccggccctacgttacccgtcccttaccccggcggtcccgcccgtcgtcccgacccgtacggacgtccctacccgaccggaaggaccgacgaccgtaccggg

SEQ ID NO: 115853 - DNA, 584 bp, Homo sapiens
  misc_feature: GYAE6OF02ITZFM.37.34.D01.1.454.CMB.1.raw
  modified_base (267)..(267): a, c, t, g, unknown or other
  misc_feature (267)..(267): n is a, c, g, or t
  modified_base (435)..(435): a, c, t, g, unknown or other
  misc_feature (435)..(435): n is a, c, g, or t
  modified_base (512)..(512): a, c, t, g, unknown or other
  misc_feature (512)..(512): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtcccagcctggggggtccctgagactctcctgtgcagcctctggattcaacttttggtagctattggatggactgggtccgccagtctccagggaaggggctggagtgggtggccaacatacgagggagtggtggtaacgaaaaactntgtggactctgtgcggggccgattcaccatctccagagacaacgccaaaaactcacttgtactcgtgacaaagtggacggcctgagatccgaggacacggctgtgtattattgtgcgaagatagtttagacttacgaagtttcgagtacgactggtatgatgacttangataccgtgggaccaacgggcagtcgtcacgtctctcgactccgtccaccgacggcccagtccgtcccttaccccgnggccccgtcccgtcggtccctccgacgggacgacccgttaccgtaccggaacgacggtccgacgtacccggg

SEQ ID NO: 115854 - DNA, 665 bp, Homo sapiens
  misc_feature: GYAE6OF02HA9KP.37.34.D01.1.454.CMB.1.raw
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatccctccctgtctgcatctgtaggagacagagtcatcatccacgttcgccgggacaagtcgagggactattaagaaattagtagtttaggcgtaggtatcgagacgaacgaaaccgaggaaccgaccctaagcctacccgnactctagtggtanactacgtccgtaagtttaacaacggttcgggtacctaagttaagacgttacgaggaccggtagtacggtaggtactccggtagactaacgtacgtactttacccacgttcctaactacctaagtacaacgtctaacgtcccgtagacgtacgtaccgtaagtaagttaccttttaaggaaccttaaacttttacgtttacttaagttacctaacggtaacttaacgtttaacctaaaccttcccgtaagttacggtaccggaaccggtaaggaacccggtaaggtaacggaacttaacgtaaacggtaccttggtacggcttaccggactaaccg

SEQ ID NO: 115855 - DNA, 604 bp, Homo sapiens
  misc_feature: GYAE6OF02IM3K9.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtcgtgggggaggcgttggtccagccgtgggggtcccgtgagactctcctgtgcagcctcgtggtattctaacttttggtagctattggatggacgtgggtccgccagtcgtccgaggggagggcgtgggaggtgggtcggccaacagtacgaggggagggtggtagggtaaacgtaaaaacgtagttggtaggacttcgtggtcggccgggggaccgtagttccacccgatcctaccgaagacgaaccaaaccgaaccctaaaaactcaactgtactcgtgacaaagtcggacgtcctagagacgtccggaggaccgacggctgttagttattagttgtagcgtaagtgtaatttacgacttaacgtaagtttcgagtacgttacgtggtaatgatcg

SEQ ID NO: 115856 - DNA, 813 bp, Homo sapiens
  misc_feature: GYAE6OF02I2OZU.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgagcgttgggttttccttgttgcttattttagaaggtgtccagtgtgacgtgacaacgttggtggaggtcggtgggggaggtcgtttgggtccgaggtcccggttcgggggggttcccctagggacgtaccgttccgttccgtggtcgacgtacgtcccttcgtggtattaccgtaacgttttgggtaagtccttagttggagttcgggacgttcggggtcccgccgagttccgtaccggaaggggaacggggtcgtagggtaggttcggggtcggacctaaacgtagtaaccggagggggtagggttaggtacgggtaaaacgtaaaaacgttagttaggttcgggtaaacttcgtagggttcgggacccgggggtaccgtaacgttaccgaacccgtattcccgtaccgaaggtaaacggaaaccaaacggtaaacccctaaaaaaccgtccttaaaccgtacggttaacttaccggtacgtaaaaccgtaaaggtcgggtaacccggtaccgttaaggacgtaaccgtaaccgggacggaaacgtacccggtacgtttggtagtttaattacgttggtacgacggtaggtaacgtttaagttaaccgtaacgttaacgtaacgttttacgacggtagtaacggttaggttagtagtaacgttg

SEQ ID NO: 115857 - DNA, 303 bp, Homo sapiens
  misc_feature: GYAE6OF02FIHOJ.37.34.D01.1.454.CMB.1.raw
  modified_base (291)..(291): a, c, t, g, unknown or other
  misc_feature (291)..(291): n is a, c, g, or t
  modified_base (297)..(303): a, c, t, g, unknown or other
  misc_feature (297)..(303): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctgggcctgtccctggtcaccgtctcctcagcctccaccaagggcccatcggtcttccccctggcgccctgctccaggagcacctccgagagcaccagcggccctgggctgcctggtcaaggctacttccatcctacactactgagcgggctggcaaggcncatagnnnnnnn

SEQ ID NO: 115858 - DNA, 772 bp, Homo sapiens
  misc_feature: GYAE6OF02IWJIB.37.34.D01.1.454.CMB.1.raw
  modified_base (238)..(238): a, c, t, g, unknown or other
  misc_feature (238)..(238): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctccaaggtgccagatgtgccataccaaatcgacccagtcctccatcctccctgtcctgcatcgtggtaggacgacagagtcatcatcacgttcggcccggganaagtccgaaggggactaagttaagaaagtgtaagtttagggaccgttaggtactacgaggacaaacggaaaaccgaagggaaaccgacccctaaagcctacctacactacgttatacgggtagacctactaccgttaacggtttaaccgtaaacggttccggggttaaccctaagtttaaacggtacttaccggacggtaccgggtacgtaggtaggtacttcggtacggaccaacgttacgtactttacccgaacttccgtaacctaaccactacgacgtaccgtacgtccgtacgcctacgtaccgtaagtaacgtttacgttttaacgaacctttaaactttaacttacgtacgtaaaccttaacgtaaagttaaccgtttaaactaacccgtttacccgttaaccggtttaccggtaccgggtaacccggtaaaacggggttaaccgtaacggggttaaccggtaaacccgttaaaccggtaaaacggttaccggttacggtaccggtaccgttacggaaccctaaccgg

SEQ ID NO: 115859 - DNA, 658 bp, Homo sapiens
  misc_feature: GYAE6OF02G7WFP.37.34.D01.1.454.CMB.1.raw
  modified_base (271)..(271): a, c, t, g, unknown or other
  misc_feature (271)..(271): n is a, c, g, or t
  modified_base (332)..(332): a, c, t, g, unknown or other
  misc_feature (332)..(332): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagccgtggggggtccctgagactctcctgtgcagcctctggattcaactttggtagctattggatggactgggtccgccagtctccgagggaaggggctggagtggggtggccaacatacgagggaggtgggtaggtaacgaaaaactntgtggactctgtggcgggccatcaccatctcagagacaacgaccaaaaactcactgtatcngacaaatggacggctagagactcggagacgacgctgtagtattattgtgcgagagtattagactaactaagtttcgagtgacgtaggtatgtatggtacttagtacgtactaccggtacggggacccgaaagggacctaaggttccggtacccgtaccgttccgttaccgttaccgtacgtaccctacccgaaccgtaacgggtacccctaacggtttcccgttaccccgtttccccgtccgggtcccgtccccgttacgaccgttaccccggaacggacgtacccgtacccctaccggtaacgaaccgtcccgaacggacccggg

SEQ ID NO: 115860 - DNA, 622 bp, Homo sapiens
  misc_feature: GYAE6OF02IZOJR.37.34.D01.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (268)..(268): a, c, t, g, unknown or other
  misc_feature (268)..(268): n is a, c, g, or t
tcagtagtgtagatcacgaccggtgctcgatttagatcgtctgtgttgggttttccttgttgctatttagaaggtgtccagtgtgacgtgcaactggtggagtctgggggaggcttggtccagcctgggggggtccctgagactctcctgtgcagcctctggattcaactttggtagctattggatggactgggtcccnccagtctccgaggggaaggggctggagtgggtggccaacntacaggggaggtggtggtaacaaaaactntggtgactctgtggcgggcattcaccatctccagagacaacgaccaaaaactcaactgtatctgacaaagtggaccgtcctgacgatccggaggacgacggctgtagttattagttgtgcgaagagtatttagactaacgtaagttcgagtgtacgtgtatgatgtacttagtcgactaccggtcgggccgaacgggtcctagtcggtacctaccgttcttccttcgacgtccctacccgaccgtaaccggccctacgttcccggttcccttccccggtcggtcccgtcccgtacgtccctaccggacggtaccgcccgacccggtacccggaggaccgccgtacggacccggg

SEQ ID NO: 115861 - DNA, 593 bp, Homo sapiens
  misc_feature: GYAE6OF02IBUTK.37.34.D01.1.454.CMB.1.raw
  modified_base (211)..(211): a, c, t, g, unknown or other
  misc_feature (211)..(211): n is a, c, g, or t
  modified_base (311)..(311): a, c, t, g, unknown or other
  misc_feature (311)..(311): n is a, c, g, or t
  modified_base (526)..(526): a, c, t, g, unknown or other
  misc_feature (526)..(526): n is a, c, g, or t
  modified_base (551)..(551): a, c, t, g, unknown or other
  misc_feature (551)..(551): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgttcagtgtgacgtgcaactggtggagtcgngggggaggcttggtccagccgtgggggtccctgagacctctcctgtgcagcctcgtggatttacaacgttttggacgcttattggatggactgggtcccncagtcctccgagggaagggctaggagtgggtgaccaaactatacgagggaggtggtagggtaacaaaaactgtgtaggactcgtggtgccgggggtcctagttccaacccgagttacctaccaggacgaaccaaccgaaaccaaaaactcaactgtaactcgtagacaaagtggacgctagacgtacgtacgacgacacggtctgttactagttnttcggagacgaaggtatagtttaanactaacgtaagtttcgacgtacgtacgttgtatacggatacg

SEQ ID NO: 115862 - DNA, 638 bp, Homo sapiens
  misc_feature: GYAE6OF02I18ZC.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgcttattttagaaggtgtccagtgtgacgtgcaactggtggagtcgtgggggagcgttggtccagccgtggggggtccctgagactctccgtgtgcacgcctcgtggattactaactttgggtatctagttggagtcggtcgtcgggtcccgccagttcctaccggagggacgggtctgggaggtgggtcgaccgaacagtacggagggtagtggtaggaaaccgtaaaatgtacgaggtactgtaggtcgggccggggacctctaccgaccagttccacgagacgaaccaaaccgaaccaaaactcacgtgtactcgtacaacgtaagtcgggacgtacgtggaacacgtccgaacggaccaagggtccttaggtattagttacgtagcggacgtaagacggtttaagttaccgtaaagttaacgtaaggtttacggtaacgtggtaaccgtagggtagtcgagttacgg

SEQ ID NO: 115863 - DNA, 622 bp, Homo sapiens
  misc_feature: GYAE6OF02JEUNU.37.34.D01.1.454.CMB.1.raw
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctggnttcaactttggtagcttattggatggactgggtcccgccagtcctccgaggggagggctgggagtgggtggccaanagtacgagggaggtggtaggtaacgaaaactgtgtaggactcgngtcggcggggccgattccgaccatcccgtaccgagaagaacaaccgaccaaaactcactntactcngtacaaagtcgggaccgtccgtggaacgacgtacccggaggaccgtacgggtcttaggtagttagttaagtttggtaggacgaggtacgttaagttttacggaaacctttaacgtaaacggttttacggagttacggtaacgttaggttaacttggtagttacgg

SEQ ID NO: 115864 - DNA, 561 bp, Homo sapiens
  misc_feature: GYAE6OF02FXBY9.37.34.D01.1.454.CMB.1.raw
  modified_base (298)..(298): a, c, t, g, unknown or other
  misc_feature (298)..(298): n is a, c, g, or t
  modified_base (452)..(452): a, c, t, g, unknown or other
  misc_feature (452)..(452): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattgggctgagctgggttttcctgttgctattttagaaggtgtccagtgtgaggtgcaattggtggagtctgggggagcctgtccagcctggggggtccctgagactctcctgtgtagcctctgaattccccttaggcttattggatgagctgggtccnccgaggctccgagggtagggctggagtgggtggccaacataaagcaagatggaagtaagaggagtatcgtaggactcgtagtgaagggccgtttacgaccctagtctccgagacgacaacgcaaagactcccgtgcatctagacaaagtcgaanagtcagacgacgcccggagaccgacggcttatttactacgtgcgcgagacgaaggacgtcgggacgtttacgagtacgcgggaccgtaacggaccctggtacctaccgg

SEQ ID NO: 115865 - DNA, 778 bp, Homo sapiens
  misc_feature: GYAE6OF02HI1G7.37.34.D01.1.454.CMB.1.raw
  modified_base (269)..(269): a, c, t, g, unknown or other
  misc_feature (269)..(269): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtggggggtccctgacgactctcctgtgcagcctctggnttcacgtttggagtcttagttggatcggtactcgggtaccgcctagttccgtaccggaaggggacggggtctgggagggtcggggtcggaccaacgagtacggaggggtacgggtggtacggggtaaaccgaaaaacgttgttacgggtcggaaccgttcgtgggttacgggccggggggtacccgtaacgtttccaaacccgtacgtaccgttaccggaaacggaacggtaaacccgaaaccggtaaacccctaaaaaaaccgttacctaaaccggtttacggttaacttaccgtacgtaaccgtaaaggtaccgggtaaccggtacccgtaggaacggtaccgtaaccgggaaccggtaacggaccggtacgttagggttacgttaaacgtttaggtttagttcggtacggtacggtaaggttaacgtttaacggtaaccgttaaacgttaacggttttacggtaacggttaccggtaacgttacgggttaactaggttagttacgg

SEQ ID NO: 115866 - DNA, 719 bp, Homo sapiens
  misc_feature: GYAE6OF02JMVQP.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctcgtggcctcccgaggtgccagagtgtcgccataccaaatcgacccagtcctccactccctccctgtctgctatctagaggagacagtagtacactacactctacgttcggaccggacgtaacgtccggaacggggtactaagttaagaaagttaggtagtttaacggcgttaggtactacgaacgacgaaacggaaaccggaaacgggaaacccgtaccccgtaacgtcctaccgtacctacgttacctaaggtacggtctaccgtacctaacgttaacgttaacgtaaccggtccggttaacctaattaacgtacgtcgacggacgtacgtacggtagtagtcggtacgtactatacgttactttacccgtaacctcctaaaccgtactaccgtacgaccggaccttaccgacgttcgaccgttaacgtacgttaagtacggtttactttcgtaaaccgtttaacgtttaaccactttaaccgtaactacgtaaacttaacgtaaaccttaccgttaacgtccgtacgtacgaccggtaaggtacctagggtaactaacgactaacgtcgtcgtaagctaccgactcg

SEQ ID NO: 115867 - DNA, 605 bp, Homo sapiens
  misc_feature: GYAE6OF02H1E51.37.34.D01.1.454.CMB.1.raw
  modified_base (439)..(439): a, c, t, g, unknown or other
  misc_feature (439)..(439): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttaggaggtgtcagtgtgacgtgcaactggtggagtcgtggggggaggctttggtccaggccgtggggggtccctggagactctcctgtgcagcctctggattcaacttttggtagctattggatggactgggtccgccagtctccgaggggaagggctggagtgggtcggaccaacatacgagggaggtggtgggtaacgaaaaactgtgtacggactcgtgtgcgggggcgtattcacctatctcagagaacaacgaccaaaaacncactgtatctagacaaagtcggacggcctaggacgaacgtacgaacgggacacgggcttaggtacgttattacgttggtcgacggtagtacggtaagttttaacgaaccttaacgtaaaacgttttccggaaggttcgttaacgttacgggtaattaggattacgg

SEQ ID NO: 115868 - DNA, 673 bp, Homo sapiens
  misc_feature: GYAE6OF02J2LYF.37.34.D01.1.454.CMB.1.raw
  modified_base (241)..(241): a, c, t, g, unknown or other
  misc_feature (241)..(241): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (371)..(371): a, c, t, g, unknown or other
  misc_feature (371)..(371): n is a, c, g, or t
  modified_base (444)..(444): a, c, t, g, unknown or other
  misc_feature (444)..(444): n is a, c, g, or t
tcagtagtgtagatcacgaccggtgctcgatttagatcgtctgtgttgggttttccttgttgctattttagaaggtgtccagtgtgacgtgcaactggtggagtctggggggaggcttggtccagccgtgggggggtccctgagactctcctgtgcagcctctggattcaactttggtagctattggatggactggggtccgccagtcctccgaggggaaggggctggagtgggtgccaanatacgagggaggtggtggtaacgaaaactntggngactcgtgtgcggggcattcacatctccaganacaacgaccaaaactcactgtatctgacaaagtcggacggccgtagagagtaccggaggtaccncggactggtgttagttatggtgacgaagtagtattacgactaacgtaagtttcgagtgacgttggtatgagtntacgttagtcgaacgtaccggtcggggacctaacgggacctacggttacggaccgtaacccgttccgttaccttcgacctaccccgttaccgaaacccggtaacgggaccccctagttaccccggttcccgtttacccccgagggtacccccgtccggtcgaccgttacccgggacggtaccggtacccacccggttaccgaacggtacccggccgacggtaacccggg

SEQ ID NO: 115869 - DNA, 698 bp, Homo sapiens
  misc_feature: GYAE6OF02FS9O0.37.34.D01.1.454.CMB.1.raw
  modified_base (154)..(154): a, c, t, g, unknown or other
  misc_feature (154)..(154): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcgnggtttcgtgtaggctatttagaaggtgtccagtgtgacgtgcaactggtggagtcgtgggggagtcttggtccagccgtgggggtccctgagactctcctgtgcagcctcgtaggtacttctaacgttggtagcttagttggatggtacgtggtcccgacctagtcctaccgaggggagggcgtagggacgtgggtcgacccaagtagtacggaggggaggttcggtaggtaaaccgtaaaacgtgtaggtagtacgttcgtagggtcggccggggtaccgtaacttccgaacgttacgtccgtaccgaaggacgtaacccaaccgtaaacccaaaaaccgttctaaccgttaggtaacttacgttacgaaccgtaaaggttaccgggtaacgtacccgttagacggtaacgtaccggtaggtacccgacggttccgttagtagttaaacgttcgttagtacgacggtaagagtttaacgttacgtaacgttaaccgtaagtttaccggacgttacgtacgtttacggaattcggtacttacgg

SEQ ID NO: 115870 - DNA, 617 bp, Homo sapiens
  misc_feature: GYAE6OF02GUO2T.37.34.D01.1.454.CMB.1.raw
  modified_base (379)..(379): a, c, t, g, unknown or other
  misc_feature (379)..(379): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggtattcaactttggtagctaattggatggactgggtccgcagtctccgaggggaaggggctgggaggtgggtcggccaacatacgaggggaggtggtggtaacgaaaactntggtggactcgtgtacggcggggccgtattccaaccatcctaccgagacgaaccaacgaacccaaaactccaactagtatctgacaaatggaccgcctagacgactaccggaggaccacgggtcctaggttacgtaatttagttagtggacggtagaggtaagttttaacgtaaccgttaaacgtaaaggttttaccggaaggttacggtaccgtttagggtaacttcggtattacgg

SEQ ID NO: 115871 - DNA, 301 bp, Homo sapiens; identical to SEQ ID NO: 115399
  misc_feature: GYAE6OF02GT7A7.37.34.D01.1.454.CMB.1.raw
  modified_base (295)..(301): a, c, t, g, unknown or other
  misc_feature (295)..(301): n is a, c, g, or t

SEQ ID NO: 115872 - DNA, 580 bp, Homo sapiens
  misc_feature: GYAE6OF02F0EBB.37.34.D01.1.454.CMB.1.raw
  modified_base (457)..(457): a, c, t, g, unknown or other
  misc_feature (457)..(457): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtcccctgagactctcctgtgcagccctctggattcgaactttggtagctattggatggactggggtccgccagtctccgagggaggggctgggaggtgggtgccaacgatacgaggggaggtggtaggtaacgaaaaactagtgtggaactctggtcggccggggccgtattccaccgatctccagacgaacaacgaccaaaaacgtcactagtactngacaaatcgggacgctagacgagtaccgaggaccgacggcttgtagttattattgtagtcgaaggagtaatttaacgaactaacgtaaggtttacgaggttagacgtgggtactgtattacgg

SEQ ID NO: 115873 - DNA, 661 bp, Homo sapiens
  misc_feature: GYAE6OF02IJO35.37.34.D01.1.454.CMB.1.raw
  modified_base (362)..(362): a, c, t, g, unknown or other
  misc_feature (362)..(362): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgcttattttagaaggtgtccagtgtgacgtgcaacgtggtggagtcgtgggggagcttggtccagccgtgggggtccctgagctctcctgtgcagcctctggtattcaacgttttggtagctattggatggacttgggtcccgccaggtcctccgaggggaggggctgggagtgggtggccaagatacgagggnggtggtaggtaacgaaaaactgtgtaggactcgttggcggcggggtccgagtttccaacctagttccctaccgaagaacgaaccaaaccggaccctaaaaaactcctaaccgtacgttactacgttacgaactaaacgttcgggacccgggtaccgtagaacgtacgtacccggaggacccgaacgggtcgttgttacggttaatttaacgtttggtaggtcggtaagtaaggttaatttaacgaaccttaaacgtaaaggttttcgaagttacgtacgttaggtacttaggattacgg

SEQ ID NO: 115874 - DNA, 556 bp, Homo sapiens
  misc_feature: GYAE6OF02GTZLW.37.34.D01.1.454.CMB.1.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttgccggnaagtcgaggctagttagaaatgtatttagctaggtactcagcaagaaaccgagggaaacnccctaagcctcctnatctatgtcnctatctagttacaacgtcggtaccaattagatcaggcgactagtgatcgtgaccagagtacttacactctacactatcagctacgcctgacacgcgtagtaagttctttacgacttaactttattacctagttactaactaagtactttaacgtaaccttacccgttacgtacgttaccggaccggtaaggtaaccgtaaggtacggtaacgtacgaaacgtcgttcggtacgtccttacgacctacg

SEQ ID NO: 115875 - DNA, 779 bp, Homo sapiens
  misc_feature: GYAE6OF02GVYQ9.37.34.D01.1.454.CMB.1.raw
  modified_base (655)..(655): a, c, t, g, unknown or other
  misc_feature (655)..(655): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctatttagaaggtgtccagtgtgacgtgcaactggtggagtcgtgggggagtcttggtccaggccgtggggggtccctgagactctctgtgcagcctctggtattcaacgttttggagcttagttggatgggacgtcggggttcccgccgtagttccgtacccggaagggggaacgggggccgttggggtaacgggttgggggtcggaacccctaaacgtaacgttaaccggaagggggtagggttacgggttacgggtaaaaccggaaaaaacttggtaggtacgggaaccgtttcggttaggtacgggggcccggggggtaccgtaacgtttacccgaaccgtactaccgtacccgtaaggaacggaaacccaaacccggaaacccaaaaaaccgttcccgtaaacttcgtaacgttaccgttaacgacgtaaacggtcgggaaccgtaccgtaggactacggtaccggaacggtacgaccggtnttacggttagttacgttagttgtacggtacggtaacgtaaggttaacgtttaacggttaaccgttaaacgttaaacggtttccggtaaggttacggtacgttaggttaacgttagtagttacgg

SEQ ID NO: 115876 - DNA, 619 bp, Homo sapiens
  misc_feature: GYAE6OF02I6ON3.37.34.D01.1.454.CMB.1.raw
  modified_base (342)..(342): a, c, t, g, unknown or other
  misc_feature (342)..(342): n is a, c, g, or t
  modified_base (374)..(374): a, c, t, g, unknown or other
  misc_feature (374)..(374): n is a, c, g, or t
  modified_base (383)..(383): a, c, t, g, unknown or other
  misc_feature (383)..(383): n is a, c, g, or t
  modified_base (581)..(581): a, c, t, g, unknown or other
  misc_feature (581)..(581): n is a, c, g, or t
  modified_base (597)..(597): a, c, t, g, unknown or other
  misc_feature (597)..(597): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgagggaagggctggagtgggtggccaacatacgaggggaggtgggtggtaacgaaaaactgtggtggactctgtggcggggccgattccaccatctccagagacaacgaccaaaactcactgtatctgactaagnggaccgcctgagacgtcgaggacacggctgtntattattgngcgagtagtatttaagacttaactaagtttcgagtacgtactgggtatgatggtacttagtgtaatacccggtaggggacccaaaggggtcctaagttcggtcctaaccgttcttaccgtcgccgtccctacccgaacgtaaccgggccctacgtcccggttcccttccccgtggcccgtcccgttcgcccttccggnggtaccgccgtaaccnccggtaacgcgaccgacgccgg

SEQ ID NO: 115877 - DNA, 543 bp, Homo sapiens
  misc_feature: GYAE6OF02G2RAK.37.34.D01.1.454.CMB.1.raw
  modified_base (492)..(492): a, c, t, g, unknown or other
  misc_feature (492)..(492): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggtagctattggatggactgggtccgccagtctccgagggaaggggctggaggtgggtggccaacatacgagggaggtggtgggtaacgaaaaactataggtggactctggtgccggggccgattcacatctccagagacaacgaccaaaactcactgtatctgacaaatggacgcctgagagtccgaggacacggctggtagtattagttgtgngagagtagtttagaactaactaagtttcgagttagacgttggtatgtatgg

SEQ ID NO: 115878 - DNA, 623 bp, Homo sapiens
  misc_feature: GYAE6OF02IN9Y0.37.34.D01.1.454.CMB.1.raw
  modified_base (480)..(480): a, c, t, g, unknown or other
  misc_feature (480)..(480): n is a, c, g, or t
  modified_base (491)..(491): a, c, t, g, unknown or other
  misc_feature (491)..(491): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtccagtgtgacgtgcaactggtggagtcgtggggggaggcttggtccagccgtggggggtccctgagactctcctgtgcagcctctggattcaactttggtagctattggatggacgttgggtcccgccgtagtccgtaccgagggggaacgggggcgttaggggacggttgggggtcggacccaaacgtagtaaccgaggggtagggtggtagggtaaacgaaaaaacttgtggtaggacttcgtggtggcggggcgattccaccgtatcctccgagacgaacaaccgaccaaaacncaactgtatcngacgaagtcggacgcctaggagacgtccggaggaccgacgggtcttgttagttattgttgtagtcggaggtaacgtaagtttaacgaaccttaacgtaacgtttcggagttggtacgttaggtatgtatcgg

SEQ ID NO: 115879 - DNA, 677 bp, Homo sapiens
  misc_feature: GYAE6OF02JZ59M.37.34.D01.1.454.CMB.1.raw
  modified_base (524)..(524): a, c, t, g, unknown or other
  misc_feature (524)..(524): n is a, c, g, or t
tcagtagtgtagatcacgaccggtgctcgatttagatcgtctgtgttgggtttgggggtcgtcagagaggagccttagccctggactccaaggcctttccacttggtgatcagcactgagcacagaggactcaccatggaagttgggactgagcgtgggttttccttgttgcttatttagaaggttgtccgagtgtgacgtgcaactggtggagtcgtggggagcgttggtccagtccgtgggggtccctggacgactcgtcctggtgcacgtcctacgtggtattacgtaacgtttggtacgtctagttcggatcggtacgtcgggtaccgccgtagtcctaccgaggggtaacgggcgtgggaggtcgggtacgacccgtaaagagtaacgaggggtaggtggtacgggtaacgaaaaacgtgtaggtagtaaccgtcgtggtggaccgggtccgtaagttcccgactaacgtcgtccaacggtagaaaccaaccgaacgtaaaaacctcgtaactgtaacntacgacaaagtcggacgtacagaagtactacggaacgtacgaaccggtacgtagtacgtaattagttcgtagtaccggaagtaagttaacgttttaacgacgttaacgtaaacgtttgaacgtttcggaagtttaggtagtacgtagttacgg

SEQ ID NO: 115880 - DNA, 650 bp, Homo sapiens
  misc_feature: GYAE6OF02H3H28.37.34.D01.1.454.CMB.1.raw
  modified_base (330)..(330): a, c, t, g, unknown or other
  misc_feature (330)..(330): n is a, c, g, or t
  modified_base (462)..(462): a, c, t, g, unknown or other
  misc_feature (462)..(462): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtttgacgtgcaactggtggagtcgtgggggaggcttggtccagccgtggggggtccctgagactctcctgtgcagcctctggattcaactttggtagctattggatggactgggtccgccagtctccgagggaagggctggnggtgggtggccaacatacgaggggaggtgggtaggtaacggaaaaactgtaggtggactcgtggtggcggggccgattccaacctatctcagacgacaacgaccaaaaactccaactgtatctagactaaancgggtaacgccgtaggaacgtacgtacccggaacggacccgaacgggtccgtaggttacgttaatttaacgttacggttcgtacggtaacggtaacggttaagtttaacggtaaaccttaaaccggtaaacggtttttaccggaaggttacggtaacgttagggttaatacggttagttaggttaccg

SEQ ID NO: 115881 - DNA, 584 bp, Homo sapiens
  misc_feature: GYAE6OF02H9F6X.37.34.D01.1.454.CMB.1.raw
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtcgtgggggaggcttggtccagcccgtgggggggttcccctggagacctcctcctgtgcagcctctggattcaactttggtagctattggatggactgggtccgcagtctcgaggggagggctgggagtgggtcgccaacatacgagggnggtggtggtaacgaaaactntggtgactctggtggcggggcctagttacacatctcagacgacaacgaccaaactcactgtatctgacaagtcggacgtcctagacgactcccggagcgacggtctagttacgttattagttgtacggagaggtacgtaagttttacgaacgttaacgttaaacggtttacggacgtttacggacgttcgggtaattcggtacgttgg

SEQ ID NO: 115882 - DNA, 844 bp, Homo sapiens
  misc_feature: GYAE6OF02JSHAQ.37.34.D01.1.454.CMB.1.raw
  modified_base (788)..(788): a, c, t, g, unknown or other
  misc_feature (788)..(788): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttgggttttccttgttgtctattttagaaggttgtcagtgtgacgtgcaactggtggagtcgtgggggagcttggtccaggccgtcggggggtccctaggacgacctccgtcctggtgacgacgtcccttcgtggtactttaccgtaaaccgtttttgggtaagtccttaagtttacgggagtttacgggaccgttcgggggtacccccggtccgtaacggtttcccgttaacccggaaggggggtaaacggggggttcccgttggggggtaaacgggtttcgggggggttacggacccccgttaaaaacgtacggtttaaacccgggaagggggtaaccgggggtttagggtacgggggttaaaaccggtaaaaaaaccttgtttacggggtcgggtaaaccttccggtttagggtcgggtccgggggggaccctaagtttcccgaacccggtatttacccgtaccgaacggaaacgggtaaccaaaacccgggtaaccctaaaaaaccgtccgtaacgttagttaactccgttacgacgtaaacgtcgggacgtacccgtgaagcgtacccggacggaccgaacggtctaggttacgtaactttagttggacggtacgaggtacggtaagtttanaaaccgttataaacggtttgaacgtcggtaaccgtaggttaactaggtacttacgg

SEQ ID NO: 115883 - DNA, 765 bp, Homo sapiens
  misc_feature: GYAE6OF02J0GW0.37.34.D01.1.454.CMB.1.raw
tcagtagtgtagatcacgaccggtgctcgatttagatcgtctgtgttgggtttggggcgtcagagaggagccttagccctggactccaaggcctttccacttggtgatcagcactgagcacagaggactcaccatggaattgggctgagctgggttttccttgttgcttattttagaagttgtccagtgtgacgtgctaactggtgagtgtgggggagcgttggtcagccgtcgggggtccctggacgacgttccgtccgtgtagcctacgcccttcgtggtactttaccgtaacgttttggtacgtacgttagtttagggtagttacggaccgttgggggttcccccgccgtaagttccgtaccggtaaaggggggaaaccggggtcttacgggggacgggttcgggggtacggtacccgaaaacgtacggttaacggaggggtacggttgggtacgggtaaaaccgaaaaacggttgttacgggacggtaacttcggttagggtcgggaccgggggtcccgtaacgttaccgaaccgttagtcctaccgacggaacgtaaccgaaccgaaacccgtaaaaaactccgtaacgtacgtaacgtacgtacgtaacaaacgttacggaacgtaccgagaacgtacgtccggacgtaaccgacggtcgttcgtaggttattacgtgtacggagtagtaacgtcgtttaacgtaacgttaacttaaaggtttcgaaggttacgtaacgttggtaagttacgtattacg

SEQ ID NO: 115884 - DNA, 751 bp, Homo sapiens
  misc_feature: GYAE6OF02FY02B.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcgttggtccagccgtgggggtccctgacgcctcctcctgtgcgacgccctcgtggtattcctaacgttttggtagtcttagttcgggatcggtacgttcggggtcccgccgtagtcctacccggaggggaacggggccgtagggagggtggggtaccggacccgaaacgtacgtacggaaggggtaggttagggtacgggtaaacgaaaaaacgttgtaggtaggacttcgtaggtcgggccggggccgtagttcccgacctatcccgtaccgagaacgaaccaaaccgaacccgaaaaactctaaccgtagttactacgttacgaacgtaaagtcgggtaacccgtactagggaaccgtacggtaacccggaggtaacccgaccgggttaccttaggttaacggtttagtttagttcggttaggaccggtaaggttaacggttaacgtttaacggtaaaccttaaccgttaaaaggttttccggaaggtttacgttaaccggtttaggttaagtttacggtacgtttaacgg

SEQ ID NO: 115885 - DNA, 631 bp, Homo sapiens
  misc_feature: GYAE6OF02JKGXW.37.34.D01.1.454.CMB.1.raw
  modified_base (153)..(153): a, c, t, g, unknown or other
  misc_feature (153)..(153): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (398)..(398): a, c, t, g, unknown or other
  misc_feature (398)..(398): n is a, c, g, or t
  modified_base (456)..(456): a, c, t, g, unknown or other
  misc_feature (456)..(456): n is a, c, g, or t
tcagtagtgtagatcacgaccggtgctcgatttagatcgtctgtgttgggtttgggggcgaggagtcagacccactcaggacacagcatggacatgagggtccccgctcagctcctggggctcctgctgctctggctcccaggtgccagatgngccatccaaatcgacccagtctccatccctccctgtctagcatcctggtagggacacaggtagtcactcatcacttggccggacaagtcagggctaattaagaaatgagtttagcgtaggtanacgagacaagaaaccgtagggaaacnccccgtaagcctctaccagtctagtcggtcgtactacgttctaacgtttaacgaacggttcggtaaccctaacgtttaagctttacgagacggtanacgtaagggctttaccggagcctaagacgttacttactacctacgtacctaaaccgtntaccggactacgtaccgacttcggtacacgacccgtagtaagttactttaggtactaaccgtttaatacgttacgttactaactaagttactaactacgttaccgttcgtacgttacgacgtaacggaaccgtaagacggtaataccgaacgtactggtacgcgttacgctaacg

SEQ ID NO: 115886 - DNA, 951 bp, Homo sapiens
  misc_feature: GYAE6OF02G4G5B.37.34.D01.1.454.CMB.1.raw
tcagtagtgtagatcacgaccggtgctcgatttagatcgtctgtgttggggttgggggtctcagacgaggagacccttagccctggactccaaggcctttccaccttggtgatccagcactcgagcgacagacggacgtacgaccatggtaattggggctgagctgggtttcctgtgctactttagaacggtgtccagtgtgacgtgcactgggtggagtcgtgggggaggcgttcgggtccagccgtgggggtaccctgacgactctccgtcgtgcgacgcctcgtggatcaactttggtacgtctagttggatcggacgtcgggtcccgccgagtccgtccgaggggaacggggcgtagggtaggtgggtcggacctaacgtagtaacgacgggtagggtggtacgggtaaacgtaaaaacgttagtacggtaggaacgttacggttagggttcggggaccgggggtaccgtagtttaccgaacccgtaacgtcccggtttaacccggaaggtaaaccggtaaaccccgtaaaaccggaaacccccgtaaaaaaaacccgttccgtaaaacccgtttacggttaaaccgttccggttaaacgggtaaacctaaaacgggttaccggggtaaaccccgggtacccgttaaacgggtaacgggttaaaccggtaaccccgggtaaacggggtaaaccccgggttaacccgggtaccggttttaacggtttaacgggttttaaacgtttaaacggttttaccggggtaacggtaaccggggttaaaacgggtaacggggttttaaaccgggttttaaaaccgtaaaccggggtttaaaacccgggtttttaaaaaccgggtttttacccgggttaaagggttttaaccggggtttaaccgggttttaacggggtaaacccgtttttaccgggtaaccggttttaacccgggg

SEQ ID NO: 115887 - DNA, 651 bp, Homo sapiens
  misc_feature: GYAE6OF02I2B7Z.37.34.D01.1.454.CMB.1.raw
  modified_base (281)..(281): a, c, t, g, unknown or other
  misc_feature (281)..(281): n is a, c, g, or t
  modified_base (524)..(524): a, c, t, g, unknown or other
  misc_feature (524)..(524): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctatttagagtgtccagtgtgacgtgcaactggtggagtcgtgggggagcgttggtccagccgtggggggtccctgagtactctcctgtgcagcctctggattcaactttggtancttattggatggacgtggtccgcagtctccgagggaggctggagtgggtcggaccaacgacgtacgagggtaggtcggtaggtaaacgaaaacgtagtcggtaggtactcggtgtcgggcggggaccgtacgtttcgaacccgtatttcccgacccgtaaggaccgaaacccggtaaaccgaacctaaaaaactcctaaccgttagtaatacccgtgaaacaaacgttgggacccgttaccgngaacgaccggtaccgaacggacctacggagttacgtagtttagtgttagacgacgtaagtaggttaacgttaacgaccgttaaacgttaagttcgtaaggtcgttaagtagggtaattggattacgg

SEQ ID NO: 115888 - DNA, 604 bp, Homo sapiens
  misc_feature: GYAE6OF02H767G.37.34.D01.1.454.CMB.1.raw
  modified_base (289)..(289): a, c, t, g, unknown or other
  misc_feature (289)..(289): n is a, c, g, or t
  modified_base (388)..(388): a, c, t, g, unknown or other
  misc_feature (388)..(388): n is a, c, g, or t
  modified_base (599)..(599): a, c, t, g, unknown or other
  misc_feature (599)..(599): n is a, c, g, or t
tcagtagtgtagatcacgaccggtgctcgatttagatcgtctgtgttggggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccaggccgtggggggtccctggagactctcctgtgcagcctctggattcaacttttggtacncttaattggatgggaactgggtccgccagttctccaggggaaggggctgggagtggggtcggccaacatacgagggaggtggtaggtaacgaaaaagtntaggtaggactcgtgtgccggggccgagttcaccatctaccgagtacgaacaaccgtaccaaaaaacgtcaaccttggtaactctacgacaaagtcgggaacggcctagacgtactaccggaggaccgaccggtagtcgttagtattaacgttgtgtcgtagtagtagtttaagacttagtaaacgtttcgagtgacgttggtaactaggnttacg

SEQ ID NO: 115889 - DNA, 591 bp, Homo sapiens
  misc_feature: GYAE6OF02F8CIB.37.34.D01.1.454.CMB.1.raw
  modified_base (374)..(374): a, c, t, g, unknown or other
  misc_feature (374)..(374): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctgggagtgggtggccaacatacagggaggtggtggtacgaaaaactatggtggactctgtgcggggccgattcaccatctcagagacaacgccaaaaactcaactgtatctgcaaatggacggcctgagatccgaggacacggctgtgtatattgngcgagagatttagactaacaaagtttcgagtgtactggtatgtatgtcttagtgtagtaccgttggggccaaagggaccagtcggtctaccgttctacttcacgtccctaccgaccgaacggccctagtccgttacccttcccccgtcggcccgtcccgtcgtccctccgaacggtacgaccctaccgttacccggacgacgaccgaccgacccggg

SEQ ID NO: 115890 - DNA, 622 bp, Homo sapiens
  misc_feature: GYAE6OF02H62HM.37.34.D01.1.454.CMB.1.raw
  modified_base (310)..(310): a, c, t, g, unknown or other
  misc_feature (310)..(310): n is a, c, g, or t
  modified_base (371)..(371): a, c, t, g, unknown or other
  misc_feature (371)..(371): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcaggctattagaaatgagtttaggctaggtatcagacaagaaaccaggggaaacaccctaagcctcctacatctatggtncatcctagttaacaaacgtcgggtaccctaattaagatcgagcgcagtgtatcgtaggcanagtactttcacttctacactatcagacagcctgcctagcctagaagttagtttacgacttaaactttacttacgttacgttaccttaacgtaaagtttaacttaaccgttaaacgttttaccccgttacggttaacccggtttaccgggaacccgtaaacgggggttaaccctaaagggggttaaccgggtaaacttaacccggtaaaacggtacgtttacgggtacggtaccgttacggaccctaacccg

SEQ ID NO: 115891 - DNA, 582 bp, Homo sapiens
  misc_feature: GYAE6OF02HJA8R.37.34.D01.1.454.CMB.1.raw
  modified_base (260)..(260): a, c, t, g, unknown or other
  misc_feature (260)..(260): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttcctgttgctatttagaggtgtccagtgtgacgtgcaactggtggagtcgtgggggagcttggtccagccgtgggggtccctgagactctcctgtgcagcctntggtattcaactttggagcttattggatggacgtgggtccgccagtctaccgaggggaagggctggagtgggtgccaagagtacgagggagtggtaggtaacgaaaactgtaggtaggactgtggtggcggggctattcactatctcgagacgacaacgaaccaaaatcactagtactcgtagactaaagtcgggacgtcctaggagacgtaccgaggaccgacggtctagttcgtaattacgttgtggacgtaggaacgttagttacgtaactaacgttaaaggtttccgaggttacgaacgttgggtaattggattacgg

SEQ ID NO: 115892 - DNA, 825 bp, Homo sapiens
  misc_feature: GYAE6OF02FQJIR.37.34.D01.1.454.CMB.1.raw
  modified_base (280)..(280): a, c, t, g, unknown or other
  misc_feature (280)..(280): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtgggggtccctgagactctcctgtgcagcctctggattcaatttggtanctagttggatggactgggtcccgcctagtcctccgagggaaggggctgggagtgggtcgccaaacgtagtacgaaggggtaggtcggtaggggtaaaccgtaaaaaacgttgtaggtacgggtaccttcgttagggtcgggaccggggggtaccctaagttttcccgaaccccgtagtcccgttaccgaaggaaccggtaaacccgaaacccgaaaccccgtaaaaaaaaccgttccctaacccgtttacggtaaccgttaccgttaggaaacccgtaaaacggtacggggtaaccggtcccggttaacgggaacggtaacgggtaccccgggtaacgggggtaaaccccggttaaccggggtacccgttttagggttaacggttttaaacgttttaaccggtttaaggggttcggtaacccggtaaggtaacgggtttaacgttttaaaccggtaaaccggtttaaaccggtttaaacggtttaaccgggtaacggttaccgggtttaaaccggttagggttacgtttagggtactttaccggg

SEQ ID NO: 115893 - DNA, 586 bp, Homo sapiens
  misc_feature: GYAE6OF02GK8U9.37.34.D01.1.454.CMB.1.raw
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
  modified_base (495)..(495): a, c, t, g, unknown or other
  misc_feature (495)..(495): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaggtgtccagtgtgacgtgcaactgggtggagtcgtggggggaggcttggtccaggcccgtggggggtccctggagactctcctgtgcagccctcgtggattcaactttggtagccttattggatggacgtcgggtccgccagtctccgagggagggctgggagtgggtggccaanagtacgagggaggtggtaggtaacgaaaatntggtggactcgtggtggcggggacgtatcaccgatcctccagacgacaaccgaacaaaactcaactgtatctagactaagnggaccggctagganacgtacggagacgacggngttagttcgtattagttgtacgacgagtaaggtaatttacgaacttaaccgttaaaggtttcgaaggttcgtaacggtggtatggattagg

SEQ ID NO: 115894 - DNA, 612 bp, Homo sapiens
  misc_feature: GYAE6OF02J13VO.37.34.D01.1.454.CMB.1.raw
  modified_base (435)..(435): a, c, t, g, unknown or other
  misc_feature (435)..(435): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttgggtccagcctgggggggtccctgagactctcctgtgcagcctctggattcaactttggtagctattggatggactgggtccgccagtctccgagggaaggggctggagtgggtgccaacatacgagggaggtggtggtaacgaaaaactgtggtggactcgtgtggcggggcgattcacatctccgagagacaacgaccaaaactcactgtatctgacaagtcggacggctgacgacgtcgaggacgacggctgtgttattagtgtgacgagtagtattagactacgtaagtttcgagttgacttggtatgtatgtnttagtcgtactcggtacgggtaccgaagggacctagtcggtacctacgttctctacacgtccctacgaaccgacggacctcgttacccgtccgttaccccgcggtacccgtcccggtcgccgtacccgacggtaccgtacctacccgtaccggtaggtaccgcccgaacgtcccggg

SEQ ID NO: 115895 - DNA, 735 bp, Homo sapiens
  misc_feature: GYAE6OF02HS15D.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtcgtgggggaggtcttggtccaggccgttgggggtccctgagactctcctgtgcagcctctggacttcaactttggtagctagttggatggactgggtccgccagtctccgaggggagggctgggagtgggtggccaagatacgagggaggtggtgggtaacaaaaacgtgtagtaggactcgtggtggccggggccagttcacccgtatactccgaagtacggaacgtaaaccgaccctaaaaaacctcctaaccgtaggttaactaccgttagtaacctaaaacggttcgggaaccgggtacccgtaggtaaacgggtaaccgtacccgggtaacgggaacccgtaaccgggtacccgttagggttaccggtttaaagtttaagtttcgggtacgggtaccgggttaaggtaacgggtttaaacgttttaaacgggtaaacccgtttaaaccggtaaaagggttttttaccgggtaaggttaaccggtaacggtttaacgggtttaacgttaggtaagtttaccggg

SEQ ID NO: 115896 - DNA, 1054 bp, Homo sapiens
  misc_feature: GYAE6OF02HHFT0.37.34.D01.1.454.CMB.1.raw
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctggtttcctgttgctatttagaggtgtcagtgtgaggtgcaattggtggagtcgtgggggagcctcgtccngccgtgggggtccctgagactctctgtgtagcctntgtaacttccccgttttacggctttagttcggagtcgtacgtcgtcggggtacccgacccgacgggtccgtacccggaagggggtaacggggggtccgtaggggtaacggggttgggggtaccgggaacccgtaaaaccgaaagttaaaaacggaccgaaaaggtaacggttaaggggtaaaaacggtaaaaggggaaaaggggtaacggttaagttacgggttacgggaacgttttcggttagggtaacggggtaaccgggggttttaccccgtttaacccgtaacccggtaacgtttaccccggttaacccggaaagggttaaacccgggaaaacccgaaacccccgggtaaccccggtaaaaaacggttaacccggtttaccccggggttagtaacccgttaaaccggtttccgttaaccgggtaaaccctaaaaaacgggtttaccggaaaacccgttaacggggtttaaccgttaaacgggggaacggttaaacccgggaccccggggtaaaacgggaaacccgtttaaccggggttttaaacctttttaaacgttttttaaacccgggttaaccgttacgggtaccggggttaaaccccgggttaaaaggggaaaccgggggttaaaccgggggttaccccgggggttttaacggggggtttaaccccgggggtttttaaccccggaaccgggtttttaaacccccgggggttcggggggaaacccccgggttaccccgggggggtttaaaacccccctttccgggggggttaacccccttaaccccccggg

SEQ ID NO: 115897 - DNA, 793 bp, Homo sapiens
  misc_feature: GYAE6OF02I5XRU.37.34.D01.1.454.CMB.1.raw
  modified_base (363)..(363): a, c, t, g, unknown or other
  misc_feature (363)..(363): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaagttggggctgagcgttgggttttccttgttgcttagttttagaaggtgtccagtgtgacgtgacgtaacgtggtggacgtcgtagggggagtcgttcggtccgacggtccggttcggggggtccctaggacgaccttccgttccgtggtgacgtacgtcctcgtggtacttaccgtaacgttttggtacgtcgttaagttggtacgtggtacgtcgggtcccncgagttccgaccggaaggggacgggtccgtgggtacgggtcgggtcggaacctaacgagtaacggaggggtacggttggtaacggtaaacgtaaaacgtgtacggtacggtacgttcgtggggtcggacgggggaccctttacgttacccgaaccgttacgttaccctaccggaacggtaaccggaaacccgtaaacccggtaaaccctaaaaaacgtccgtaacccgttaggttaacctacgttaacggtaaccgttaaaggtccgggaacccgttctaaggaccgtaacgtaccgggaacgtacgtaccggtacgttagtttacgtagtttagtagtccggtagaaggtacggttaactttaacggaacgttaaaccggttaaggtttctaaggtacgttaacggttggtttaacgtgtaacgttcgg

SEQ ID NO: 115898 - DNA, 787 bp, Homo sapiens
  misc_feature: GYAE6OF02GASFE.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattgggctgagctgggttttccttgttgctattttagaaggtgtccagtgtgacgtgcaacttgggtggagtcgtgggggaggtcgttgggtcccaggcccggttgggggggtcccctggacgtaccgtcctccgtgtgcacgccctctggtacttctaaactttgggtagcttagttggatggacgtcgggtcccgcctacggtccgtcccggaaggggacggggcgttaggggaggtcggggtcggaccgaacgtagtacggaggggaggtgggtagggtaaaccgtaaaaagttgtgggttacggaacgtttcgtagggttcggggaccggggggtacccgttaacgtttccgaaaccctacgtttcccgtacccgaaacgggtaaccgaaacccgaaaccccggtaaaccctaaaaaaacccgtcccgtaaccgttaacgtaccttaccgtaacggtactaaaacggtcgggtaccgggtacccgtaggtaacggccgtacggacgggaaccgggtacggtaccgttaggttacgttaagtttacgtttgtccggtaggaacggtaaggttaacgtttaagtaacgttaacgttaaaggttttacggtacggtacggttaacgttaggtagtggtagttaacgg

SEQ ID NO: 115899 - DNA, 609 bp, Homo sapiens
  misc_feature: GYAE6OF02JJTPC.37.34.D01.1.454.CMB.1.raw
  modified_base (227)..(227): a, c, t, g, unknown or other
  misc_feature (227)..(227): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (552)..(552): a, c, t, g, unknown or other
  misc_feature (552)..(552): n is a, c, g, or t
  modified_base (562)..(562): a, c, t, g, unknown or other
  misc_feature (562)..(562): n is a, c, g, or t
tcagtagtgtagatcacgaccggtgctcgatttagatcgtctgtgttcgggttgggggaagagggaagacgtgaccggtcctgccacgaggttcggtgtcttgaggtaagagatggaggtcggacgtgtacagcacccagctgggggcctggtacccgttgggtcctaccggttctccgttcgtaacgtccttacctaacgtaaagggccctatcggtccttcccgnggccgccctaggcttaccggaggagtccgtaccgtaccggagtacggccacgacgggcccggggtccctgggctcgtcccgtgtacgaaggttacctctccgattcctacgacgttacgtgaacggtccggtactggacctaagggcgacctagtagcgtcgnggcgngtaggcttccgngtntaggtctgagtcgagtcganactcacacttagcacgtagctcacgtnacgggacactntaccncgtactcaancgnacganacgatccattccatcaatcngcncganggtaccaagcgccaggatcggtattccgaggttnagtctacgtntagactacgtagtacgtacgtcggaccgacgtaccggtacgtggacc

SEQ ID NO: 115900 - DNA, 667 bp, Homo sapiens
  misc_feature: GYAE6OF02GBJJD.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccaggccgtggggggtccctgagactctcctgtgcagcctcgtggattcaacgttttggtagcttattggatggactgggtccgccgagtcctccgagggaagggctggagtgggtcggaccaacagtaacgaggggaggtggtacggtaacgaaaaactgtggtaggacctcgtggtcgggccgggggaccgtagtttccacctagttcctcccgtaagacgaacaaaccggaacccaaaaaaccgtccaacgttacgtaactacgtacgacgtaaaagtcgggacgtccgtagaacggtacgtaccgggaaggaccgacggcgttaggttacgtttagttagttgggttgacggtaaggtagttaacgtttaacgtaaccttaaacgttaacggttttacggaacgggttgtaacggttaggttaagttaggtattacgg

SEQ ID NO: 115901 - DNA, 728 bp, Homo sapiens
  misc_feature: GYAE6OF02I3P8H.37.34.D01.1.454.CMB.1.raw
  modified_base (266)..(266): a, c, t, g, unknown or other
  misc_feature (266)..(266): n is a, c, g, or t
  modified_base (626)..(626): a, c, t, g, unknown or other
  misc_feature (626)..(626): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtgagtcgtgggggaggctggtccagcgtgggggtccctgagctctcctgtgcagcctctaggtnttactaactttggagtcttagttggatggtactcggggtccgccgtagtcgtccgtaagggggaaggggctagggaggtgggggttacggacccgaaacgaagtaaccggaggggtacgggttgggtacgggtaaaacgaaaaaaccgttggtacggttacggaactttcggtacgggttcggggcccggggggtacccgtaacgttttacccaaccttaacgttccccgttacccgaaggaaaccggaaccctaaaccgggaaacccctaaaaaaccgtctaaccgttaacgtaacgttccgtaagaaccgtaagtccggggaccggtacctaggacgtacgtacggacggacgtacgngttgtacggttatttagtggtgtacgaggtacttagtttaacgaacgttaacggttaaaccgtttcggaagttacggtaacgttagggtactaggtattacg

SEQ ID NO: 115902 - DNA, 299 bp, Homo sapiens
  misc_feature: GYAE6OF02G34KJ.37.34.D01.1.454.CMB.1.raw
  modified_base (294)..(299): a, c, t, g, unknown or other
  misc_feature (294)..(299): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagcctccaccaagggcccatcggtcttcccctggcgccctgctccaggagcacctccgagagcacagcggccctgggctgcctggtcaaggctacttccatctacactactgagcggctggcaaggcgcatagnnnnnn

SEQ ID NO: 115903 - DNA, 811 bp, Homo sapiens
  misc_feature: GYAE6OF02I1DK5.37.34.D01.1.454.CMB.1.raw
  modified_base (391)..(391): a, c, t, g, unknown or other
  misc_feature (391)..(391): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtcgtgggggaggcgttggtccagcctggggggtccctggagactctcctgtgcagcctctggattcaactttggtagtcttagttggaatggacgttgggccgccgagtctccgagggtaagggctgggagtgggtcggccaacgtatacgaggggtagggtaggtagggtaacgaaaaaacgtntagggttaggaacgtcgtaggtacgggcgggggcccggtaaacgttccgaaccgtacgttaccttaccggaacggaacgaaacccgaaaacccggtaacccgtaaaaaaaccttaccgaaccgttaaggttaaccttacgttaccgaaccgaaaaacggtttcgggaaacccggggtcccttaacggaacggggtaaacgtttaccccggggaaacgggttaacccgaaaccgggttccggttaacgggttggtttaaagttttaaacgtttgggttaaccggtaccgggtaaagggtaaaggtttatttaaaccgggtaaacccgttaaacgtttaaaaaaccgggttttccgggttaaaacggtttacccggttaaaaccggtttgggtttaaaacgttgggaaaagttttacccggg

SEQ ID NO: 115904 - DNA, 706 bp, Homo sapiens
  misc_feature: GYAE6OF02GRD15.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccagccgtcgggggggtccctggagactcctcctgtgcagcctcgtggatttcctaacgttttggtacgtctagttggattgagcgtcgggtcccgccgacggcctccggaggggaaggggcgtgggagtggggtgccaaacaagtaaagcgaaagagtaggaaaggtaagaagggagtagtaggtgacctgtaggtaggacgggtccgtttacaccgtacttcctaccgtaaggacgaaccaaacgacccgtaaaagtaacccgtcccgtacggacactttaccgacaactaaaacgtcgaaaccgtgtaccgtagggtacgaaccggaccggtaagggaaccgacgggttactttaattttacgttacccgtggaccggtaacggaaggtaacgggaacgggttccgggttagggggttccgggtttaccgaaccggttaccgggtccgggggtaccggtaaacccggggtccccg

SEQ ID NO: 115905 - DNA, 613 bp, Homo sapiens
  misc_feature: GYAE6OF02IO2WC.37.34.D01.1.454.CMB.1.raw
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (461)..(461): a, c, t, g, unknown or other
  misc_feature (461)..(461): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttcctgttgctattttagaaggtgtccagtgtgacgtgcaactggtggagtcgtgggggaggcttggtccagccgtggggggtccctgagactctcctgtgcagcctctggattcaactttggtagctattggatggacgtgggtccnccagtctccgagggaagggcnggagtgggtggcaacagtaacgagggaggtggtaggtaacgaaaaaacgtgtagttaggacttctggtggtaccggggccgtacttcgaaccagttacctacccgagaacgaaccgaaaccggaacctaaaaaacncgtaactgtaatcctagtacaaaagtgaccgctaggaacgacgtccgtacgggacaccggtctagtagttacttagttgtacgacgtagagtatttaacgaacctaaagtaaacgtttcgaaggtcgtacgttagggtaacttagtagtacg

SEQ ID NO: 115906 - DNA, 773 bp, Homo sapiens
  misc_feature: GYAE6OF02F7J5T.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtgggggtccctgagactctcctgtcgcagcctcgtggatttcgtaactttggtagtcttagttggagtggacgttcggggtcccgcctacggtccgtaccggagggggaacggggcctgggtacgggtggggtcggaccgaaactacgtaacggagggggtacgggttgggtaagggtaaacgtaaaaaacgttcgtaggtacggtaacgttcggtagggtccggggccgggggtaccgttaaccgtttacccgaacctacgttcccgtacccgtaaaggaacgaacccgtaaaccggaaaccctaaaaaccgtacctactaggtacctacgtacgaacgtaaacgtcgggtacccgccgttaaggacgtaccggtaccggacgggtaaccgtacgggtaccgttaggttaacgtttaagtttaacggttgacggtacggtacgtaacgggtttaatttaaaccgggtaacttaaaccggtttaaacggtttacggtaagggttacgtaaccggttagggttagttaggagtttacggg

SEQ ID NO: 115907 - DNA, 569 bp, Homo sapiens
  misc_feature: GYAE6OF02FLU8K.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtcccgccagtctccgagggaggggctggagtgggtgccaacgatacgagggaggtggtggtaacgaaaaactgtgtggactcgtagtggcggggccgattccacatctccagacgacaacgaccaaaactcactgtactctagacaagtggacgtctagagacgtaccggagaccgacggctagtgttagttagttgtcgtcgaggtagtaatttaggaacttaacgtaacgttttacgagttacggtaacgttggtaattggagttacgg

SEQ ID NO: 115908 - DNA, 629 bp, Homo sapiens
  misc_feature: GYAE6OF02IXR6X.37.34.D01.1.454.CMB.1.raw
  modified_base (270)..(270): a, c, t, g, unknown or other
  misc_feature (270)..(270): n is a, c, g, or t
  modified_base (349)..(349): a, c, t, g, unknown or other
  misc_feature (349)..(349): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagtagtgtagatcacgaccggtgctcgatttagatcgtctgtgttgggtttgggggctcagagaggagcccttagccctggactccaaggcctttccacttggtgatcagcactgagcacagaggactcaccatggaattggggctgagctgggttttccttgttgcttattttagaaggtgtccagtgtgacgtgcaactggtggagtcgtgggggaggcttggtccagccgtgggggtccctgagctctcctgtgcagcctctggnttctaacgtttggagctagttggatggcgtgggtccgcctaggtctccgagggaaggggctggaggtgggtcggccaanagtacgaggggaggtggtagtaaacggaaaatgtgtggactgtgtgcgggcatccacatcgtcagacaacaacgaaccaaacnctacngtactcgtagacaagtcgggactacgtagacgtagtaccgagggtaccgacgggtacctacggtttgttaaacggttagttttacggcggtacggtaaggttaacggttaagtttaacggtaaccttaacgttaaacgggttttaccgaggtttacggtaacggtttaagggtacgttcggttaagttacgg

SEQ ID NO: 115909 - DNA, 300 bp, Homo sapiens; identical to SEQ ID NO: 115346
  misc_feature: GYAE6OF02FG2PY.37.34.D01.1.454.CMB.1.raw
  modified_base (295)..(300): a, c, t, g, unknown or other
  misc_feature (295)..(300): n is a, c, g, or t

SEQ ID NO: 115910 - DNA, 794 bp, Homo sapiens
  misc_feature: GYAE6OF02IENTG.37.34.D01.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (267)..(267): a, c, t, g, unknown or other
  misc_feature (267)..(267): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagccgtggggggtccctgagactctcctgtgcagcctctggattcaacttttggtagctattggatggactgggtccncagtctcgagggaagggctgggagtggtggacaanatacgagggagtgggtaggtaaacgaaaactntgtgtactctgtggcgggaccgtattcgacactcctacgaagacgaacgaaccgaaccaaaaaacttccaaacgttgttaactcgttacgaactaaagtcgggtaccggtacgtaggacgtacgtaccggaacggtaaccgacggtcttacgttagttaactttagttaggtacggtacgtaaggtaacgtaaagtttttaacggaaacgtttaaacgttaaaaggttttcggaaaggttcggtaacgtacgggttaatcggtaagtcggtttaactttaagtacggtaacgtttacccggtaccgggggtaaccgtaaacgggaaccgttaacggtacgggtacccgtaaccgttccgtaccgttacgaacccggttacccgtacccgtaaaccggtaccgggtaacccgtaccgttaccccggttcccgtacccccgttcggccccgtacccgtccgtaccgtacccggtaacggtacccgtacccgtacccgtaccggaacggaccgtacgtaccgtacccggg

SEQ ID NO: 115911 - DNA, 583 bp, Homo sapiens
  misc_feature: GYAE6OF02F3YM1.37.34.D01.1.454.CMB.1.raw
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (455)..(455): a, c, t, g, unknown or other
  misc_feature (455)..(455): n is a, c, g, or t
tcagtagtgtagatcacgaccggtgctcgatttagatcgtctgtgttgggtttgggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggagcgttggtccaggcccgtggggggtcccctggagactctccgtgtgcagcctctggattcaacgttttggtagcttagttggatggacgtggggtcccncgagtcctccgaggggagggcgtgggagtgggtgaccaanagtacgaggggaggtggtaggtaaacgaaaaactgtggtggactcgtgtggcggggcctatccacctatcctcgagacgaacaaccgactaaaaccnctaactcgtatctagacaagtcggacgctcggaagacgtaccggagaccgacggtcttgtagttattagttgtcgagtagtagtagttaacgaacttaacgtaaggttgagtgtacgtgtatgtatcg

SEQ ID NO: 115912 - DNA, 845 bp, Homo sapiens
  misc_feature: GYAE6OF02IDT3O.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaaccatggaattggggctgagcttgggttttccttgttgtacttattttagaaggtgtcctagtgtgacgtgctaactggtggagtcgtgggggaggtcttcggtcctgccggtggggggtccctggacgaccgtcctccgtgtgacacggtcctgtggtattctaacgtttggtagcttagttggtagtggtaccgtgggtccccgcgtacgtccgtaccgaagggggtaggggtccgtagggaggttcggggtacggaccgaacgtacgttaacggaggggtaagggtagggttagggtaaacgtaaaaacgtagttaggtacggtacgtcgtgggtccgggtacgggggtacccgtacgttaccaacccgtacgttcccgtaccgaaaggaccgaaaccgtaaccgaaacccgtaaaaacctccttaaccgttaggttaacctacgttacgacgtaaagggtaccgggtccgactaggaacggtaaccggttaacccgggaggtaacccggtacgggtcgtttacgggttagtttaacgttttacgggttaggttaccgggaaccgggttaaggtaaacggttttaaccggttttaaaacgggtaacccgttttaaaaacgttaaaaccgggggtttttaccggaagggtttaccgggttaaaacccgggtttggggttttaaaccgtacgggttaaagttttaccccggggg

SEQ ID NO: 115913 - DNA, 315 bp, Homo sapiens
  misc_feature: GYAE6OF02IFMQW.37.34.D01.1.454.CMB.1.raw
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (304)..(315): a, c, t, g, unknown or other
  misc_feature (304)..(315): n is a, c, g, or t
tcagtagtgtagatcacgaccggtgctcgatttagatcgtctgtgttgggttgggggaagaggaagactgacggtctgccacaggtggtgctgaggaagagatggaggtggacgtgtcagcacccagctggggcctgtccctggtcaccgtctcctacagcctccaccaagggcccatcgtccttccccctgggccgccctgcctccgaggacgcacctccgagagcacgagccggccctgggctgccctggtcaaggctacttcatctacactactgaggcggcnggnaagggcnctagtagnnnnnnnnnnnn

SEQ ID NO: 115914 - DNA, 633 bp, Homo sapiens
  misc_feature: GYAE6OF02G9RLZ.37.34.D01.1.454.CMB.1.raw
  modified_base (574)..(574): a, c, t, g, unknown or other
  misc_feature (574)..(574): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgcttattttagaaggtgtccagtgtgacgtgcaactggtggagtcgtgggggaggcttggtccagccgtggggggtccctggacgactctcctgtgcagcctcgtggattcaacttttggtagcttagttggatggacttggggtcccgccagtcctccgagggggaaggggctgggagtggggtcggaccaaacagtaaccgaggggagggttggtaagggtaaacgtaaaaacttgttggtacggactcgtaggtcgggccgggggccgtacttccgaacctatccctaccgaggacgaaccgaaaccgaacccaaaaacgtcctaactacgtactccgtagactaaagtcggaccggcctaggacgacgtaccggacgacgcggtcttagttgtacttagtgngacgagtagtattacgactaacgttaagtttcgaggttacgacgttggtatgtagttcg

SEQ ID NO: 115915 - DNA, 608 bp, Homo sapiens
  misc_feature: GYAE6OF02HKW8S.37.34.D01.1.454.CMB.1.raw
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (517)..(517): a, c, t, g, unknown or other
  misc_feature (517)..(517): n is a, c, g, or t
  modified_base (522)..(522): a, c, t, g, unknown or other
  misc_feature (522)..(522): n is a, c, g, or t
  modified_base (604)..(604): a, c, t, g, unknown or other
  misc_feature (604)..(604): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttttccttgttgctattttagaaggtgtccagtgtgacgtgcaactggtggagtcgtgggggagtcttggtccagccgtgggggtccctgagactctcctgtgcagcctctggtattccaacttttggagtcttagttggatgggacgttcggggcccgcctagttcctaccggagggggtaaggggctgggaggtggggtcggaccaaacagtacgaggggtaggtgggtacggtaaacgtaaaaattgtggtaggacttcgtggtcgggccggggctacgttaccacctatctccgagacgaacaacgaaccaaaactcactntanctagacaagtcggacgctagagacgtccgagacncggtnttgttgttagttagttgtggtacgagtagttaattacgaaccttaacgtaagtttacgacggttgtacgttaggtataggtntacg

SEQ ID NO: 115916 - DNA, 629 bp, Homo sapiens
  misc_feature: GYAE6OF02HP6DS.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgctattttagaaggtgtccagtgtgacgtgcaactggtggagtcgtggggggaggcttggtccagccgtggggggtccctgagactctcctgtgcagcccttcgtggatttctaacgttttggtagtctatttgggattggacgtcggggtcccgccgagttcctaccgagggggaacgggctgggaggtggggtgaccaacgtatacgaggggaggtggtacggtaacgaaaaactgtagtaggactcgtgtggcggggccgtattcacactctccagagaccaacgaccaaaactcactgtactcgtgacaagtacggacgtcctagagaactaccggaggaccgacggtcgtagtgtatttaacgttgtagacgtacgtaagtaacgtttcgtaaacgttaacgttaaaggtttacggtacgttacggtaaccgttgggttaacttagagtttaacgg

SEQ ID NO: 115917 - DNA, 750 bp, Homo sapiens
  misc_feature: GYAE6OF02GX0PK.37.34.D01.1.454.CMB.1.raw
  modified_base (267)..(267): a, c, t, g, unknown or other
  misc_feature (267)..(267): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccaggggaaggggctggagtgggtggaccaacatacgagggaggtggtggtaacgaaaactntagtggactctgtggcggggcgattcaccactctccagagacaaccgaccaaaaactcactgtatctgacaaagtgggaccggccgtagacgtacgtacccggaggaccgaccggtcgtacggttaggttaactttagtttggttacggtacggaagggtaagttaaagttttagtaaaccgtttaaacgttaaaacgttttcggaagttacgtaaccggttaggggttaatgtagttggttacctttaagtcgtaacgttacccggttacgggggtaacccgaaacggggaccctaggtcggttacccttacccggtcctttaccgttaaccgtccccttaaccgaacccgaaccggggccccttaacgggtcccgttccccgtttcccccggtaccggtcccggaccccgttccgcccgtacccggtcggaccgtaccccgacccgtccggaccgacgtacccgacggtaccggtcccggg

SEQ ID NO: 115918 - DNA, 837 bp, Homo sapiens
  misc_feature: GYAE6OF02H7BK7.37.34.D01.1.454.CMB.1.raw
  modified_base (259)..(259): a, c, t, g, unknown or other
  misc_feature (259)..(259): n is a, c, g, or t
  modified_base (830)..(830): a, c, t, g, unknown or other
  misc_feature (830)..(830): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgcttattttagaaggtgtccagtgtgacgtgcaacgtggtggagtcgtgggggagcttggtccagccgtgggggtcctgagactctcctgtgcngcctctggatttcaacgttttggtagtcttagttggagtacggtacgtccgggtcccgccgtacgttcccgtaccgggaagggggacgggtcgtaggggtacgggttcggggtaccggaaccctaaacgtaacgtacggggaggggtacggggttagggttaaacgggtaaaaaccgttaaaaacgttcggtagggtacggttaccgttacggttaggggtccggggtcccggggggtacccgttaacgttacccaacccgttacgtaccccgttaaccggaaagggtaacccgaaacccgaaaaaccccgtaaaaccctaaaaaaccttccgtaaaccgtttacgttaaccttacgtaacggtaaacgttaaacgggtccggggtaacccgtacggtaacggaacggttacccggaaccggggaacggaaccggtacgggtccgtttaaggtttaacgttagttttaaggtttcggacgggttaacggtaaggttaacggttaacgtttaaaccgacgttaaaacggtttaagttccggtaagttacggtaacgttaggttacgtacggnttaacgg

SEQ ID NO: 115919 - DNA, 732 bp, Homo sapiens
  misc_feature: GYAE6OF02IES3J.37.34.D01.1.454.CMB.1.raw
  modified_base (240)..(240): a, c, t, g, unknown or other
  misc_feature (240)..(240): n is a, c, g, or t
tcagtagtgtagatcacgaccggtgctcgatttagatcgtctgtgttgggttttccttgttgctattttagaaggtgtccagtgtgacgtgcaactggtggagtcgtggggggaggcttggtccagccgtggggggtccctgagactctcctgtgcagcctctggattcaactttggtagctattggatggactgggtccgcagtctccgaggggaaggggctggaggtgggtggccaanatacgagggtaggtgggtaggtaacgaaaaactgtggtaggactcgtggtcggccggggccgtattccgacctagtcctacgagacgaacaaccgaaccaaaaactctaactgtaactcgtacgaacaaagtcgggaccggtcctagagtacgaccggaaggaccgacggtctggtacgttatttagttgtacggacgaaggtaagttaagtttaacgaaccttaaacggttaaagtttcggaaggttaggtaacgttagggttaataggtattcgtactttagaggtaccgttacgggacgggtaaccgtaaacgggacctagtcggtacctaccgttcgttactccgtaccggacccctaccgaaccggtaaccggtcccctaacgttcccgtttccccttaccccggcggaccccgttcccgtacgtaccggtaccgaacgggtaccgacccgttaccccggacggaggaccaccggaccctaccgggg

SEQ ID NO: 115920 - DNA, 710 bp, Homo sapiens
  misc_feature: GYAE6OF02FYJ59.37.34.D01.1.454.CMB.1.raw
  modified_base (305)..(305): a, c, t, g, unknown or other
  misc_feature (305)..(305): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttcctgtgctattttagaaggtgtccagtgtgacgtgcaactggtggagtcgtgggggaggcttggtccagccgtggggggtccctgagactctcctgtgcagccctctggattcaacgtttggtagctagttggatggactgggtcccnccgagtcgtccgaggggaaggggctgggagtggggtggccaacagtacgaggggaggtggtaggtaaacgaaaaactagtaggtggaactctagggttcggcggggggccctaagttcccaaccgacgtcccttacccgaggaacggaaccctaaacccgggaacccaaaaaaacccttccgtaaactttacggaacttcgttaacggactaaaacggttaccggggaccggtcccgtagggtaacgaacgttacccgggaacggtaaccgaaccgggtcttgggttaacgttaaggttttaattgggttacggaccggtaaggaagtttaactttaaggtaaccttaaacgtaaaacggttttcggtaacgttaggtaaccgttagggtattagggtaattcgg

SEQ ID NO: 115921 - DNA, 368 bp, Homo sapiens
  misc_feature: GYAE6OF02HS8IG.37.34.D01.1.454.CMB.1.raw
  modified_base (352)..(368): a, c, t, g, unknown or other
  misc_feature (352)..(368): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagccctccaaccgaacgggccccagttccggtccttcccccctgggccgcccctgcctccgagggacgccacctccgaggacgccaccgagccggcccctggggctggttctcggtacgaaacggtaccttaccttaccacttactaaccacttaacctggaggcgggactcgggacaaaggcgacagtagnnnnnnnnnnnnnnnnn

SEQ ID NO: 115922 - DNA, 367 bp, Homo sapiens
  misc_feature: GYAE6OF02IFQIT.37.34.D01.1.454.CMB.1.raw
  modified_base (348)..(367): a, c, t, g, unknown or other
  misc_feature (348)..(367): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcagccctccaccgaacgggccccagtccggtccttcccccctgggccgcccctgcctcccagggacgccaaccgtccgagacgccaacaggccggccctggggcctcggcccgttgggtaccaaacgggtaccttaccttccaattctaaccactactggacggcgggctgggacaacgggcacatagnnnnnnnnnnnnnnnnnnnn

SEQ ID NO: 115923 - DNA, 620 bp, Homo sapiens
  misc_feature: GYAE6OF02GCFVH.37.34.D01.1.454.CMB.1.raw
  modified_base (181)..(181): a, c, t, g, unknown or other
  misc_feature (181)..(181): n is a, c, g, or t
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
tcagtagtgtagatcacgaccggtgctcgatttagatcgtctgtgttggggtttggggctcagagaggagccttagccctggactccaaggcctttccacttggtgatcagcactgagcacagaggactcaccatggaattggggctgagctgggttttcctgttgctattttagaaggtntccagtgtgacgtgcaactggtggagtctgggggaggcttgggtccaggccgtggggggtccctgagactctcctgtgcagccctcgtggacttcaacttttggtagcttattggatggactgggtccnccagtctccgagggaaggggctgggagtgggtggccaacatacgaggggagtggtaggtaacgaaaactntggtggactcgtgtgggaccggggcctattccgaccctatcctacagacgaacaacgacccaaaaactccaactctactcttacgacaaatcgggaccgacgttggaacgacgtacccggagggtaccgacgggtcttcgtagttagttagttaggtgtacggtaggagttaagtttaacggaacttaaccgtaaggttttacggaggttaggtaccgttagggtacttggtacttacgg

SEQ ID NO: 115924 - DNA, 528 bp, Homo sapiens
  misc_feature: GYAE6OF02FT75X.37.34.D01.1.454.CMB.1.raw
  modified_base (224)..(224): a, c, t, g, unknown or other
  misc_feature (224)..(224): n is a, c, g, or t
  modified_base (422)..(422): a, c, t, g, unknown or other
  misc_feature (422)..(422): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctcctgtctgcatctgtaggagacagagtcatcatcacttgccggnaagtcgaggcattagaatgattaggctggtatcagcagaaaccgagggaaacgcccctaagctcctcatctatggtgcatcctagttacaaactcgggtcctaattaagattcagcggcagtggatctggcacgagtattcactctccacatacagacacgcctgccacgcctgaacgtattttacgacttaaacttnttactgtactacaagtataacaattaccctacgttacgttccggacgtaacggtaaccgtaaggtaggtaacgtacgaaccgacgttagtaggactcgactaaccg

SEQ ID NO: 115925 - DNA, 704 bp, Homo sapiens
  misc_feature: GYAE6OF02JELMM.37.34.D01.1.454.CMB.1.raw
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtcccaggccgtggggggtccctgagacttctcctgtgcagcctctggattcaactttggtagctattggatggactgggtccgccagtcnccgaggggaagggcnggagtggggtagaccgaanagtacgagggaggtaggtaggtaacgaaaaactgtagtcggactcgtggtcggcggggaccgtacttccaccgtatccttaccaaggaacgtaaccgaacgaacccaaaaaccgtctaaccgttagtaacttcgttacgaacgtaaacgttacgggaacggtacccgtagggaacgtaacgtacccgggaaggtacccgaacgggtaccgtttagtttaccggttaagtttttaagttacggttaggtacggtaaggtacgggttaacttttaacggtaaaccttaaaccggttaaaggttttacggtaacggttacggttaacgtttaggggttaacttagggtagtttaacgg

SEQ ID NO: 115926 - DNA, 1021 bp, Homo sapiens
  misc_feature: GYAE6OF02H0J6Z.37.34.D01.1.454.CMB.1.raw
tcagtagtgtagatcacgaccggtgctcgatttagatcgtctgtgttgggtttggggtctcagagaggagccttagccctggactccaaggcctttccacttggtgatcagcactgagcacagaggactcaccatggaattgggctgagctgggttttccttgttgctatttagaggtgtccagtgtgacgtgcgtaactggtggagtcgtgggggaggtcttggtccaggcccgttgggggtcccctgacgacctcttccctggtcgcaggcccttacgtggtactttacgtaacgttttggacgtacgttagtttcgggattcggggtaactcgggggttccccgtaccggtaacggttccgtaccccggaagggggggtaaaccgggggtccgttagggggaacgggtttcggggggtacgggaccccgtaaaacggtaacgttaaccgggaaaggggggtacggggttacgggttaaggggtaaaacccggtaaaaaaaccgttaggttggttaacggggtaaccttccggttagggttcggggacccggggggtacccgttaaacgtttcccgaaccccgttagttacccgttacccgtaaacggtaaccgaaaccgttaaaaccccggaaacccttaaaaaaaaccgtttacccgaaaccgtttacggttaaaccgttacccgttaaccggaaacgtaaaaccgggtttaaccgggggaacccggttacccctaaaggggttaaccggtaaccggttaacccccggggtaaaggggaaacccccgtaaccggggttacccggtttacgggtttttaaacgggttaacttttttaaacgggtttcggggttttacccggtaacgggtaacggttaaaacgggtttaaaccggtttttaaaccgggttaaacccgtttaaaaaccggttaaaaacgggtttttacccgggtaaacgggtttacggttaaacccgggttttagggtttaaaccgttaccgggttaagttttaaccggg

SEQ ID NO: 115927 - DNA, 814 bp, Homo sapiens
  misc_feature: GYAE6OF02FY4MQ.37.34.D01.1.454.CMB.1.raw
  modified_base (356)..(356): a, c, t, g, unknown or other
  misc_feature (356)..(356): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagagtgtccagtgtgacgtgcaactggtggagtcgtgggggaggcttggtccagccgtggggggtccctgacgactctcctgtgcagtcctcgtggtattctaacgtttggtatctagttggatggacgtgggtccgcagtcctccgagggacgggcgtggaggtcggggtgacccgtaacgngtaaccgaggggtacgggtggtaaggtaaacgtaaaaacgtagtcggtagggaaccttcgtacgggtcgggcccggggggtaccgtacggtttacccaacccgtagtaccgttacccgtaacggaacggtaaacccgaaaccggtaaaccccgaaaaaaccgtacctaaacccgttacgttaaccggttacctacggtaaaccgtaaaggttccggggtaaaccgggtcccgttaagggtaaccgggttaactaacccccggggggtacgggtaaacccgggtaccggggtaccggtttacgggttaacggttttaaggttttaacgttcgggtaggtaccgggtaaggtaaggtttaacgtttaaaccgggtaaccttaaacggttaaaacggtttttacgggaacggtttacgggttaaaccgtttaaggggtttacgtacggttagttaaccggg

SEQ ID NO: 115928 - DNA, 804 bp, Homo sapiens
  misc_feature: GYAE6OF02I04ET.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaacgtggtggagtcgtggggggagcgttggtccaggtccgtcggggggtccctggacgactcgtcctgtgcacgcctcgtgattcaacgtttggtatcgtattggatggacgtcgggtcccgcagtccgtaccgaggggaacggggtcgtagggaggtggggtacgaccgaacgacgtacggagggggaggttacgggttacgggtaaaaccgtaaaaactgttaggttacgggaaccttcggtaggtacggggccgggggtacccgtaggttacccaccgtaacgttcctaacccgaagtaacggaaaccctaaccggaaaccctaaaaaaccgttccgaaacgttcgttaactaccggtataaaccggtaaacggtccggggtaacccgtaccggtagggtaacgtaaccgttaccgggaacgggtaaacccgtacggggttaccctttagggttaacgtttaagtttaacggttagttacgggaccgtaaaggttaaccgggttattttaaaccggaaacgtttaaaccgtttaaaacggtttccgggtaagggttaacggtttaccggttaaggggttaaccgtttagggtatttaaccggg

SEQ ID NO: 115929 - DNA, 803 bp, Homo sapiens
  misc_feature: GYAE6OF02JC2MP.37.34.D01.1.454.CMB.1.raw
  modified_base (475)..(475): a, c, t, g, unknown or other
  misc_feature (475)..(475): n is a, c, g, or t
tcagtagtgtagatcacgaccggtgctcgatttagatcgtctgtgttggggtttggggctcagagaggagccttagccctggactccaaggcctttccacttggtgatcagcactgagcacagaggactcaccactggaagttggggctgagcgtggtttcctgtgctatttagaaggtgtccagtgtgacgtgcaacgtggtggagtcgtgggggtaggcgttggtccaggcccggtgggggggtccctaggacggacttctccctggtcgacgacggcccttcgtaggaactttctaaccgtttagggtaacgtcttagttagacgtaggacgttcgggtccccgaccgtacgtacctaccggacggggaaggggccgtggggaggtgggtcggaccaacgtatacggaggggacggtagggtaacggtaaacgggaaaaacgtggttaacggtacggtactacggttacggngggacccgggggaccggtaatttacccgaccgtaaccgttccgtaaccccggaaggaaaccgtaacccggaaacccggtaaccctaaaaaaaccttcccgtaaacgttaaccggttaaccttacgttaacgtaaccgtaaaaccgggttgggaacccgggtacccttagggaaagaccggttaacccgggaaccggttaaccggaaccggtcggttaagggttaccggtttaattaaacgggttcggacggtacgtaaggtacgttaagtttaccgaaaccgtagttaaggttacgtaagttcggagtttaggtactaggtactacgg

SEQ ID NO: 115930 - DNA, 553 bp, Homo sapiens
  misc_feature: GYAE6OF02FG18S.37.34.D01.1.454.CMB.1.raw
  modified_base (308)..(308): a, c, t, g, unknown or other
  misc_feature (308)..(308): n is a, c, g, or t
  modified_base (452)..(452): a, c, t, g, unknown or other
  misc_feature (452)..(452): n is a, c, g, or t
  modified_base (500)..(500): a, c, t, g, unknown or other
  misc_feature (500)..(500): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccagccgtcggggggtccctggagactctcctgtgcagcctctggattcaactttggtagctattggatggactggggtccnccagtctccgagggaaggggctgggagtgggtggccaacagtacaggggtaggtggtagggtaacgaaaaactgtggtaggactctggtggcgggggccattccaccatctcagagaaccaacgaccaaaaactcaactgtatntgacaatcggacgcctagagactccgaggaccacggcttgagttattnttgtgcgagagtattagactaagtaagtttcgagttagacgtggtatgtatcg

SEQ ID NO: 115931 - DNA, 732 bp, Homo sapiens
  misc_feature: GYAE6OF02FSW8Y.37.34.D01.1.454.CMB.1.raw
tcagtagtgtagatcacgaccggtgctcgatttagatcgtctgtgttggggtttgggggtctcagagaggagccttagccctggactccaaggcctttccacttggtcgatcagcactgagcacagaggactcaccatggaattggggctgagctgggttttccttgttgctattttacgaaggtgtccagtgtgacgtgcaactggtggagtcgtgggggaggtcttggtccagccgtgggggtccctgagactctcctgtgcgagtccgtctggtattccgtaacgtttggtagcttagttggaattggactggggtcccgccgagtcctacccgaggggaacggggcgtgggacggtggggtcggaccgaagagtaacgagggggaggtaggttaggggtaaacggaaaaaacgttgtagggtacggtaaccttcgtgggtacgggccgggggtacccgtaagttccgaacccgtcgttcccgtacccgaggaacgtaaacccgaacccggtaacctaaaaaaccctccgtaaaccttagtaactcgtacgaaccgtaaagttccgggaaccgtccgtaggaacgtacgtaccggacgggtaccgaccgggtcgttacgttaggtacgtttagttgttacggtacgtaggtaacggttaacgttaagtaaccgtaaacggttaaggtttacggtaggtacgtaacggttaggttactaggtagttacgg

SEQ ID NO: 115932 - DNA, 814 bp, Homo sapiens
  misc_feature: GYAE6OF02JCECL.37.34.D01.1.454.CMB.1.raw
  modified_base (261)..(261): a, c, t, g, unknown or other
  misc_feature (261)..(261): n is a, c, g, or t
  modified_base (695)..(695): a, c, t, g, unknown or other
  misc_feature (695)..(695): n is a, c, g, or t
  modified_base (702)..(702): a, c, t, g, unknown or other
  misc_feature (702)..(702): n is a, c, g, or t
  modified_base (806)..(806): a, c, t, g, unknown or other
  misc_feature (806)..(806): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagcttgggtttccttgttgctattttagaaggtgtccagtgtgacgtgcactggtggagtcgtgggggagtcttggtccagccgtcgggggtccctggacgactctcctgtgacncgtcctcgtggtacttactaacgttttggagtcgttagttggatgggtaccgttgggtacccgcctacggtccgttacccggaggggggtaaacggggccgttaggggtagggttcggggtacggggtaccccaaacgaacgttaacggaaggggggtacggggttaggggttaaccgggtaaaacggttaaaaaaccgttagttacggggttaacgggtaccgttcgttaggggtacggggtccggggggtacccggtaaccgtttaccgaacccgtacgttacccgttacccggaaaggaaaccgggaaaccgaaacccggaaaccccgtaaaaaactttccgaaacgttacggttaacttccgtaagtaaccgtaaacgttacggggtacccgtacgtagggaccgtacgtaccggacggaccgtacggtntacggtntttaacgttgtacggtgtagggtaacgaggtttaacgtttaagtaacccgttaaactaagggtttttaacgaaggtacggttaccggtaaggttacgttaggtnttaaccgg

SEQ ID NO: 115933 - DNA, 546 bp, Homo sapiens
  misc_feature: GYAE6OF02HLV2Z.37.34.D01.1.454.CMB.1.raw
  modified_base (456)..(456): a, c, t, g, unknown or other
  misc_feature (456)..(456): n is a, c, g, or t
  modified_base (463)..(463): a, c, t, g, unknown or other
  misc_feature (463)..(463): n is a, c, g, or t
  modified_base (500)..(500): a, c, t, g, unknown or other
  misc_feature (500)..(500): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactgggtggagtcgtggggggaggcttgggtccagccgtggggggtccctgagactctcctgtgcagcctctggattcaactttggtagctattggatggactggggtccgccagtctccgaggggaggggctgggagtgggtcggccaacatacgaggggaggtgggtggtaacgaaaaactgtgtggactcgtaggtggcggggccgtattccaccatctccagagacaacgaccaaaaactcactgtatctgacaanggacgcngagacgtacggacgacgacggctgtgttattagttgngcgagagtattagactaataagtttacgagtgacgttggtatgatg

SEQ ID NO: 115934 - DNA, 697 bp, Homo sapiens
  misc_feature: GYAE6OF02HLTU6.37.34.D01.1.454.CMB.1.raw
tcagtagtgtagatcacgaccggtgctcgatttagatcgtctgtgttgggtttggggctcagagaggagccttagccctggactccaagcctttccacttggtgatcagcactgagcacagaggactcaccatggaattgggctgagcgtggttttcctgttgctattttagaggtgtccagtgtgacgtgcaacgtggtggagtcgtgggggaggtcttcggtccaggcccgtgggggtccctgacgactctcctgtgcagcctgtggattacactttggtacgctagttggactggactggtcccgcctagtctccgagggacggtcgtagggagtgggtcgaccgaacgtacgtaacggaggggtaggttacggtagggtaaaccgtaaaaacgttgttacgggtacggtacttccggtgtaccgggtccggggaccctagttaccaccctagttacccgtaccgaaggaacgaaacccgaaccgaaccctaaaaacgtcctaacgtagtaactaccgtgaacctaaacggttcggaccggtaccacgggtaagtaccgtaccggacggaccgtaccggtcgttacgttacgttaattagtttacggtagaccgggtaagtaacggttaagtttaaccggaacgttaaaccgttagttaccggtagtacggtattacgggttatagtagtacgg

SEQ ID NO: 115935 - DNA, 736 bp, Homo sapiens
  misc_feature: GYAE6OF02HIFF7.37.34.D01.1.454.CMB.1.raw
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaaggtgtccagtgtgacgtgcaactggtggagtcgtgggggaggcttggtccagccgtgggggtccctgacgactctcctgtgcagccctctggattctaaacgttttggtagcttagttggatggactggggtcccnccagttcctccgaggggagggctgggagtggggtgaccaanatacgaggggaggtggtagggtaaacgaaaaacttgtggtaggtactcgtaggtgggcgggggtcctaagttccaccgtatcccgtccgaacggaacgaaccaaaacccggaacccgaaaaaaaaccttccgtaaacgttacgggttaacttaccgtaggtaacctaaaaggttccggggaaccgggtcccttaagggaacggtaacgttacccgggaagggtaaacccggacggtccgttaggtcggttttaattacgtttgggtaccgtacgggtaaggtacgtttaaacggtttaaccggaaccttaaacgtttaaaacgggtttcggtaacggttacggtaaccgttagggtttaagttacgggtaatttaccggg

SEQ ID NO: 115936 - DNA, 353 bp, Homo sapiens
  misc_feature: GYAE6OF02J3E1T.37.34.D01.1.454.CMB.1.raw
  modified_base (316)..(316): a, c, t, g, unknown or other
  misc_feature (316)..(316): n is a, c, g, or t
  modified_base (335)..(353): a, c, t, g, unknown or other
  misc_feature (335)..(353): n is a, c, g, or t
tcagtagtgtagatcacgaccggtgctcgatttagatcgtctgtgttgggtttggggggaagaggaagactgacggtcctgccacaggtggtgctgagggaagagatggaggtggacgtgtcagcacccagctgggcctgtccctggtcaccgtctcctcacgtcctaccaccgaacgggcccagtccggtcccttcccccgtgggccgccctgcctccgaggagccaccgtcgagacgcacgagccggcccgtgggctcgaccgtcggtacaaggtcctaccttccaatcctaccactacgtcggaggccgggtnggacaagggcctcaagtgnnnnnnnnnnnnnnnnnnn

SEQ ID NO: 115937 - DNA, 801 bp, Homo sapiens
  misc_feature: GYAE6OF02GJRJK.37.34.D01.1.454.CMB.1.raw
  modified_base (362)..(362): a, c, t, g, unknown or other
  misc_feature (362)..(362): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctatttagaaggtgtccagtgtgacgtgcaactggtggagtcgtgggggaggcttggtccagccgtggggggtcccctggagactctcctgtgcagcctctggattcaactttggtagtctagttggatggtactgggtcccgccagtcctccgaggggacgggcgtggaggtggtcgaccaacagtacgaggggnggttggtaggtaaacgtaaaaactgtaggtacggacttcgtaggtcgggacgggggtcccgtaagtttcccgaacccagttcccgtacccgtaaagggaaccgtaaaccccgaaaaccggtaaaccccctaaaaaaaacccgtcccgtaaaccgttaacggttaaccctttacggttaaccgtaaaccgttaaaaacgggttccgggggaaacccggtacccggtaagggaacgtaccgttacccggggaaacggaacccgggaaccgggttcgttacggtttacggtttaaacggttttagtttacgggtacggtaccggtaaggtaacgggtttaaacgttttaaacggtaaacgtttaaaccgtttaaaggggttttacccgtaagggttaaccgggttaacggtttaggggttaacgttagggtacgtttaacgg

SEQ ID NO: 115938 - DNA, 597 bp, Homo sapiens
  misc_feature: GYAE6OF02GGMMA.37.34.D01.1.454.CMB.1.raw
  modified_base (347)..(347): a, c, t, g, unknown or other
  misc_feature (347)..(347): n is a, c, g, or t
  modified_base (593)..(593): a, c, t, g, unknown or other
  misc_feature (593)..(593): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccaggccgtggggggtccctggagactctcctgtgcagcctctggattcaactttggagtctattggatggactgggtccgccagtctccgagggaaggggctggagtgggtggccaanagtacgaggggagtgggtaggtaacgaaaaactgtaggttacgactacgtggtgggcggggcccgtatttccgaacctatccgtaccgaggaagaacaaaccggaacccaaaaaactccaacttacgtatacgtagaccaaagtacggacggcctagagacgtaccggagaccgacggccttagtgtattagtagtgagagtagtattagactaataacgtttagagttacgacttaggtatagtntacg

SEQ ID NO: 115939 - DNA, 747 bp, Homo sapiens
  misc_feature: GYAE6OF02GVX8C.37.34.D01.1.454.CMB.1.raw
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (350)..(350): a, c, t, g, unknown or other
  misc_feature (350)..(350): n is a, c, g, or t
tcagtagtgtagatcacgaccggtgctcgatttagatcgtctgtgttgggttttccttgttgctattttagaaggtgtccagtgtgacgtgcaactggtggagtcgtgggggaggcttggtccagccgtggggggtccctgagactctcctgtgcagcctctggattcaactttggtagctagttggatggactgggtccnccagtctccgagggaggggntggagttgggcggccaanagtacgagggnggtgggtagtaacgaaaaactntggtaggactcgtgtggccggggcctagttcaccacgtctacgagacgaaccaacgaaccaaaaactcacgtgtactntgacaaacgtggaccgtcgtagacgtacgtccggaacgaccgtaccgtgttgtaagttacttagtttacggaggtacgaagtacggttaagtttaaacgacgttaaacgtttaaacgtttacggtaacgtcgggtaacgttagggttacgtagtagtttaggtacttaggtacgtaaccgttaccggggtaaccggggtaacccgtaaacggggaaccgtacgttaccgggtaaccttacccggttactttaccggtccctaaaccggtccccgtaacccgaacgggtaacccgtcccgtacgttaccccgtccgtttcccccgcgggtacccgtcccgtactcccggtccaaacccggtcgaccgtaccgtccggacgacgacgtaccgtaccggg

SEQ ID NO: 115940 - DNA, 541 bp, Homo sapiens
  misc_feature: GYAE6OF02G681A.37.34.D01.1.454.CMB.1.raw
  modified_base (355)..(355): a, c, t, g, unknown or other
  misc_feature (355)..(355): n is a, c, g, or t
  modified_base (424)..(424): a, c, t, g, unknown or other
  misc_feature (424)..(424): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccaggccgtggggggtccctggagactcgtcctgtgcagcctctggattcaaacttttggtagctattggatggactggggtccgccagtctccgaggggagggctggagtgggtgccaacatacgngggaggtggtgtaacgaaaactgtgtggactctgtgcggggccagttccacatctccagacgacgaacnccaaaaactcatgtatctgacaaagtggacgtcctagacgactccggagacacggctgtagtatagttgtgcgagagtattagactaagtaagtttcgagttacgatggtattgatg

SEQ ID NO: 115941 - DNA, 722 bp, Homo sapiens
  misc_feature: GYAE6OF02H31T1.37.34.D01.1.454.CMB.1.raw
  modified_base (232)..(232): a, c, t, g, unknown or other
  misc_feature (232)..(232): n is a, c, g, or t
  modified_base (575)..(575): a, c, t, g, unknown or other
  misc_feature (575)..(575): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttggttttccttgttgcttattttagaaggtgtccagtgtgacgtgcaacgtggtggagtcgtgggggaggtcttggtccngccgtcggggggtccctgacgtcctctccgtgtcgcacgtccttcgtggtactttcctaacgtttttggacgtactaagttcggagttcggacgttcggggtcccgcccgaggtcctccgagggctaggtgggggactggaccgtaggtcgggtactacgtaaagttacgtgttcgtccgttcgtagggttaataaggtcgacacgactaccggacgtaagacccgttaccggtagggtaacgggtcccggttaccaaccgtacgtcccgtacgaacgaacgaactaaacgttaccaaaagaccaaccgtactcgtacgtactacgaactaaagtacgaaacncggtaccgtaagaaacgtacgtaacggaaggaacccgtacggtacttaaacgttcgttaacggttgttacgggtaaagtaacgggtcgggttacgggggacggggttaacgggaccggttaacgggccgggggacccgtaaccgggg

SEQ ID NO: 115942 - DNA, 768 bp, Homo sapiens
  misc_feature: GYAE6OF02IDE4Z.37.34.D01.1.454.CMB.1.raw
  modified_base (461)..(461): a, c, t, g, unknown or other
  misc_feature (461)..(461): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcacatggaattggggctgagcttgggttttccttgttgtcttattttagaaggtgtctagtgtgacgtgactaactgggtggagtcggtgggggaggtcgttggtccaggccggttcggggggtccctggagaccttctccgtgtcgcacgtccttcgtaggtacttacctaacgttttggtaacgcttaagttggagttgggaccgttcggggtcccgccgaaggttccgtacggaggggacggggcgtagggtcggtggggtcggaccaacgtagtaacggaggggtaggtggtaacggtaaacgtaaaaacgtgttgtacggacttacgngggtacggccggggtacccgtattaccgtacccgtacgtaccgttacccgaacggtacgaaaccccgaaacggaaaccctaaaaaaccgtccgtaacgtcggtttaacacgttacgaacgtaaaggtaccgggacgggtacctaggtaacgtaccgtacgggacgaaccgcggttccgttagttcgtttaaagttcgtttagaccgggttacgaggttaacggttaacgtttaaggttaacccgtaaagtttaacggtttaccggtaggttaaccgtacgtttaaggggtactaggttccttaacgg

SEQ ID NO: 115943 - DNA, 406 bp, Homo sapiens
  misc_feature: GYAE6OF02FK584.37.34.D01.1.454.CMB.1.raw
  modified_base (202)..(202): a, c, t, g, unknown or other
  misc_feature (202)..(202): n is a, c, g, or t
  modified_base (357)..(357): a, c, t, g, unknown or other
  misc_feature (357)..(357): n is a, c, g, or t
  modified_base (359)..(406): a, c, t, g, unknown or other
  misc_feature (359)..(406): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagctggggcctgtccctggtcaccgtctcctcacgccctccaccaacgggcccatcgatccttccccgtggccnccctgcctccgaggacgccaccgtccgagacgcacgacggccgggcccgtgggcctcgtccgttcggtaccgaaacggtaccttaccttcctactacctaaccgtacctagtcggacggtccgggcgtaagggaccgaacgggcgacgtagtagngnnnnnnnnnnnnnnnnnnnnnnnnnnnnnnnnnnnnnnnnnnnnnnnn

SEQ ID NO: 115944 - DNA, 449 bp, Homo sapiens
  misc_feature: GYAE6OF02IBUAK.37.34.D01.1.454.CMB.1.raw
  modified_base (340)..(340): a, c, t, g, unknown or other
  misc_feature (340)..(340): n is a, c, g, or t
  modified_base (395)..(449): a, c, t, g, unknown or other
  misc_feature (395)..(449): n is a, c, g, or t
tcagtagtgtagatcacgaccggtgctcgatttagatcgtctgtgttgggtttgggggaagaggaagactgacggtcctgccacaggtggtgctgaggaagagatgggaggtggacgtgtcacgccacccagcgtggggcctgtcccctggtccacccgtcctccctcacgccctccacccgaacgggcccctagtcccggtcccttccccccgtggcccgccctcgcctaccgacggacgccacccgtccggagacgcaacgcggcccgggcccgtgggctcggcccgtagggtacaacgggtactacccttaccattaccctaacccaacgttaaccncgggacggccgggtactagggacccaaagggcccggaacttaagaggcctgaagnnnnnnnnnnnnnnnnnnnnnnnnnnnnnnnnnnnnnnnnnnnnnnnnnnnnnnn

SEQ ID NO: 115945 - DNA, 957 bp, Homo sapiens
  misc_feature: GYAE6OF02HWVJO.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctggagcttgggttttccttgttgcttattttagaaggtgtcagtgtgacgtgcaactggtggagtcgtgggggaggtcgttcggtccaggcccggttgggggggtcccctggaacggtacctccttcccgtaggtcgcacgcccttcttggtaactttcctaaacgttttgggtacgtcttagtttagggtagttcgggtacgttcggggttaccccgcccgtaaggtttcccgtacccggaaggggggggtaacgggggtccgttaggggggtaaggggttggggggtaccgggtaccccgaaaacgtaagttaaccgggtaaggggggtaagggggtttagggttaacggggttaaaaaccggtaaaaaaaacctttaggttacgggttaacgggtaaccttaccggttggggttaccgggggacccggggggtaccccgtaacgttttacccgaaaccccgtacgtttacccctaaccggtaaagggaaccggtaaaaccccgaaacccggtaaaaacccctaaaaaaaccgttcccaacgtttacggttaaaccgttccttaacggaaacgtaaaaggttaccgggggacccgggtacccgtttacggaaacggttaaccgttacccggggaaacggtaacccggaacccggggttcgtttggtttaacggtttaagttttaagttttagggcgggtaaccgggttaagtaaacgggtttaactttttaaacggaaaccctttaaacggtttaaaggttttccggaacggttacgtaaccggtttaaggtagttacggtagtttacgg

SEQ ID NO: 115946 - DNA, 1005 bp, Homo sapiens
  misc_feature: GYAE6OF02GQZB0.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaaccagtggaagttggggctgagcttgggttttcctgttgcttattttagaaggtgtccagtgtgacgtgcaacgtggtggagtcggtgggggaggtctttgggtccaggccggttcggggggtaccctggacggaccttccttccgtgtcgaccgacgtcccttacgttggtaacttaccgtaaacgttttagggtaacggtcctttaaggttggggaacgttgggtaacccggtttcggggggtccccgtaccggaaccggtttaccccggtacccgggtaaaggggggtaaaccggggtccgtttaggggggtaacggtcgggggggttaccggaacccctaaaaccgaggttaaccggaaggggggtacggttaggggtacggggtaaaaaccctaaaaaacggttggtacggtagggtaacccgtttacggttgggtacgggggtaccggggggaaccccttaacgtttaccccgaaaacccgggttaaaccttccccgggttaaacccgtaaaacggggaaaacccgtaaaccccgaaaaaccccgggtaaaaaccctaaaaaaaccgtttaaccccggttaaaccggtttaacgtttaaacccgttaacggttaaccgtaaaccccgaaaagggtttacccggggaaaccggttaccggtaccggtaaggttaaccccgggtaaccccggggtaaacggaccgggttaaaccgggcgttttaaaccgggttggttttaaaccgttttaaaggtttcgggtacgtaaccgggtaaaggttaacgtacggttttaaaacgtaacgttaaaaacgttaagggtttaccgtaacggttacggtacggtttaagtaagtacggtaattacgg

SEQ ID NO: 115947 - DNA, 658 bp, Homo sapiens
  misc_feature: GYAE6OF02F5H3E.37.34.D01.1.454.CMB.1.raw
  modified_base (494)..(494): a, c, t, g, unknown or other
  misc_feature (494)..(494): n is a, c, g, or t
tcagtagtgtagatcacgaccggtgctcgatttagatcgtctgtgttgggtttgggggtctcagagaggagccttagcccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttgggtccaggccgtcggggggtcccctgagacctctcctgtgcagcctctggattcaacgtttggtagctagttggatggactgggtcccgcagtctccgaggggaaggggctgggaggtgggtgggaccaacgacgtacgaggggacgggtggtagggtaacgaaaaacgttagtggtaggtactcgtaggtggccgggggccgtagttccgacctatcctaccgagacgaacaaccgaaccctaaaaactcaacttgtaactcgtanaacgtaaagtcggacgcctaggagtacgtaccggaggaaccgacggtccgttaggttcgttaagtttagttcgtagtcggaaggtaggttaattaacggaacctttaaacgtaaacggttttacggaagtttacggtacgttagggtaacgttagtagttacgg

SEQ ID NO: 115948 - DNA, 720 bp, Homo sapiens
  misc_feature: GYAE6OF02GMJDO.37.34.D01.1.454.CMB.1.raw
  modified_base (708)..(708): a, c, t, g, unknown or other
  misc_feature (708)..(708): n is a, c, g, or t
  modified_base (715)..(715): a, c, t, g, unknown or other
  misc_feature (715)..(715): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttgggtccagcctggggggtccctgacgactctcctgtgcagcctctggatcaccttcacgtagctatagacactgtaaacgtggggtccgccgaggccttaccgaacgggggtaacgggggtcgtgggaggttcgggggtccttaccgaacttcccgtaagtttaggtaagttagttacgggttaacctttaactagttaacgttaacttaccgacgtaacgaccgttactaacggtagggaacgggggtcccgtaactttccaacctacgttaccgtccgtaaacgtagaaacccgaaaccggacccgaaacggaaaccttcgaacttggtaactccgttaggacctaaaatcggaaaccgtagtccgttacgaacgaacgggtacccggaaaggtaccgaaccgggcggtttacgtacggtttaactttaacgtcgggttggaacccggtaacgacgggtacccccttaccaccccggtttanaccgganaacgg

SEQ ID NO: 115949 - DNA, 817 bp, Homo sapiens
  misc_feature: GYAE6OF02G4OXP.37.34.D01.1.454.CMB.1.raw
  modified_base (179)..(179): a, c, t, g, unknown or other
  misc_feature (179)..(179): n is a, c, g, or t
tcagtagtgtagatcacgaccggtgctcgatttagatcgtctgtgttgggtttggggctcagagaggagccttagccctggactccaaggcctttccacttggtcgatcagcactgagcacagaggactcaccatggaattgggctgagctgggttttcctgttgctatttagaaggtntccagtgtgacgtgcaactgggtggagtcgtggggggaggcttggtccagccgtggggggtccctggagactctcctgtgcacgtcctcgtaggtacttacgtaaccgttttggtacgtcttagtttgggattacgggacgttcgggggtacccgtcccgtaaggttcccgtaccggaacggggggtaagggggtccgtagggtacgggtgggggttccgggaacctaaaccgtaacgtacggaaggggtacgggttgggttaacggtaaaccgtaaaaaacgttgtagggtacgggaaccttggtagggtcgggtccgggggtaccgtaagttacccgaaccgtagtacccgtaccgaacggaacgaaaccgaaccggaaaaccctaaaaaaccgtccaacgtagttaactccgtaagtaaccgtaaaggttcgggaccgggtaccgtaggaaccggtacgtaccccgggaagggacccggtaacgggccgtttagggttagggtttaaattttaacggttcgggtacggtaccggtaaggttaacggttaaacggttttacggtaaacgttaacgtttaaaggtttaccgggtaagttaccggtaagtttacggggtaattacgggtactttacgg

SEQ ID NO: 115950 - DNA, 602 bp, Homo sapiens
  misc_feature: GYAE6OF02F5G1O.37.34.D01.1.454.CMB.1.raw
  modified_base (351)..(351): a, c, t, g, unknown or other
  misc_feature (351)..(351): n is a, c, g, or t
  modified_base (450)..(450): a, c, t, g, unknown or other
  misc_feature (450)..(450): n is a, c, g, or t
  modified_base (595)..(595): a, c, t, g, unknown or other
  misc_feature (595)..(595): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccagggaaggggctggagtgggtggccaacatacgagggaggtgggtaggtaacgaaaaactatggtggactcgtgtggcggggccgattcaccatctccagagacaacgaccaaaactaccactgtatctgacaaagtggacggntccccccgagactccggacggacaccggcgtgtgtattattgtgcgagagtatttagtactaactaaagtttcgtagtagtacgtaggtagtgatagtnttatagtacgtaccggtacgggaccgaacgggaccagtcgtccgaccgttctcttacgcgtacctccaaccgacggcctacgtccgtcccgttcccgtcggccgtccctcgccgtccgacggacgaccaccgtccgacgacgacncgaccgg

SEQ ID NO: 115951 - DNA, 616 bp, Homo sapiens
  misc_feature: GYAE6OF02JME8I.37.34.D01.1.454.CMB.1.raw
  modified_base (175)..(175): a, c, t, g, unknown or other
  misc_feature (175)..(175): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
tcagtagtgtagatcacgaccggtgctcgatttagatcgtctgtgttgggtttgggggcgaggagtcagacccactcaggacacagcatggacatgagggtcccgctcagctcctggggctcctgctgctctggctcccagtgccagatgtgccatccaaatcgaccccagtccnccatcctccctgctagcatactgtacggagacagtacgtcatcaatccaacgttggccggcaagtcgaggcattagaatgtattaggctggtatcagactagaaccaggtaacgaccctaaggcctaccgtacacttcaagttcgggtcactactaccggtaagttaccgtaaacggttcggtacccgtaatttaaggtacctttacgaagccgggtacaagggtttacggacttccgtagggccaacttaggttattaaccctntttaccgcaacgtctactaacgggntacgctcganacgtcgtacgtagtattcgacttattacttctattacgtataacgttctaaacttagtacctacggtttccgacgaccgtaagggaccttaagggtaaccggtagaaacccgttacgacgttagtacggtcgacaacgtcc

SEQ ID NO: 115952 - DNA, 990 bp, Homo sapiens
  misc_feature: GYAE6OF02JBPL2.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggtttccttgttgcttattttagaggtgtccagtgtgacgtgcaacgtggtggagtcgtgggggagtcgttggtccagccggtcgggggtccctggacgacctccgttcctggtgcgacgtcccgttcgtggtatttaccgtaacgttttagggtacggtacgtttaacgttgggtaagttcgggtaacgttccggggtcccgaccgtacggttccgtaccggaggggggtaacggggcgtggggtaggggttggggtaccgggaacccgaaacgtaacggtaacggtagggggtaagggggttagggttaacgggtaaaccggtaaaaaacgttacggttacgggtacggtaacgttccggttacggggttacggggaccccgggggggtaccgttaccggtttacccgtaaccccgttacgttacccgtaaccccggtaacgggtaaacccggaaaccggtaaaaccccggaaaacccctaaaaaccgttacccgttaaccgttaacgtttaccgttaccggttaacgggtaacccgttaaaacgggttaccgggggaaccccggggttacccgtaacgggaaaccggttaacccgggtaaccccgggtaacggggtaaccccggttaccgggttacccgtttaagggtttacgttttaaagttttacgggtttacggggtacggttaccgggttaaggttaaaccgggttttaagttttaaaaccgggtaaaccgttttaaaaccggttaaacggttttttaaacccgggtaaggggttttaccggttaacgggttttaacgggtttaacggtttaggttaacggtttaaccgg

SEQ ID NO: 115953 - DNA, 794 bp, Homo sapiens
  misc_feature: GYAE6OF02GZ2RK.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggcctcccaggtgccagatgtgccataccaaatcgacccagtcctccactccctccttgtctgactatcgtaggtaggagacagtagtcatacattctaccgttggaccgggacaggtcgaggactaagtaagaatgtagttagcgttagtatcagacaacgaacgaacggaacctacccgtaagtcctccgtactaacttcttagtcgtacgctaacttacgttaacgtttaacgaacggttccgggtaaccttaagttaagtcgttacgacgtacggagtacggtagtacgtcggtacgactacgttacttaccgttacctaccgtaccttaaccaccgtaacgtaccgacgtacgtaccgaccgtacggtaccgtacgtacgttaacgttaaacgtttactttaaccgtaacgtttaaaccttttacgtttaacccgttacgttaaaccgttaactaaacgtttaaacccgtttaaacgttaacccccgtttaacccggtttacccgggtttaccgggttaaacccgggttaaccccgggtaaaacgggtaacccgggttaaaccgggttaaacgggtaaccggttaaaaacccggtaacccgggtaaaacgggtttccggttaaccgggaccttaacccggtaacccgtttaacccgg

SEQ ID NO: 115954 - DNA, 739 bp, Homo sapiens
  misc_feature: GYAE6OF02GAOYL.37.34.D01.1.454.CMB.1.raw
  modified_base (252)..(252): a, c, t, g, unknown or other
  misc_feature (252)..(252): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaggtgtcagtgtgacgtgcaactggtggagtcgtgggggaggtcttggtccagccgtgggggtcctgagctctctgngcagtcctcgtggtaacttcaacgttttggtgtacttagttcggtagtcggacgttcggggtcgtcccgagtccgttaccggaggggtaacgggggcttagggnggtcgggtcgggaacccaanaagtacggaggggttagggtacggttagggtaaaccgaaaaagtactagggtacggtacttacggtggtgggtcccggggtacggtacgtttccgaaaccgtcgttaccgtaccgaacggaacgttaacccgaaaccggtaaacccaaaaaccgttacgaaacccgttggtaaccttacggtaactaccgtaaacgtacgggaaccgggtacccgtaggaacgttaccaccgggaacgaaccggtaccggtcgttacggttagttacgtttagttaagtcgggacgtaaggtaggtaaacgtttactaccgtaagttaacgtttacggtaacgttcggtaccgaggtttactgtacgttacgg

SEQ ID NO: 115955 - DNA, 875 bp, Homo sapiens
  misc_feature: GYAE6OF02FSEQS.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagtcgtgggttttccttgttgcttattttagaaggtgtccagtgtgacgtgacaacgtggtggagtcgtgggggagtcttggtccacgtccggtcgggggtccctggacgtacctccgtccgtgtcgccgacgtcctcgtcggtactttaccttaacggtttggtacgtacgttagttacggagttcgggtacggttccggggtcccgtccgtacggtacccgtaccgggaaggggggtaacggggtccgttagggggtacgggttcgggggttaccggaaacccgtaaaacgtaacggttaaccgggaagggggggtttaacggggtttacggggttaaaccgggttaaaaaaccggtaaaaaaccgttttacgggttacggggttaacgggttaacccgtttacgggttacgggggttacggggggacccccgggggttaacccgtaaccgttttaaccccgaaacccgttacccgtttacccgtaacccgaaaggtaaaccgtaaaaccccgaaaccggtaaaacccctaaaaaacctccgtaacgttagttaccgtacgtacgtaaacgtaacggccgggtaccgtacctaggaacgtaccgacggacgacggtaccgtcgttagtagtttactttcggtaggtcgagtaaggtattaacgttaagtaaaccttaacggtaagttccggaagttacgttacgtaggtagtacgtagttacgg

SEQ ID NO: 115956 - DNA, 737 bp, Homo sapiens
  misc_feature: GYAE6OF02HJF6N.37.34.D01.1.454.CMB.1.raw
  modified_base (360)..(360): a, c, t, g, unknown or other
  misc_feature (360)..(360): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggggctgagctgggttttccttgttgctattttagaaggtgtccagtgtgacgtgcaactggtggagtcgtgggggaggcttggtccagccgtggggggtccctgagactctcctgtgcagcctctggtattcaacttttgggagtcttattggattgggacctggggtcccgccagttcctccgagggggaagggcgtgggaggtggggtgacccaanagtacgaggggtaggtggtaggtaaaccgaaaattagtcggtaggacttcgtgggtcggaccgggggccgtaacgttccgaacccgtactccgtacccgaacggaacgtaaacccgaaaccggaaacccctaaaaaactcccgtaaccttacgttaacttccgttaaggaacccgtaaaaggtaccggggaaccgggtaccccgtaggtaacggtaaccggtacccgggaaaccgggaaccgaccggggtaccgttgtttaacggttaagttttaagttggtcggacgggtaggtaacggttagtttaacgaacgtttaaacgttaaacggttttacgtaaggttacgtacgttttaggtaacttcggtaatttcgg

SEQ ID NO: 115957 - DNA, 849 bp, Homo sapiens
  misc_feature: GYAE6OF02FTG8W.37.34.D01.1.454.CMB.1.raw
  modified_base (243)..(243): a, c, t, g, unknown or other
  misc_feature (243)..(243): n is a, c, g, or t
tcagtagtgtagatcacgaccggtgctcgatttagatcgtctgtgttggggtttgggggcaggagtcagacccactcgaggacacagcatggacatgagggtccccgctcagtctcctggggctcctgctgctctggctcccagggtgccagtatgtgccatccaaatgacccagtctccatcctcctgtctgcagtcctgtaggacgactagagtacatacactcgtacttggcccgggtanaacgtccgagggacattagaaatggtagttacgctggtatcagacaagaaccgacgggtaaacgcccctaacgcttacccgtacacttacgttacggtcggtgaccgtacttacccgtaagttttaaccgaacgttacggggtaccctaagttaaacggtactttacggacggtacgggtaccgtaagggttacggaacgtaccgtagggtaccaacgtacggtaacttttaccaccgttccttaaccgaacccgtacgtaaccggagtacccggtaacgggcccgttcggtacccttacgtaccgttaggttaaacgggtttaacctttttaacgggtaaccttttaaacgttttaacgtttttaccgtttacgggtttacccttaaacccgttttaaaaggtaaccgtttaaaacccgtttaaacccgttttaaccccgggtttaccggtttaaccgggtttaacccgggaaccccgggttaaaaaccggggggtaacccgttaaaacggggggttaaccgggttaaacggttaaacccggtaaaacggttaaacccgtttacggggttaccgggtaccggttacggtaaccccgttaacccgg

SEQ ID NO: 115958 - DNA, 696 bp, Homo sapiens
  misc_feature: GYAE6OF02GCUQC.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctggagcgtggtttcgtgtaggctatttagaaggtgtccagtgtgacgtgcaactggtggagtcgtgggggagcttggtccagccgtgggggtccctgagctctcctgtcgcagcctctaggtacttcctaaccgttttgggtagtccttaagttgggaagttgggacttcggggtaccccgaccgacggttcctaccggaaggggaacggggtccgttagggcggttggggtcgacccgaacgtagtaccggtaggggaggttggtacgggtaaacgaaaacttgtaggtacggcctagtggtggccggggtacgtacgttccaactacgtcctaccgagtacgacaacgccaaagtaccgtccgtgactacgttcgtacgtacaacgtacgaaacgtgttaccggagaaggtaccgcggtaacggaaccgtacggttaaccttagtttaacgttacgtacggcgtacggagtaacgggaacggtacggttgggtaccggtttacgaacggttcgggtaccgggtaccgaacggttacccggtggtacccg

SEQ ID NO: 115959 - DNA, 720 bp, Homo sapiens
  misc_feature: GYAE6OF02IGZGQ.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctgggggaggcttggtccagcctggggggtccctgagactctcctgtgcagcctctggattctaactttggtagctattggatggactgggtcccgccagtctccgaggggaacggggctgggaggtgggtggaccaacgtataacggaggggagggtggtaggtaaacgaaaaaactatggtaggactcgtggtcggcggggccgtattccaaccactcctccagacgaacaaccgaacccaaaaactacacgttagtatcctagaacaaagtcggaccggcctgagataccggagacgacggctgtagttattagttgcgacgagtaagtaatttagaacttaaagtaagttttacgagttacgagttaggtagtagaattcgtatttaacgtagtaacgtaccggtacggggaccgtaacgggtaacctaggtccggttaccgtacccgttccttacgttaccgaccgtacccctaccaaacccgggtaaccgggcccttaacggttcccggttacccccgttcccggtacccggcccgtcccggttacggtccgttcccggaacgacccggtaccgaacccggttcggaccgacgacccgtaccggaccggg

SEQ ID NO: 115960 - DNA, 616 bp, Homo sapiens
  misc_feature: GYAE6OF02GB5WW.37.34.D01.1.454.CMB.1.raw
  modified_base (310)..(310): a, c, t, g, unknown or other
  misc_feature (310)..(310): n is a, c, g, or t
  modified_base (375)..(375): a, c, t, g, unknown or other
  misc_feature (375)..(375): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttcctgttgctattttagaaggtgtccagtgtgacgtgcaactggtggagtctgggggagcttgggtccagccgtggggggtccctgagactctcctgtgcagcctctggattcaactttggtagctattggatggactgggtccgcagtcnccaggggaggggctgggacgtggggtgccaacgatacgagggaggtggtaggaaacgaaaaactntgggtggacttcgtggtcggcggggggccgtaattccgaaccctagtcccttccgaaggtacgacaaacggacccaaaaactccactgtatctgactaaagtcggacgcctaggaacgtacgtcccggaaggaccgacgggtacgttcgtagttaatttacgttgtgaccggagaggtaatttaacgaacgttaaacgtaaggtttcgaagttcggaacttgggtaacttaggattaccgg

SEQ ID NO: 115961 - DNA, 653 bp, Homo sapiens
  misc_feature: GYAE6OF02FOZX4.37.34.D01.1.454.CMB.1.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgtggtttctgtgctatttagaaggtgtccagtgtgacgtgcaactggtggagtcgtgggggagcgttggtccaggccgtgggggtccctgagactctcngtgcagcctcgtggattcaactttggagtctattggatcggacgtcgggtcccnccgagtcctccggaagggtaaggggctgggacggtgggtcggaccaacgtagtaccgaggggtggtgggttaaggtaacgtaaaaacgtcgttaggtaggtaccttgtagggttgggccggggacctagttaccgactacgtctaccgagaacgaacaaaccgtaaccgaaaaacctcgaacttcgtaacttaccgtagaactaaacggtcggaccgtacgtaggaacgtagtaccggacgaccgtaacggtcttaggttacttattagttgtagcgaagtagttaacttaacggtaactaaacgttaacggtttaggagtaggttaccgttagggtacttagtattacg

SEQ ID NO: 115962 - DNA, 617 bp, Homo sapiens
  misc_feature: GYAE6OF02GQJCU.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggcccagccgtggggggtccctggagactctcctgtcgcagtcctcgtggattcaacgtttggtagcttagttggatggacgtcgggtcccgccagtcctccgaaggggaagggctgggaggtggggtcgccaaacgagtaacgaggggaggtgggtaggtaaacgaaaaacttgtaggtaggactcgtggtcggcggggccgtattccgaacctatcctaccgaagacgaaccaaaccgaaccaaaaactccaactcgtaactctagactaaagtcgggaccgcgtagacgactccggaaggaccgacggtctgttagtaattagttgtgacgagtagtaatttacgaacgttacgtaaacgtttcgagttcgtacgttaggtagtagattacgg

SEQ ID NO: 115963 - DNA, 925 bp, Homo sapiens
  misc_feature: GYAE6OF02IHPYY.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagactctcctgtgcagcctctaggtattccaaacgttttggacgacttagttggggaattgggaccgttcggggtcccgacctacggttccgtaccccggaaggggggaaacggggtccgtaggggtaagggttcggggggtacgggaaccccgtaaaacgaacgttaaaccgggaaggggggtaaggggttacggggttacgggtaaaaaccggaaaaaaaacgttcggttagggtaacgggtaccgtttacggttcgggtacggggtacccggggggtacccgtaacgtttccgaaacccgtacgttacccttacccgaaacggaaccggaaacccgaaaacccggtaaacccaaaaaaaccgttcgtaaacccgttgttaaaccgtcctaacgtaaccgaaaaggttaccggggaaccggtacccggtaagtaaccgggtaacccgttacccgggaaaccgggtaacccggaaccggggttacgttaaccgggtttacggtttaaacgttttaacggttacgggttacgggtaccgggtaaaaggtttaacgggtttaaacttttaacgggtaaacccgttttaaaaaccggttaaaacggtttttaacccgggaagggtttaaccggttaaaccggtttagggggttttaaattaacgggtaacggtttaaaccgg

SEQ ID NO: 115964 - DNA, 789 bp, Homo sapiens
  misc_feature: GYAE6OF02J19FA.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagtcgttgggttttcctgttgcttattttagaaggtgtccagtgtgacgtgcaacgtggtggagtcgtggggggagtcgttggtccagtccggtggggggtccctggacgtaccttcctcctggtcgcacggtccctcgtggtattccgtaacgttttgggtagtcttaaggttgggagttcgggtacgttcgggggttccccgccgtacggtcccgtaccgggaaggggggtaacgggggtcgtgggggtaggttcggggtacggaccaacgtacggtaacggagggggtaggtagggtacgggtaaacgaaaaacgtgtaggtcggacgttacgtggtccgggccggggtaccgtacgtcccgaactacgttcccgtacgaacggtaaaccgaacccgaaaccgaaccctaaaaaccgtcctaaccgttagtaactcgttacgaccgtaaaggtccggaccggtaccgagtaaccggacggtacccggaacgggtaccgacggtacgttacggttacgttaaagtttcgttcgggtcgtacgaaggttacggtaacgttttaaccgtacgttaaaacggttaaggtttaccggaaggtttacggaacgggttttaggtttactaggttaacggttacg

SEQ ID NO: 115965 - DNA, 754 bp, Homo sapiens
  misc_feature: GYAE6OF02IZ09A.37.34.D01.1.454.CMB.1.raw
  modified_base (206)..(206): a, c, t, g, unknown or other
  misc_feature (206)..(206): n is a, c, g, or t
tcagtagtgtagatcacgaccggtgctcgatttagatcgtctgtgtttgggttttccttgttgctattttagaaggtgtccagtgtgacgtgcaactggtggagtctgggggaggcttggtcccagccgtggggggtccctgagactctcctgtgcagcctctggattcaacttttggtagcttattggatgggacttggggtccnccagtcctccgaaggggaaggggctgggagtgggtcgccaacgatacgaggggaaggtgggtacggtaaacgaaaaactagtggtaggaccttcgtggtcggcgggggtcccgagtttccaacccatcctacccgagaacggaacgaaccgacccaaaaaacgtcaacttaggtaatctgacgaaagtggaccgccgtagagacgtcccgaaggaccgacggctaggtgtaattatttggtgacggagagtatttaaggaacttaacgttaaacgtttacgaacgttaggtaacgttcgggtaattaggattcgtacgttaatcgtaacttacccgggttaggggacccgtaaacggggacctaaagtcggtaccgtaacccggttcttacccgttaccgtacgacccgttacccgaaacccgggaacgggtaccccctaaggttcccggttacccttacccccggtacggtcccgtaccccgtcgacccgtacccgtaacggaccgacgtaccccgtacggaccggaactaccgaccgtaacccggg

SEQ ID NO: 115966 - DNA, 552 bp, Homo sapiens
  misc_feature: GYAE6OF02GFRVJ.37.34.D01.1.454.CMB.1.raw
  modified_base (247)..(247): a, c, t, g, unknown or other
  misc_feature (247)..(247): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (477)..(477): a, c, t, g, unknown or other
  misc_feature (477)..(477): n is a, c, g, or t
  modified_base (547)..(547): a, c, t, g, unknown or other
  misc_feature (547)..(547): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagctgggttttcctgttgctattttagaaggtgtccagtgtgacgtgcaactggtggagtctgggggagcttggtccagcctggggggtccctgagactcncctgtgcagcctctggattcaactttggtagctattggatggactgggtccgccagtctccgagggaaggggctggagtgggtggaccaacatacgagggagtggtaggtaacgaaaaactgngtggaactntagtgcggggccattccaccatctccagagacaaacgacaaaaacctacactgtactctgacaaagtggaacggctagagataccgacggacgacggngtcgtagttattattgtggacgagtagtatttaagacctaataaacgtttgagtagtacgtaggtatagngtacg

SEQ ID NO: 115967 - DNA, 924 bp, Homo sapiens
  misc_feature: GYAE6OF02H06GS.37.34.D01.1.454.CMB.1.raw
tcagtagtgtagatcacgaccggtgctcgatttagatcgtctgtggttgggtttggggctcagagaggagccttagccctggactccaaggcctttccgaccttggtgatcagcgactgagcacgagaggactcacccagtggaattggggctgagctgggttttacctgttgcctatttagaggtgtcctagtgtgacgtgcaacgtggtggagtcgtgggggagccttggtccacgtccgtcggggggtccctggacgacctctccgtggtacgcgaggcctcgtggtattcaacgttttggagtaccgttaagttcggaagttgggtaacttcgggggtaccccgtcccgtaacggttccgtacccggtaaggggggtaaaccgggggtccttaagggggtaagggtttcgggggttaacgggtacccggaaaaccgtaagttaacccggaaggggggtaccgggttagggtacggggttaaaccgtaaaaaaaccgttgttagggtacggtaacggttccgtagggtacggggtacccgggggtacccgtaactttacccgaacccgtaaacttcccgtaaccccggaaggaaccggtaaacccgtaaaacccggaaaacccctaaaaaaccgttacccgtaaacgttacgttaaacgtttaccgtacggtaaaccgttaaaacggttacggggtaaccggtacccgtagggaaccggttaacgtaacccgggtaaacggtaaccgtacccgggaacctttacgggttaacgtttaacgtttaacgttaggtacggtacggtaggtaacgttaacgtttttaaaccggaaccgtttaaaccgggttaaaacggttttaccgggtaacggtttaacgggtaacccggttttaagggttaacgttacggtagtttaacccgg

SEQ ID NO: 115968 - DNA, 343 bp, Homo sapiens
  misc_feature: GYAE6OF02FLO83.37.34.D01.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (311)..(343): a, c, t, g, unknown or other
  misc_feature (311)..(343): n is a, c, g, or t
tcagtagtgtagatcacgaccggtgctcgatttagatcgtctgtgttgggtttgggggggaagaggaagactgacggtcctgccacaggtggtgctgaggaagagatggaggtggacgtgtcagcacccagctggggcctgtccctggtcaccgtctcctcacgcctccaccaacgggcccatcggtccttccccctggccnccctgctccaggacgcacctccgagancacagccggccgtgggctcgccgtggtcaaggtacctactccatccacactactgacggcggcgtggacaggcgcaagtcgnnnnnnnnnnnnnnnnnnnnnnnnnnnnnnnnn

SEQ ID NO: 115969 - DNA, 771 bp, Homo sapiens
  misc_feature: GYAE6OF02F54Q3.37.34.D01.1.454.CMB.1.raw
tcagtagtgtagatcacgaccggtgctcgatttagatcgtctgtgttgggtttggggctcagagaggagccttagccctggactccgaaggcctttccacttggtgatcagcactgagcacagaggactcaccatggaattgggctgatcgtggtttcctgttgctattttagagtgtccagtgtgacgtgcgaactggtggagtcgtgggggagtcttggtccaggtccgtgggggtccctggacggtactcgtccgtgtcgcgcgtcctcgttcggtattccgtaaaccgtttggtagtcgttagttggtactgggtaacgttcgggtcccgtacgcgttcgtccgagggacgggcgttggaggttcgggtcggacctaacgacgttacggaggggtaccggtgggttaacgggtaaacccgtaaaaaagttcggtacggtttacgggtaaacggtttaccgtgggttaccggggtaccgggggttacccgtaacggttttccgtaaccggtacttacccgttacccggtaaggacggttaaacccgaaaccgggttaacccgaaaaaactacccgtaacgttcggtaacttacggttacgaaacgtaaaacgttccgggttaacggcccgtttaaggaacgttacgaccgggaagtaccgacgtaccgttgtaggtactttagtcgtcggacgaggttacgtaaggttaacctaagttaagttaacggtttagacggttacggacgttacgtaggtagtaccgttaag

SEQ ID NO: 115970 - DNA, 630 bp, Homo sapiens
  misc_feature: GYAE6OF02JHN3K.37.34.D01.1.454.CMB.1.raw
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (345)..(345): a, c, t, g, unknown or other
  misc_feature (345)..(345): n is a, c, g, or t
  modified_base (404)..(404): a, c, t, g, unknown or other
  misc_feature (404)..(404): n is a, c, g, or t
  modified_base (457)..(457): a, c, t, g, unknown or other
  misc_feature (457)..(457): n is a, c, g, or t
tcagtagtgtagatcacgaccggtgctcgatttagatcgtctgtgttggggtttgggggtctcagagaggagccttagccctggactccaaggcctttccacttggtgatcagcactgagcacagaggactcaccatggattaaggggctgagctgggttttcctgttgctattttagaggtgtccagtgtgacgtgcaactggtggagtctgggggagcttggtccagccgtggggggtccctgagacctctcctgtncagcctntggattcaacttttggatctattggatggactgggtccgccagtctccgaggggagggctgggagtggggtcgccgaanagtacgaggggtagtagggtggtaacgaaaactgtggtaggactgtgtggcggggcctnttccacctatcctccaggacaacaaccgaccaaaaacctcaactgtactcgtnactaaagtcgggaacgtccgtgaacggatacccggaggaccgacgggtcgttagtacgttaagtttagtttacggacggtcggtaacggaggtttaacgtttaaacgaacgttaaaccgttaaaggtttccggtagttacgggtacgttagggtttacgttaggtagttacgg

SEQ ID NO: 115971 - DNA, 749 bp, Homo sapiens
  misc_feature: GYAE6OF02J11AA.37.34.D01.1.454.CMB.1.raw
  modified_base (197)..(197): a, c, t, g, unknown or other
  misc_feature (197)..(197): n is a, c, g, or t
tcagtagtgtagatcacgaccggtgctcgatttagatcgtctgtgttgggtttgggggcaggagtcagacccactcaggacacagcatggacatgagggtccccgctcagctctggggctcctgctgctctcggctcccgaggtcgccaggatggtgacccatcccaaaatcgacccagtcctccttccacctgtcngcatctgtaggagacaggtatccacctgtcacgttcggccgggtcaagtcggtactaagttacgtacgtggtcggcctaggtatcaaacgtacgaaaccgaagggtaaaccgcccgttaaggtcctaggacttaccgtaagtgaacgttcggaccttaccgtacgtttaacgggaaacggtcccggggtacctagttacgtaaacggttccgaacggcgggtactacggttagtaacgtcgtacggggtactaagtaacgttccgaaccttccgtaaaccacgtaactacgtaccggtaacgtcccgtacggtaccgtaacgtacccgtaggtaacttacggttagttttaaccggtaactttaacctttacgtttacgtacgttaactacgtacctaaacgtagttaacgtacgggtacgtacggtttaccggacggtaaacgggtagttaccgggtagtaccggaacgttaacggaacgtaacgtaggtaccggtacgtaccggaccgttaacgtccgtttaacgtccgtttaccgtaccgtttaacccg

SEQ ID NO: 115972 - DNA, 771 bp, Homo sapiens
  misc_feature: GYAE6OF02JEEOA.37.34.D01.1.454.CMB.1.raw
  modified_base (312)..(312): a, c, t, g, unknown or other
  misc_feature (312)..(312): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggccagccgtggggggtcccctgagactctcctgtgccagcctcgtggattcaacttttggtagctagttggatgggaccttggggtcccnccagtcctaccgaggggaaggggctgggaggtgggtcggaccaagtacgtacgaggggaggttggtacgggtaacgaaaaacgtgtggtaggtacttcgtggtacgggccgggggaccgtaatttcccgaacccgtattacccgtaccaacgtaacggaaaccgtaaacccgaacccgaaaaaactccgtaacctacggttaactccgtaacggtacctaaaacggttcgggaaccggtacccgtggaaacgtacgtacccgggaagggtaacccgtaaccgggtaccgtttacggttaacgttaaggttttaacgtttagggtaccggtacggtaagggtaaccggtttaaaaggttttaccggtaaaaccgtttaaaaccggtttaaaacgtttttaccgggtaaacggttaccggtaaccgtttaggggtttaacgttcggttaaagtttaccggg

SEQ ID NO: 115973 - DNA, 814 bp, Homo sapiens
  misc_feature: GYAE6OF02JZUDY.37.34.D01.1.454.CMB.1.raw
tcagtagtgtagatcacgaccggtgctcgatttagatcgtctgtgttgggtttgggctcagagaggagccttagcctggactccaaggcctttccacttggtgatcagcactgagcacagaggactcaccagtggaagtttggggctgagtcgttgggtttttccttgttgtcttagtttttagaaggttcgtccagtgtgacgtgcaacgtggtggagtcgtagggggagtcgttgggtccgaggtccggttcggggggtccctggacggaccttccgttccgtaggttcgcgtacgtccctcgttagggtacttaccgtaaacgttttggtagtcgttagtttcgggaagtcggtaacggttcggtcccggtaccgtaggttccgtaccgggtaaacggggaaggggtccgtgggtaagggtcgggtacgggaacctaaacgaacgtaacgggaggggtacggggttcggtaacgggtaaaacggtaaaaactaggtaggtcgaacgttacgtgggtcgggacgggtcccgtataccgacctaagtcccgtacgacgaacgtaaccaaaccgtaaacgtaaaacctacgtaacgttacgtactacgtaccgaacgtaacgtaggaaccgtacggtaacgtaaccggaaccggttaccggaaccggaacgtaacccggttcgttaaagtttcgtttaaggtaaacgtttcggtacgggtacgtaaggttacggtaaggtttaaccaacggtttaaccgtaaaagtttccggtaacgtttacgtaacggtttacgtacggttactaggttaacg

SEQ ID NO: 115974 - DNA, 932 bp, Homo sapiens
  misc_feature: GYAE6OF02I25FH.37.34.D01.1.454.CMB.1.raw
  modified_base (226)..(226): a, c, t, g, unknown or other
  misc_feature (226)..(226): n is a, c, g, or t
tcagtagtgtagatcacgaccggtgctcgatttagatcgtctgtgttgggtttggggctcagagaggagccttagcccctggactccaaaggccctttccacttggtgatcagcactgagcacagaggactcaccatggaattggggctgagccgttgggttttccttgttgcttattttagaaggtgtccagtgtgacgtgcaacgtggtggagtcggtgggggngtcgttggtccgagccggtggggggtcccctggacgaccttccgtccgtggtcgacacgtcctcgtaggtacttccgtaacgttttcgggtagtcttagttacggtagttcggaccgttcggggtccccaccgtacggtcctacccggaagggggaacggggcgtgggtacgggtggggtacgggacccaaacgtaagaacggtagggggtagggttacgggtaacgggttaaaacgtaaaaaaaccgttggttacgggtttaacggacgtttcgtacggggtacgggtcccgggggggtaacccgttaagtttccgaaaccccgtcgttttaccccgtaccgaaacgggtaaaccgaaacccgtaaaaccccgggtaaaaccccaaaaaaaccgttacccgttaacggtaaccgttaaccgttaacgttcgtaaaaccgtaaaccgggttccgggaaccgggtacccgttaagggtaaccggtaccgtacccgggaaaccggtaaaccgtaacccggtacggtttaaccggttttaggtttaaacggtttagttttacggggtaaccggtacggttaaaacgggttaacggtttaaaacggttttaaccggaaaacccttttaaacggttaaacgggttttaacccggttaagggttaccgggtaaacggtttaacgggtttaagggtaccggttaaagtttcgg

SEQ ID NO: 115975 - DNA, 786 bp, Homo sapiens
  misc_feature: GYAE6OF02J2J98.37.34.D01.1.454.CMB.1.raw
  modified_base (344)..(344): a, c, t, g, unknown or other
  misc_feature (344)..(344): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttgggtttttcctgttgcttattttagaaggttgtaccaggtgtcgacggtgctaacgtgggtggtaggttcgtgggggaggtcttcgggtccaggccggttgggggtccctggacgtcctccgtcctgtgccagccttgtggacttctaacgtttggagtctagttggacgtgggtccgttcggggtacccnccgtacggttaccgtaccggggtaagggggacggggtcggttacggggtcgggttacgggggtacccgacccgtaaaccggtaagttaccggggacgggggttaggggttacgggttaaccggtaaaacgtaaaacccggttgttagggtaccccgtaaggtttcggttacgggtcggggtacccgggtaccttcgtaccaccgtaccttacccgaagaccgaacggaacccgtaacgtaaaaccctaaactacgtaacgtcgttacgcgttaacgaacgttacgggtccggaccggttaccgaggaaccggttaccggaccggaacggtacccgtgggttacgtttagtgttaactttaggcgtagacggtagtaacgttgttaacgaccttaaggtaattaccggtaggtaccgtagttagcgttacggtgttaacccgg

SEQ ID NO: 115976 - DNA, 714 bp, Homo sapiens
  misc_feature: GYAE6OF02FQLRR.37.34.D01.1.454.CMB.1.raw
  modified_base (145)..(145): a, c, t, g, unknown or other
  misc_feature (145)..(145): n is a, c, g, or t
  modified_base (236)..(236): a, c, t, g, unknown or other
  misc_feature (236)..(236): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtcnccagatgtgccatccaatcgacccagtctcatcctcctgtctgctatctaggtaggagacagtagtcatcactctacgttcggaccggganaacgtcgaagggtactaagttaagtaatagtacgtttaacggcgttaggtactcgaacgaccgtaaaggaaaccgacggggtaaaccacccgtaacggtcctaccgtactacgtacgttaggtcggtacaccgtaacgttaccgttaaacgttaaccgtaacggttacccgggttaaccttaagtttaaacgtacgttacgacggacggtacgtaagggttcggtaacttcggtacgactacgtaagttaccttctacctacgtaccaccgtatacgacgacctacgaccgtcgacaccgttaccgtaagtaacgttctttacgaactttaacgtaacgttcttaataccgtaaacgttagttaaccttactaaccgttacccgttacgttaccgtaccgggtaaccgtaacgggtaccggtaaacgggtcgtaaacggtaccgtaacgtacgggttcgacggtctacgacccttacg

SEQ ID NO: 115977 - DNA, 811 bp, Homo sapiens
  misc_feature: GYAE6OF02F5QDW.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccagtggaattggggctggagcttggggttttccttgttgcttattttagaaggtgtccagtgtgacgtgcaactggtggagtcgtgggggaggcttggtccaggccgtgggggtccctgagctctcctgtgcagcccttgttcggtttctattcgtttacgacctaaactaccgcctaatggacgtccgtcggggtccccgccgagggtccacccggaagggggacggggtacgtggggtagggttgggtccttacgtaaggttaagtttaccggtaggggttagttacgggttaaactaccgggtacaagtttaacgtacgactacgtaacccgttcccggggtacgggccgggggttaccccggttccgtaacccgggtttccaccccggtagaaaccggtactaaacgtttaccccgaaaagtaaaccgttaacggttccttaaagttaccggttaaggtaaaacgttcgaaaaccgtcgtacccgttaaggacgaacgggtacccgggaacggaacccggtacccgggtccccttttaaacgttaccggtttaacgttcggttacgggaaccggaggtaaccggtagttaaaccgggaacgggtaaacgggttaaaccggttaaggtaagccggtaacgtaccgacgtttacccgttagtacggttaaccccgg

SEQ ID NO: 115978 - DNA, 636 bp, Homo sapiens
  misc_feature: GYAE6OF02F18YB.37.34.D01.1.454.CMB.1.raw
tcagtagtgtagatcacgaccggtgctcgatttagatcgtctgtgttgggtttgggggcaggagtcagacccactcaggacacagcatggacatgagggtccccgctcagctcctggggctcctgctgctctggctcccaggtgccagatgtgccatccaaatgacccagtctccatcctccctgtccgcatctgtaggagacagatcatcatcacttgccgggcaagtcagggcattagaaatgatttaggctaggtatcagcagaaaccgagggaacgacccctaagcctcctcatctagtggtcgcactctaagtttacaaacgtcggggtaccctagttaagtattacgacgcggacaaggtggactcgtgggacaacgagtactttactactctaccaacctataccagccacgtcctacgaccacggtacctaggtaacgttacttttagaccttaaactttacttaacttacgttactaaactaacgttaactttaaccttaaacctttaccccgttacggttaaccgtttccgggaacccgtaaacgggtaaccggtaacggtaaggtaaaccgttaaccgaaacggtaacgttcgggtacggtaccgttacggacctaaccgttacg

SEQ ID NO: 115979 - DNA, 720 bp, Homo sapiens
  misc_feature: GYAE6OF02FZX14.37.34.D01.1.454.CMB.1.raw
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (471)..(471): a, c, t, g, unknown or other
  misc_feature (471)..(471): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcttggtccagccgtgggggtccctgagacctctcctgtncagcctgtggactttcaactttggtanctagttggatcggacgtcgggttacccgccgagttcctaccggaggggtaaggggccttagggaaggtcggggtaggacccgtaacgtacttaacggaggggtacggtaggttacggtaaaccggaaaaacttgtagggtacgaacgttcgtaggtcggccggggtcgtactttacccgaaccgttntacccgttacgaacgtaacgtacgaaaccggaacccaaaaaacgttcaaccgttgttacctacgttgaactaaagtcggaaccgtcgtggaacgtaccgacgaacggtaccgtaacgggtccgtttaagtcgtttaaactttagttacggtgggtacgaacgtacggttaaagtttaccggtaactaaaccggtttaaacggttcggtaacgtacggttaaccggttagtaacgttcggaactttcggg

SEQ ID NO: 115980 - DNA, 922 bp, Homo sapiens
  misc_feature: GYAE6OF02GVITP.37.34.D01.1.454.CMB.1.raw
  modified_base (800)..(800): a, c, t, g, unknown or other
  misc_feature (800)..(800): n is a, c, g, or t
tcagtagtgtagatcacgaccggtgctcgatttagatcgtctgtgttgggttttccgttggttgctattttaaaggtgtccagtgtgaggtggagtgttggagtcgtggggaggacttggtaacggcctgggggtccctgtagacctctcctgtgcagcctcgtggaataatctttagcaaatccgccatgagtcgtcgggtccgccgacggcctccgaggggaagggcgtagggtaggttcgggtactcacggcctacgtttcccgagtaagtgggtggtacggccgaccgcacctaccgcacgacttccgtagaacgggtccgttaccaccgttctaccgaggtacgactaacctccgaacggaaccgacgtacgttaacgtaacgtccgtagacgtaaacgttacgaaacgacggtccgtaggaccggaacgggaccccgtaaccgaaacggtaccccgggaaccctaagtttaaaccgtttaagttttaacgtttaccgggtacggtaaacccgtaaaaaccgggtaacccccccgtaaaagggttacccgaaaccccgtaacccgttaaaggttttaacgggaacccgttttaccgtttttcggaaaccccgttttaccggggtacggggaaaccccggttaaaacggggaaccgttaaccgggtaaccccggtttaacccggttcccttaaccggttttccccgaaccgggtccccttaaacccgaacccgggtaacccgggttcccctaacgttacccggggtttacccccttccccgtacggggttaccccnccccggtttccgacccttacccggagggtccctacgttaccccggtggtaccgacgtaccgaccggtaaccggtccgtcccgggtacgggtacccgtcgggtacccgtacgggttaacccgg

SEQ ID NO: 115981 - DNA, 393 bp, Homo sapiens
  misc_feature: GYAE6OF02HI5YF.37.34.D01.1.454.CMB.1.raw
  modified_base (365)..(365): a, c, t, g, unknown or other
  misc_feature (365)..(365): n is a, c, g, or t
  modified_base (373)..(393): a, c, t, g, unknown or other
  misc_feature (373)..(393): n is a, c, g, or t
tcagtagtgtagatcacgaccggtgctcgatttagatcgtctgtgttgggtttggggggaagaggaagactgacggtcctgccacaggtggtgctgaggaagagatggaggtggacgtgtcagcacccagcgtggggcctgtccctggtcaccgtctcctcacgccctcccaaccgaacgggcccagttccggtcccttcccccctgggcccgtcccctggcctccgagggacgccaccctccggaagacgccaacgacggccgggtccctggggccttcggcccgttagggtaccaaacgggtacctaccttccaattccctaaccaccttactacggaggcggggcctagggcgtaaaggccnctatagcnnnnnnnnnnnnnnnnnnnnn

SEQ ID NO: 115982 - DNA, 640 bp, Homo sapiens
  misc_feature: GYAE6OF02IWVGX.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggtttccttgttgctattttagaaggtgtccagtgtgacgtgcaactggtggagtcgtgggggaggcttgggtcccagcccgtgggggggtcccctggacgacgtcctccgtgtcgcgagcctcgtggattcaactttggtagctagttggagtggtacgtgggtcccgcctagtctccgaggggaagggcgtgggagtgggtggaccaactagtacgagggaggtggtaggtaacgaaaaactagtaggtaggactcgtaggtcggacggggcccgtattccgacctatcctacccgagtacgaacgaacgaacccaaaaacctcgaacttgtaactcgtagacaaagtggacggcctgacgtcgtaccggaaggaccgtacgggtctggttacgttattacgttgtcggacgagtacggtaagtttaacgaacttaacgttaaacggtttacgaaggttcgtaacgttgggtatacggtattacgg

SEQ ID NO: 115983 - DNA, 864 bp, Homo sapiens
  misc_feature: GYAE6OF02IAWO4.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggattggggctgagcttggttttcttgtgcttatttagaaggtgtccagtgtagacgtgcaactggtaggagtcggtgggggagtcgttggtccaggccggttggggggtccctggacgtaccttctccgttggtcgacgtacgtccttcgtaggtacttacgtaacgttttaggatacgttagttggagttcggtacgttcgggcccgtacgtacgttccgtaccgggaagggggtaacgggtcgtacggggtggttcggggtacgaacccgtaactacgtaaccggagggggtacggttacgggtacgggtaaaaaccgtaaaaacgtggtacggttacgggtaccttcgggttcgggtaccgggccgggggtacccgtttacgttaccccgaacccgttaccgttacccgtaaacccggtaaacggtaacccgaaaaccccggtaaaacccggtaaaacccctaaaaaaaccttccggttaaacccgtaacgtttacgtaccggttacgaacgtaaaccgggtacgggtaacccggtacggtaacggtacgtaacggttaacccggggagtaacccgggtacgggtaacgtttacggtttaacgttaacggtttaagttcgggtaacggtacggtaacgtaggttaacggtttaacgtaaccgttaaacggttaacggtttacgtaggttacggtaacggttacgggttaagtacggttagttacgg

SEQ ID NO: 115984 - DNA, 1046 bp, Homo sapiens
  misc_feature: GYAE6OF02HL6J8.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgagtcttgggttttcctgttcgcttaagttttagaaggttcgtccgaggttgtcggaacgtcgacaacgtggtaggagttcgtgggggacggtcttagggcctacggcccggttcggggggtcccctaggacgaaccgttccgtcccgttaggtcgtaccgacggtcccgttacgtacgggtaacgtttaccgtaaaccgttttagggtaggtaccgttagtttacgggtagttacgggaaccgttacggggtttaccccggaccgtaacggttacccgtacccggtaaacggggaaccgggggtaccggtaggggtaacgggttcggggggtacgggaacccgtaaaacgtaaccggttaacgggaacgggggttaacggggttacggggttaacggggttaaaaccggtaaaaaaccgttaggttaacgggtaacgggttaaccgtacgtttacggggttaccggtaccccgggggggtaccgttaaccggtttacccgaaacccgttacgttaaccccgttacccggtaaacgggaacgttaaaaaccccggtaaaacccggtaaaaaccccgttaaaaaacccgttaacccgtaaacgtttaaccgggtttaaacggtaacccgttacggtaaacccgttaaaacggttaccggggtaaacccgttacccggtaacgggttaacggtaaaccgttaaccccggggtaacggtaaccggtaaccgggttaccggtttacggttaacggttttaactttaacgggtttagggttacgtaaccgggtaaggttacggttaaacggtttaccggttaacctaaacggtttaaaccgggtttacggtcggtttaacggttaaaccggttgggtttaacggttacggtaccggtttaacgg

SEQ ID NO: 115985 - DNA, 817 bp, Homo sapiens
  misc_feature: GYAE6OF02JLYJG.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcgttgggttttccttgttgcttattttagaaggtgtcagtgtgacgtgcaactggtggagtcgtgggggaggtcttgggtccacggccggtcgggggggttcccctaggacgtacttccgttcccgtggtgccacggtcctcgtggtattcgagtctttggtagtcttagttggatggtacgtcggggtcccgccgtacggtccgtccggaagggggaacggggtcgtagggtagggtggggtcggaccaaagacgtaacggagggggtaggttgggtacgggtaaaacgtaaaaaagttcgttaggtacggtaacgttcgtagggttacgggccgggggtacccgtaagtttcccgaaccgtacgttacccgtaaccgaaacggtaaaccggaaacccggaaaaccgaaaacccgtaaaaaaaccgttcctaaaccgttaaggttaaccttacgtaacggtaacgtaaaacggtacgggtaaccggtccgtaaggaacggtacgtaacccgggaacgaaccggtaccgggtacgttacggttagttaacgtttaaggttacgtacgacggtaacggtaaggtttaattttaacggaaaccgttaaacggtttaaacggtttacggtaacggttacggttaacggttagggttaacgttaggtaacgg

SEQ ID NO: 115986 - DNA, 160 bp, Homo sapiens
  misc_feature: GYAE6OF02H9UOQ.37.34.D01.1.454.CMB.1.raw
  modified_base (134)..(160): a, c, t, g, unknown or other
  misc_feature (134)..(160): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctggggggnnnnnnnnnnnnnnnnnnnnnnnnnnn

SEQ ID NO: 115987 - DNA, 594 bp, Homo sapiens
  misc_feature: GYAE6OF02FPWUW.37.34.D01.1.454.CMB.1.raw
  modified_base (343)..(343): a, c, t, g, unknown or other
  misc_feature (343)..(343): n is a, c, g, or t
  modified_base (503)..(503): a, c, t, g, unknown or other
  misc_feature (503)..(503): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagcctggggggtccctgagactctcctgtgcagcctctggattcaactttggtagctattggatggactgggtccgccagtctccgagggaaggggctgggagtgggtgaccaanatacgagggtaggtggtacggtaacgaaaaactgtgtaggactcgtgtggccggggacgattccaccgtatcctacgagacgaacaacgaaccaaaactcactgtatcgtagacgtaagtcggacgtctagacgacgtacggacgacgtacggcgttgtnttaacgttatgggttagacgtaggtaaggttaattacgtaactaaacgtaacgtttacggaggttacgtagttaggtactggtaacttagg

SEQ ID NO: 115988 - DNA, 763 bp, Homo sapiens
  misc_feature: GYAE6OF02ID0GU.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggtcttgggtccaggtccgtcggggggtccctaggagtacctcctccgtgtggcctacgcccttctggtattcctaacgttttggtatcttattgggattgggacttcggggtcccgccgaggttcctccggaagggggaacggggtctaggggtaggtggggttcgggacctaaacgataaccggaggggtacggtgggtacgggtaaacggtaaaaaacttggtaggttagggaccttcggtcggtgggccgggggtaccgatttcccgaaccattccgtaccgaaggaacgaaccgaaacccgaaacctaaaaacctcaacgttgtacttaccgaagtccaaagtcgggaccgtaccgagacggtaactacccgggaaggtccgaacggttccgttaacgttagtttaaacgtttaggttcggtagggtacgaagggttaacgttaacggtttttaaccgaaaccgttaaacggttaaggttttaacccggtaaggttaccggttaaacggttcggggttaaattacgggtaatttaccgg

SEQ ID NO: 115989 - DNA, 778 bp, Homo sapiens
  misc_feature: GYAE6OF02H8XO9.37.34.D01.1.454.CMB.1.raw
  modified_base (603)..(603): a, c, t, g, unknown or other
  misc_feature (603)..(603): n is a, c, g, or t
tcagtagtgtagatcacgaccggtgctcgatttagatcgtctgtgttgggtttgggggcaggagtcagacccactcaggacacagcatggacatggacgggtcccccgctcagcctccgtggggctcctgctgctcgtcggcctcccgaggtcgccagatggtcaccataccaaatcgacccagtcctctactccctcctgtcctagctatcgtggtaggacgaacgaggtactactactctactacctaccgggttcgggacccggggtaataaccgggtcggaacggggtactaaagtttaaaggtaaacttagggttacgtttacgggacggttacggttactaccggaaggtaacgtaaaaccggaaaaccgggaaccggggtaaaaccgtcccccgtaaacgtccccttacctacctaacgttcgttaacggtcgggtactacccttaacgttacccttaaaccggttaaccggtaacccggggtaccgggttacccttaaagtacggtcgttacgacggtccggaattacgggtacgtaccgtaggtacggaactacgtattccgaacctccgtaaccacacgtacgtaccggtacnccgtagaccgtacgtcgtaacggttagttacttagttacgtaaccttattaccgttactcggtaccacgtaccttaaagtacggtacggtagggttaccacgggtccgggacggtacgggtacgttaggtacgtaactaaccgttagaacggtggttcgacggtacacgaccgtc

SEQ ID NO: 115990 - DNA, 879 bp, Homo sapiens
  misc_feature: GYAE6OF02FSJ2B.37.34.D01.1.454.CMB.1.raw
  modified_base (214)..(214): a, c, t, g, unknown or other
  misc_feature (214)..(214): n is a, c, g, or t
tcagtagtgtagatcacgaccggtgctcgatttagatcgtctgtgttgggtttgggggcaggagtcagacccactcaggacacagcatggacatgagggtccccgctcagctcctggggctcctgctgctcgtggcctcccgaggtgccagatgtgccactaccaaatcgacccagtctccactccctcccttgtctcgctatcgtggtagganacgtagacgtcatcactccgtacgttcgggccggtacgtaacgtcgagggtactaagttaacgaaagttggttaagtttacggcgttaggtactcggaacgtaccgaaaaggtaaaccggaacggggaaaccctacccccgtaacgtccccttaccgtactacgttacgttacggttggtacgtacttaaccttaccggttaacgtttaaccggaaaccggttccggttaacccttaaagttacgtaccgttaccggaggtccggtaacgtacgggttacgtagtaccggtacggtaacctaacgtaacggtttacctttaccgtacctttacccgtacccctaacgtacgtaaccgaaccggtacccgtacccgtcccgtacggtaacccgtaacgttacccggttaacgtaaccggtttttaccgtttaccgtaaaccctttttaaacggtttaacccgttttaaccgtttaacggtttaacctaaccgtttaaaccggtttaactttaaacccgtttaacccgtttacccggtttacggtttacccgggttaacccgggaaccgttaaccgggggtaaccggttaaacgggttaaccggtaaacgttaaaccggtaacggttacggttaccgggtaccgtaccgtaccgtaacccgttaacg

SEQ ID NO: 115991 - DNA, 747 bp, Homo sapiens
  misc_feature: GYAE6OF02H9ZMQ.37.34.D01.1.454.CMB.1.raw
  modified_base (739)..(739): a, c, t, g, unknown or other
  misc_feature (739)..(739): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaagttgggctgagctgggttttcctgttgctattttagagtgtccagtgtgacgtgcaacgtggtggagtcggtgggggagcgttggtccacggtccggtgggggtccctaggagtccttcctccgtgtcgacgagtccctcgttggatttaccgtaaacgtttttgggaacgtcgtttaagttgggtagttgggtaaccgttcggggtcccgtacccgcggtttccgtaccggaaggggggtaacgggtcgttaggggacgggttcggggtccggaaccaaacgtaagttacggaagggggcgggttagggtacgggttaaacgaaaaacgttgtagggtacggtaccgtcgttcgggtgggcccggggtaccgttacttaccgaccgttacgttaccgttaccgaacggtaacgaccgtaaaccgaacctaaaaaccgtcgtaacgtgtaccgttacgaggtaaccaacgggtacggtaccgtaccggtacggtaagtaccgtacccggaacggaccggtacgtcggttagtacgttaattcgtgtcggacgtagtagttacttaacgacttaaggtaacttcggagttagtccgtaggtntgagttcg

SEQ ID NO: 115992 - DNA, 745 bp, Homo sapiens
  misc_feature: GYAE6OF02FXZ1B.37.34.D01.1.454.CMB.1.raw
tcagtagtgtagatcacgaccggtgctcgatttagatcgtctgtgttgggtttgggcgtcagagaggagccttagccctggactccaaggcctttccacttggtgatcagcactgagcacagaggactcaccatggaattggggctgagctggtttcctgttgctattttagagtgtccagtgtgacgtgcaacgtggtggagtcgtggggagcttggtccagccgtgggggtccctgagctctcctagtgcagcctcgtggtacttcgtaacgtttggtaacgtcgttaagttgggaatcggtaacgttcgggtccgcctaggtccgtaccggaaggggtaaggggccgttaggggtacggtgggtcgggaaccgtaacgtacgtaaccggtaaggggtagggttacgggttaacggttaaaccggaaaaacgttcgttaggtacggtacgttcgtcggttcgggccggggtacctacgttacccgaccgtacgtcccgtaccgaacggtaacgacccgtaaacccgaaccctaaaaaacccgtccgtaaacgttacgtacgttaccgttagaccgtaaacgtacgggacccgtcgtacggacgtaccggtaccgagggaccgtacggtccgttagttacgttaagtttacgttgtaccgtacggtacggagttaaggtttaaccgtacgttaaacgttaacgtttcggaagttcgtaaccggttaggttacgtagtcgttaag

SEQ ID NO: 115993 - DNA, 542 bp, Homo sapiens
  misc_feature: GYAE6OF02H2ADP.37.34.D01.1.454.CMB.1.raw
  modified_base (353)..(353): a, c, t, g, unknown or other
  misc_feature (353)..(353): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (538)..(538): a, c, t, g, unknown or other
  misc_feature (538)..(538): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaggtgtccagtgtgacgtgcaactggtggagtcgtgggggagcttggtccagccgtggggggtccctgagactctcctgtgcagcctctggattcaacttttggagctaagtttggattgggacgtggggtcccgcctaggtcctccgaggggaagggctgggagtgggtggaccaanagtacgaggggtaggtggtaggtaacgaaaaactgtgtaggactcgtgtggcggggccgtattcgaccatctcagagacaacgaccaaaactcactntatcagacaagtggacgcngtanagtccgagacacggctgtgtattgtgtgcgagagtattagactacaagttcgagtgagtgtatgntacg

SEQ ID NO: 115994 - DNA, 900 bp, Homo sapiens
  misc_feature: GYAE6OF02HW8B8.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaagttggggctggagctgggttttccttgttgcttattttagaaggttgtccagtgtgacgtgcaactggtggagtcgtgggggagcgttggtccagccgtgggggtccctgagacctctcctgtcgcacgccttcgtggaactttcgaaccgtttttggtagaccgtttagttggacttggtacgtcggggtcccgcccgtaacggttccgtaccggaacgggggaacgggggtccgtagggtaagggttggggtacgggacccaaaccgaacggttaaccgagggggtaggggttaggttaaggggtaaaccggtaaaaaaacgttacgttagggtaacgggttaacccgtcggttagggtcgggtccggggggtacccggtaactttacccgaaccccgtaagtccccgttaccgtaacgggaaacggtaaacccaaaaacccgggtaaaccccaaaaaaaaccgttccctaaaaccgttcggttaaaaccgttcccgtaacggtaacctaaaagggttaccggggtaaacccgggtacccgttaagggtaaccggtaaaaccgtaccccggtaaacgggaacccggttaacggggtccgttacgggtttaaccggtttaagtttaacggtttggtacggttaccgggaagttaaaggtacctttttaaacggtaaaacctttaaacgttaaaacccggttttacggtaacggttttaaccggtagtttaacggggttacttacggtagtttacccggg

SEQ ID NO: 115995 - DNA, 1017 bp, Homo sapiens
  misc_feature: GYAE6OF02HQTYA.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgaggcttgggttttccttgttgcttattttagaaggtgtccagtgtgacgtgcaactggtggagtcgtgggggagtcgttggccagccgtgggggtccctggagacttctccgtgtgcagtcctcgtggactttcaacgttttggatacttaagttagggagttacgggtaccgtacggggttcccgacccgtacggttcccgtaccggaacggggggtaaaggggtccgttaggggacgggtttacgggggtaccgggaaccctaaaaccgtagttaaaccggaaggggggtaacgggttacggggttaacgggttaaaaaccgtaaaaaaacgttacgggtacggttacggtaaccgtttacggtagggtttaccggggaccgggggggttaccccgttaaacgtttacccgaaaccccgtttaagtacccgtaacccgtaacgggaaacggttaaaaccccgaaaacccgggtaaaacccctaaaaaaaacccgttccaaacccggttttaacggttaaaccgtttccgttaaacggaaaacccgttaaaaacggttaacccgggggtaaaccggtttaacccggaaacgggtaaaccggggttaaacccggttaaccccggggtaaaacgggtaaccccgggaaaccggggttaccgttttacgggttttaaaacgttttaaagtttaccggtttttaagggttaacggggacccgggttaaaaggttaacggttttaaaagttttaaaacccgggtaaacccttttaaaaacggggttttaaaaccgtttacgggtttaaacggttacggggttaaaccgttttaaccggggggtttaaatttacgggttaaaggtttaacccgg

SEQ ID NO: 115996 - DNA, 939 bp, Homo sapiens
  misc_feature: GYAE6OF02HXOHY.37.34.D01.1.454.CMB.1.raw
  modified_base (271)..(271): a, c, t, g, unknown or other
  misc_feature (271)..(271): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattgggctgagcttggttttccttgttgcttatttagaaggtgtccagtgtgacgtgcaacgtgggtggaggtcgtgggggaggtcgtttggtccaggccggtggggggtccctgacgactctcctgtcgcacnccttcgtggtacttacgtaacgttttggtagcttagtttggattggacgttcggtcccgcctacgttccgtaccgaagggggtacgggtcgtagggacggttggggtacggcccgaaacgtaagtaccggaagggggtaggttgggtaacgggtaaacgtaaaaaaccgttagttacgggtacgggtacgttaccggtggttaacggggtcccggggggtacccgttaacgtttacccgaaccccgttaacgtttccccgttaaacccggtaacggaaaccgggtaaaccccgtaaaaaccccggtaaaacccccgtaaaaaaacccggtttcccgtaaaccgggtttacggttttaaaccgttacccggtttaacggaaacccgttaaaccgggtttaccgggggaaaccccggtttaccggtaaccgggttaaccggttaaccggttacccgggtaaacgggtaaccccgaaccgggttcggtttaacgggtttacggtttaaacgttttaagggttttcggttacggttacgggtaacggtaaggttaacggtttttaaaccgaaccggttttaaaacccggttaaacgggtttttccggtaaacgggttttaccgggaaccggtttttaaggggtttaacgttaccgggtttagtttaaccggg

SEQ ID NO: 115997 - DNA, 803 bp, Homo sapiens
  misc_feature: GYAE6OF02JVDT9.37.34.D01.1.454.CMB.1.raw
tcagtagtgtagatcacgaccggtgctcgatttagatcgtctgtgttgggtttgggctcagagaggagccttagccctggactccaaggcctttccacttggtgatcagcactgagcacagaggactcaccatggaattgggctgagtcgtaggtttttccttgttgcttagttttagaaggtgtccagtgtagacgtgacaacgttggtggacgttcgtgggggacgtccgttggtccgacggtcccggttcggggggttcccctaggacgtaccgttccgttccgtggttcgaccgacggtccttcgtaggtactttcgtaaacgttttggtacgtacgtttagttggagttcgggtacgttcgggtaccccgccgtaacgtttccgaccggaagggggtaacggggtccgttaggggtaacggttcggggttaccggaaccccgaagtaacgtaaccgggtagggggtacggtttacgggtaacgggttaaaaccgaaaaacgttacggttcgggtacggttaaccgttcggttagggttaccggggacccggggtaccgttataccgtacctaacggttccctaaccggagtaaccgtaaaccgaaacccgaacccgttaaaacgtcctaaacgtcgtaacgtaccgttagaacgtaaacggtcccggaaccgtgtacgaacgtacgtccggaacgtaccgacggtcttagacgttagttagtgacgagtagtaacgttagtttaaccgaacttacgtaagtttcgagtacgtaaccgttaggtagcggttaataccgg

SEQ ID NO: 115998 - DNA, 720 bp, Homo sapiens
  misc_feature: GYAE6OF02IZFES.37.34.D01.1.454.CMB.1.raw
  modified_base (554)..(554): a, c, t, g, unknown or other
  misc_feature (554)..(554): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaagttgggctgagcgttgggtttttccttgttgtcttagttttagaaggtgtccagtgtgacgtgcaacgtggtggaggtcgtgggggaggtcgttggtccgaggcccggttgggggtcccgtgacgactccgtccgtggtcgcagcccttgtggtattctaacgtttggtagcttagttgggtatcggtacgttcggggtcccgtaccacggttccgtaccggaaggggaacgggggtccgttggggtacggttggggtcgacccgaaccgtagtaaccggaggggtaacgggtggttaccggtaaagtaaaaacgttagtaggtacggtacgtcgtaggtcgggtcccgggggccgttaacgttcccaacgactacgtacccgaaggtaaccgaaccgtaaccgaacccaaaaacnctaactcgtacgtcgtagactaaggtcgacggccgtagaggtaccgtaacggacggtccgaccggtatggttaacgttagttttagaggttcggcgaaggttacgtaatttaacggtaacttaaacgtaaggtttcgtaagttcggtaagttggtatagtgttacg

SEQ ID NO: 115999 - DNA, 677 bp, Homo sapiens
  misc_feature: GYAE6OF02H3DHE.37.34.D01.1.454.CMB.1.raw
  modified_base (200)..(200): a, c, t, g, unknown or other
  misc_feature (200)..(200): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
tcagtagtgtagatcacgaccggtgctcgatttagatcgtctgtgttgggtttggggaagaggaagactgacgtcctgccacaggtggtgctgaggaagagagtggaggtggacgtgtcagccacccagccgtgggcctgtccctggtcaccgtctcctcagtcctaccaccaacgggcccattccggtccttcccccgnggcccgtccctgcctaccgaggacgcacccgttccggagacggtaccaacgacggcccggccccgtaggggcctcggacccggttggtaacgaaacgggtccttaaccgttccaaacgtttaccgtaacacccgttaacgtcgggaacggtccgggtgtaccggtaccgaaacggtccggacctaaaaggtgccgaagttntcgacngtacgctcgactacgcgngtaagtccgagtancgtcgtacgtacgacgtagtacgtactacgtagtacgtacgtacgtcgtaccgacgtcgtgacgtacgtacacgacgacgagtacgacgacgtacacgtacgtacgtacgtcgtactacgacacgcgctacgtacgtacgtacgtaacgtaccgttacgtaacgtacgttgtactaccgtcgtaacgtagtaccgtacgtaacgtccgagtacgacgtacgacgtacgaccgacgtcg

SEQ ID NO: 116000 - DNA, 905 bp, Homo sapiens
  misc_feature: GYAE6OF02INOLU.37.34.D01.1.454.CMB.1.raw
tcagtagtgtagatcacgaccggtgctcgatttagatcgtctgtgttgggtttggggtctcagagaggagccttagccctggactccaaggtcctttccacttggtgatcagcactgagcacagagactcaccatggaattgggctgagtcgttggttttcctgttgcttatttagaggtgtccagtgtgacgtgacaactgggtggagtcggtagggggacgtcgttcggtccgacggtcccgggttcggggggtcccctgggaacgtaccgttccgtcccggttaggtcgtccgaacggtccccgttacgttacggtaactttaccgttaaacggttttacgggtacttacgtttaacggttagggtaacgttcggggtaaccggtttccggggtaccccgtaccgtaacggttcccgtaccgggaaaggggtaacggggtccgttagggaagggttcggggtaccggaaccaaaaccggtaggtaacgggaacgggggtaggttacgggtaaggtaaaaccgtaaaaaccggttggttacgggtacggtaccgtttaggtacgggtccggggtaccggggaccgtcgttaacccgacctcgttaacccgccggaacgggtaaacccaaaccgtaaaccgaaaccttaaaaacggtcctaagggttacttaacccgttacgtacgtaaaccgtaggtaaccgggtaaccggtacttacgggacgaaccgtaccgaaccgggtactaccggtacgttacggttacgttaagtttaacgttcggacgtaccgggttaaactacggttaaacgttttaacggaaacgtttaaaccggttaaacgttttccgggtaaggttaccgggtaagttttaacgggtaaccgtttaggtaacccgtttaagg

SEQ ID NO: 116001 - DNA, 736 bp, Homo sapiens
  misc_feature: GYAE6OF02JECUK.37.34.D01.1.454.CMB.1.raw
  modified_base (319)..(319): a, c, t, g, unknown or other
  misc_feature (319)..(319): n is a, c, g, or t
tcagtagtgtagatcacgaccggtgctcgatttagatcgtctgtgtttggttttcctttgttgtctattttagaaggtgtccagtgtgacgtgcaacgtggtggaggtcgtggggaggcttgggtccctaggcccttggggggtcccctgagactctcctgtgccagccgtcttggaaaccttacttgttagtcgattggatggtaccgtcggtcgcccacgtcgtaccggacggtaaggggcgaaggtggtcggtcggctaacaggtacgtagggaggtcggtaaggtacgaaaacgtagtgtggacgtcgtggtcgngggtccggactctaccgacctcgtaccaacgaaagccgaaaaacggtacctaaaaccctacgaaaccctgtactaaccgttagtccgaaacttcggaaggacctcggtacggaacgtaccggacgtactacggtacgtgtgtagttagtcgtagacgtagtaagtacgttagtaacgtactaagtttccgaagttagacgttagtagtcgtaacgttggtaccttaggtacggtacgtaaccggtcggaacgtaacggtaccgtacgtacgtctaccgtctaaccgtccacgtacccgtccacccgtaccggtcccgtccgtaaccggtcccgttacccgtcggccgtccgcgtaccccggtacgtaccgacggccgaacccgtaccggaccacggacccgtacggcccgtaccggg

SEQ ID NO: 116002 - DNA, 856 bp, Homo sapiens
  misc_feature: GYAE6OF02ISW0E.37.34.D01.1.454.CMB.1.raw
  modified_base (180)..(180): a, c, t, g, unknown or other
  misc_feature (180)..(180): n is a, c, g, or t
tcagtagtgtagatcacgaccggtgctcgatttagatcgtctgtgttgggtttggggctcagagaggagccttagccctggactccaaggcctttccacttggtgatcagcactgagcacagagactcaccatggaattggggctgagcttggttttccttgttgcttatttagaaggtntccagtgtgacgtgcaacgtggtggacgtcggtagggggagtcgttaggtaccgacggtccggtcggggggtcccctaggacgtacctcctaccgtggtcgcgacgtcccttcgtgtacgttacctaacgtttggtagtcttaggttggagttcggacgttccggggtacccgtcgtacgttccgtaccgggaaggggggtaacggggtcgtagggtacggttggggtaccggtaaccgtaaactacggtaacgggaacgggggtagggttaccgggtttaagggaaaacccgttaaaaacgtgttacgggtacggtaacgttccggttagggttaccggggcccgggggtaacccttacgttaccccgtaaacccgtcgtttaccccgtacccgtaagggaaccgtaaacccgaaacccgggttaaaaacccctaaaaaaccgtccgttaaacgttaccggttaaccgttcgtaacggtaaaccgtaaacggtcgggtaacccggtacgtagggtacaaccgggttacccggaacgggtaccgaccggttacgttacggtttagtacgttttaggtcggttacggacgtaaggtacgtttaaacgttacgtaaacgttaacggtttacggtttaagaacgttaccggtacggttggtaacgttagggtcctaacg

SEQ ID NO: 116003 - DNA, 609 bp, Homo sapiens
  misc_feature: GYAE6OF02H4937.37.34.D01.1.454.CMB.1.raw
  modified_base (308)..(308): a, c, t, g, unknown or other
  misc_feature (308)..(308): n is a, c, g, or t
  modified_base (428)..(428): a, c, t, g, unknown or other
  misc_feature (428)..(428): n is a, c, g, or t
  modified_base (463)..(463): a, c, t, g, unknown or other
  misc_feature (463)..(463): n is a, c, g, or t
  modified_base (513)..(513): a, c, t, g, unknown or other
  misc_feature (513)..(513): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgcttattttagaaggtgtccagtgtgacgtgcaacgtggtggagtcgtgggggagcttggtccagccgtggggggtccctgagctctcctgtgcagcctctggtattcaacgttttggtagcttattggatggactgggcccnccaggtcctaccgaggggaacggggtctgggaggttggggtggaccaagatacgaggggaggtggtaggtaacgaaaaacgtgtggtacggactacgtgtggcggggccgtattcacctntctccagacgacaacgaccaaaactcactgtatcngataaacgcggtacgacctaggacgacgtaccggaacggacaaccgggtnttagttcgttaaagttgttagtagtcgaaggtagtaagtttaacgacttaaacgttaaagttccgtaagttcgtaagtttggtagttgtattacgg

SEQ ID NO: 116004 - DNA, 769 bp, Homo sapiens
  misc_feature: GYAE6OF02IK0NW.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagctgggttttccttgttgctattttagaaggtgtcagtgtgacgtgcaactggtggagtcgtaggggggagtcgttggtccaggccgtgggggggtccctgacgaccttctcctggtgcacgcctctggattctaacgttttggtagtctagttggaagtggaaccttcggggtcccgccgtagtccgtccggaagggggaacgggggtcgtagggaggtcggggtcgggcccgtaaaacagttaaccggaggggtagggttagggttacgggtaaacgtaaaaaaaccgttgtaggttacgggactacgttgggtcggaccgggggtacccgaactttccgaaccctaacttcccgtaccgaaacgtacgggaaaacccaaacccggtaaaccccaaaaaaccgttaccaaaccgtttaggttaacctacgttacggaacctaaaagtcggggtaaccggtccctaagggacgtacgtacccgggagtaaccggaccggtacgtgtttacgttaatttacgttggttaggcgtaaggtaacgttagtttaaacgacgtttaaacgtaaacggttttacggaggttacgtaaccggttggttaacgttagtagttacgg

SEQ ID NO: 116005 - DNA, 861 bp, Homo sapiens
  misc_feature: GYAE6OF02I3JKQ.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggactgagcttgggtttctgttgctatttagagtgtcagtgtgacgtgcaacgtggtggagtgtgggggagcttggtccaggccggtagggggtccctgagtactcctccgtgtcgcacggtccttgtcggtattaccgtaaccgtttacgggtagtcctagttacggtagtcggtacgttcggggtacccgtccgtcggtactaccgggaagggggtaacgggccgtgggtacgtcggggtaccgaaccgtaaacgacgtaaggaacgggggtaggttacgggttaaacggtaaaaccggtaaaaaacttcggttaggtacggtaacgttcgttacgggtaccgggtaccgggggtaacccgttaacgtacccgtaaccctacgtttccctaacccggaaacggtaaacggtaaaccccgaaaaccgtaaaccccgaaaaaacggttcccaaaccgttacgggtaaccttccgttaaggaaaccgtaaaacggttccgggtaacccgagtttaaccgaacgggttaacccggtaaccggttaacggacccggttaaaccggttccgttaaggtttaaacggtaacgtttttaaacggcgggttaggtaccgtaaagggttaacgtttaacggtttaaacgttaaacccggttaaaggttaaaccgttacgggtaaggtttacgttaggttaacggggttaccttagtagtttaccggg

SEQ ID NO: 116006 - DNA, 724 bp, Homo sapiens
  misc_feature: GYAE6OF02G3YNV.37.34.D01.1.454.CMB.1.raw
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgctattttagaaggtgtcagtgtgacgtgcaacgtggtggagtcgtggggggacggtcgttgggtccgaggtccggtcgggggggtcccctggacggaccttcctccgtgtgctacgcctcgtggacttactaacgtttggagtctagttggagtggacgtcgggtccncctagtccnccggagggacgggctgggagtgggtcgacaacgagtacggagggtagggtggtagggtaaacgtaaaaactgtagggtaggtacttcgtggtcgggaccggggtacctacgttccgaaccgtactccgtaacccgtaaggaaaccgtaaacccgaaaaccggaaaccctaaaaaaccgtccaaccgttagtaacttacgtacgtaacaaacggtcgggaaccggtaccgaggaacgtaaccgtaccggaacggaccgtaaccggtacgttggttaacgttagtttacgttagttccggaggtagtaacgttaagttaacgtaacgttaacgttaacgttaggtaacgttacggtacgttagttacggtagtacgttacgg

SEQ ID NO: 116007 - DNA, 794 bp, Homo sapiens
  misc_feature: GYAE6OF02H2PFZ.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggacctacaccatggaattggggctgagcgttgggtttttccttgttgtcttattttagaaggtgtccagtgtgacgtgcaacgtggtggagtcggtgggggaggcttggtccgacggtccgttcggggggtccctggacgtacgttcctccgtgtcgcacgtccctcgtggacttctaacgttttggaagtcttaagtcggagttcggaacgttggggtccccacctaggttcctccggaaaggggaacgggtcgtaggggtacggtgggggtcgacccgtaaaacgacgtacggtacggggtaggttcgggtaacggggttaaaccaaaaaacgttgtacggtaggttaaccgtcgttcgggtcggaaccgggggtccctagtttcccaacccgtcttacccgaccgtaacggaaccgaacgaaaacccgaaacctaaaaacctaccgtaacctagttaacctacgtacgtaaacgaaacgttaccgggaacggtccgtagtaacggaccttacggacgtaaccggtacggtacctttgggttaactaaacggtttagttagggtaccgtacggtacgtaacggttacgttttaaccgaacgtttaacggttaacggtttaccggagggtttaacgacgtttacgggttaattggtaccgttaacgg

SEQ ID NO: 116008 - DNA, 908 bp, Homo sapiens
  misc_feature: GYAE6OF02FLRL1.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttggggctgagcgttgggttttccttgttgcttattttagaaggtgtccagtgtgacgtgcaacgtggtggagtcgtgggggagtcgttggtccaggccggttcggggggttccctagagacctcctccgtgtcgcgagcccttcgtggtatttaccgtaaacgtttttgggtagtaccgtttagttagggtagttcgggtaccggttcggggttccccgaccccgtaggttcccgttacccgggaagggggggaaacgggggtccgtaggggtagggttcgggggaccggaccctaaacgtaacggtaaccggaggggtaaggggttgggttaagggtaaaaccgtaaaaaacgttgttacggggttacggtaaccgtttcgtacggggttcggggtaccggggggtacccgttaacgtttaccccgaacccgttacgttcccgttaacccgaacggtaaaccggaaaccccgtaaaacccgggaaaaccccttaaaaaaaccgttcccgtaaaccgtttacggttaaaccgtttcgtaaccggtaaaccgttaaacggtaccgggggtaccggtacccgttacgggaacgtaaccggttacccgggaaacggggtaccgtaaccgggttcgtttcgggtttaacttttaacgttttacgttaggttcggtaacgggaggtaaggtttaacgtttaaccgtaaacgttaacccgttaaaggtttcggttaacgttacggttaaccgtagggttacgtagttgttacgg

SEQ ID NO: 116009 - DNA, 798 bp, Homo sapiens
  misc_feature: GYAE6OF02FUERQ.37.34.D01.1.454.CMB.1.raw
tcagtagtgtagatcacgaccggtgctcgatttagatcgtctgtgttgggtttgggggtctcagagaggagccttagccctggactccaaggcctttccacttggtgatcagcactgagcacagaggactcaccatggaattggggctgagcttgggttttccttgttgctattttagaaggtgtccagtgtgacgtgcactggtgagtcgtgggggagcgttggtcacgccgtggggggtccctgacgactctccgtgtgcagcctcgaggtacttctaacgtttggtacgtcttagttgggagttgggacgttacggggtccctaccgtacggttccgtaccggaaggggggtaacggggtccgtggggtacgggttcgggggttccgggaaccctaaacggtagttaaaccggaggggggttaacggggtacgggttacgggtaaaaaccggtaaaaacgttgttaggggtacgggttaccgttacgtaggttcggggcccggggtaacggtacgttccgaaacccgtcttaccggtaccgacggaacgaaccgtaaccggaaacctaaaacccggtcctaacgtaccgtagttctaacggtaacgtaacggtacgggaaccgtacggtacggaacggttaccgaccgggtaacggtaccgaacgggttcgttacgttagttaatttgggttacggtacggttacgtagggtaaagttcgtttaacggtaaccgtttaagttaaacgggtttcggtacgttacggttacggttaggttaacgtagtacgttacgg

SEQ ID NO: 116010 - DNA, 723 bp, Homo sapiens
  misc_feature: GYAE6OF02GB24C.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtgggggtccctgagactctcctgtgcagcctctggtattctaacgttttggtagtccttagttggagttgggactggggtcccgccgagtcgtccgaggggaagggcgtgggaggtgggtggcaacgatacgaggggaggtggtaggtaaacgtaaaaacgtgtgggtacggacttcgtagggtcgggtccgggggccgtaacgtttccgaacccgtactcccgtaccgaacggaagaaacccgtaaaaccggaaacccctaaaaaaaccgttccgtaaaccgtttacggttaaacttaccgttacggaaccgttaaaacggttacggggaacccgggtacccggttagggaacggtaacgttaccgggaacgggtaaccgaccgggtcgttagttacgttatttagttggtagacgtaagtaggttaagtttaacggaacttaaacgttaaggtttgaggttagtacgttaggttagtacgtagttacgg

SEQ ID NO: 116011 - DNA, 685 bp, Homo sapiens
  misc_feature: GYAE6OF02IRJGW.37.34.D01.1.454.CMB.1.raw
  modified_base (221)..(221): a, c, t, g, unknown or other
  misc_feature (221)..(221): n is a, c, g, or t
  modified_base (327)..(327): a, c, t, g, unknown or other
  misc_feature (327)..(327): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
  modified_base (553)..(553): a, c, t, g, unknown or other
  misc_feature (553)..(553): n is a, c, g, or t
tcagtagtgtagatcacgaccggtgctcgatttagatcgtctgtgttgggtttgggggtctcagagaggagccttagccctggacctccgaaggcctttccacttggtgatcagcactgagcacagagactcaccagtggaattgggctgagcgttgggttttccttgttgtcttatttagaaggtgtccagtgtgacgtgcaacgtggtggacgttcggngggggcgtcgttggtccgaggccggttcgggggtccctggaacgccttcgtcctgtgcacgtcctcgtggtacttactaacgtttggtacgtcttagttggtacgngtacgtcggcccgtactgttccacggaagggacgggtcgtgggaggtcgggtcgaccgtaaacgtacgtaaagggtgggaggttacggtacgggtaaaaaccgtaaaacgtgtaggtacggtaccttaggtcggtcggccggggtacctacttccgaactggtacacgagtacgaacacggaaactaaacncgaactntanacganagtacgngaccctgcgaaanccggtacgacgtacgccgttaagtgtcgtaagttacgtcgtacgtacggaagttacgtaaagtttaccaacgtaaacggttaacgtttcggtaaagtccgtaaaggtttaacgtacgttgggtaattaccgg

SEQ ID NO: 116012 - DNA, 936 bp, Homo sapiens
  misc_feature: GYAE6OF02H2LXZ.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaagttgggctgagcgttgggttttccttgttgtcttattttagaggtgtccagtgtgacgtgacaacgttggtaggagtcggtgggggaggtcgtttacggtccgacggtcccggttcgggggggttcccctaggacgtaccttccgttcccgtggtcgtaccgtacggtccgttcggttacggtactttaccgtaaggtttttcgggacgttacgtttaagttagggtagtacggggtacgttccggggtcccgaccgtacggttcccgtaccgggtaagggggtaacgggttccgttagggggtacggggttcgggggtacggaacccctaaacgtaaggtaaccggggtagggggttaggggttaacgggttaccgggttaaaaacgttaaaaaccgttggttacgggtaacggttaaccttcggttacggggtcggggaacccgggggttacccgtttaacgttacccgtaaccgttacgttacccgtaaccggtaaaccggtaaaccgtaaaccccgtaaaacccgaaaccgtaaaaacccgttaccgtaaccgtttagttaaaccgtaccgtaaacggtaaccggtaaacggttaccgggaccggtacgtaggtaacggtaccggttaacccgggaggtaaacccggtacggttacggtttacgttaggtttacttaacggttcgggttaccgtaacgggtagttaacgggttaacttttaaaccggtaacttaacggttaaacgtttcggtaacgttacgggttaggttaccggaggttttaggagtttacgg

SEQ ID NO: 116013 - DNA, 912 bp, Homo sapiens
  misc_feature: GYAE6OF02J2DGA.37.34.D01.1.454.CMB.1.raw
  modified_base (174)..(174): a, c, t, g, unknown or other
  misc_feature (174)..(174): n is a, c, g, or t
tcagtagtgtagatcacgaccggtgctcgatttagatcgtctgtgttgggtttccttgttgctatttagaaggtgtccagtgtgacgtgcaacgtggtggagtctggggaggcttggtccagccgtgggggtccctgagactctctgtgcagcctcgtgattcgaacttggtancgtattcggatcggactcgggtccgccaagtcctaccggaggggaacgggcgtagggaggttcgggtcggacccaacgtaacgttaccggagggtaggtacggtacgggtaaacgaaaaaaccgttgttcggtacggtaccttcggtaggtcggaccgggggtacctagttacccgaaccgtacgttacccgtccgaaggacgtaaccgtaaacccgaccgtaaaaaccgtccgaacgttacgttacgtcgtacggtaacgtaaacggtcgggtaacccgtcgtaggtaaaccggtacgtaaccggacggtaaccggtaacggtcggttagttacgtaagttttcgtaaggtccggacgtaacgggaagtttagttaacgtaaacctaaggttaaaccgtttagggacggttacgtaaccggttacgggttaacgtaacgttacgttacggttacctttaacggtcggtaaacccgtttacccggaacggggtttacccgaaaccggggttaacccgttaacgttccgggtaaccccgttccttcccggttacccttaccggtaccccggacccgttaacccgggtacccgtaaaccgggttcccccgttaagtccccggggttacccctttaccccggacggttccccgtccccggttaacctcggtaaacccggtccggtaaccgacccggtttacccacggttaacggacccgttacccctaccgggtaccccgg

SEQ ID NO: 116014 - DNA, 361 bp, Homo sapiens
  misc_feature: GYAE6OF02JIVGD.37.34.D01.1.454.CMB.1.raw
  modified_base (216)..(216): a, c, t, g, unknown or other
  misc_feature (216)..(216): n is a, c, g, or t
  modified_base (332)..(332): a, c, t, g, unknown or other
  misc_feature (332)..(332): n is a, c, g, or t
  modified_base (339)..(361): a, c, t, g, unknown or other
  misc_feature (339)..(361): n is a, c, g, or t
tcagtagtgtagatcacgaccggtgctcgatttagatcgtctgtgttgggtttgggggaagaggaagactgacggtcctgccacaggtggtgctgaggaagagatggaggtggacgtgtcagcacccagctggggcctgtccctggtcaccgtctcctcagcctccaccaagggcccatcggtccttccccctggccgcccctgcctccagggacnccacccgtccgagacgccaacgacggtccggccccgtagggcctcggtccccgtgggtaccaacgggtaccttacctttccatcctaacacctactgacggcggactggacaggcncgatagnnnnnnnnnnnnnnnnnnnnnnn

SEQ ID NO: 116015 - DNA, 627 bp, Homo sapiens
  misc_feature: GYAE6OF02GCX3Z.37.34.D01.1.454.CMB.1.raw
  modified_base (348)..(348): a, c, t, g, unknown or other
  misc_feature (348)..(348): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagccgtggggggtccctgagctctcctgtgcagcctctggattcaacgtttggtagctattggatggactgggtccgcctagtcctccgaggggaaggggctgggaggtgggtcggccaanatacgaggggaggtggtggtaacgaaaaactgtggtggactcgtggtggccgggggccattccaccatcctaccgagacgaacaacgaaccaaaaactcaactgtactcgtagacaaagtcgggaccgcctaggacgacgtaccggacggaccgacgggtcttaggtgttaagttagttggtaggcggtaaggtaagttaagtttaacggtaaccttaaacggtaacggttttacggaacggttacggtaccggttagggtacttaggtaacgttacgg

SEQ ID NO: 116016 - DNA, 879 bp, Homo sapiens
  misc_feature: GYAE6OF02JU751.37.34.D01.1.454.CMB.1.raw
tcagtagtgtagatcacgaccggtgctcgatttagatcgtctgtgttgggtttggggctcagagaggagccttagccctggacctccaaggcctttccacttggtgatcagcactgagcacagaggacctcaccatggaattgggctgagcgttgggttttccttgttgcttatttagaaggtgtcctaggtgtgacgtgcaacgtggtggagtcggtgggggagtcgttggtccacggtccggtcggggggtccccttagggaacggtacccttccgttccgttcgggtcgaccctacggtccccgttacgttagggtaacgtttacccgttaaaacggtttttagggtacgttaccgtttaaggtttacgggaagttcgggtaccggtttccggggtacccgtccgtaacggttcccgtaaccgggaacggggggtaaacggggccgttaggggtacgggtcggggttacccgaaccgtaaacgtaacggttaacgggagggggtagggttaacgggtaaacgggtaaaaaccgttaaaaacggttacggtacggtacgggtaacgttcgttacggggtaccggggtaccgggggtacccttaacgttacccgaaccgttacgtaccgtaccgtaaacggaaccgtaaaccgaaaccgtaaaccctaaaacgtcgtaactacgtacgtcgtaacgtaataacggtaccggtaccgtacgaaggctaacccggtaaccggacggtaaccgaccggttcgttaacggttaactaacgttacgttagtaccggacgttaagtacggttaacttaacgttaagtaaaccgttaaggttaccggtaacgttacgtaggttaacgttagtacgtattaaccgg

SEQ ID NO: 116017 - DNA, 716 bp, Homo sapiens
  misc_feature: GYAE6OF02FVWZ9.37.34.D01.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
  modified_base (388)..(388): a, c, t, g, unknown or other
  misc_feature (388)..(388): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggtaatggggctgagctggttttccttgttgctattttggaaggtgtccagtgtgagtgcaattggnggagtcgtgggggaggcctcgtccagtcgtggggggtcccngacgactctcctagtgtacgcctctgtaactttccccgttaggtcttatggangaacgtgggtccncgaggctaccggagggagggcgtggtaggtgggagtaccgaagaagtaagacgaagtacgtggaaggtaagaaggatacnggtaggacttcgtgtaggtaacgggtccctttacaacccgtagtccctaccgtaagacgtaaccacgtacgaaacgtacctaccggtagtacctagtccgtaacggtacctaaaacggtacgtaaaccgttaacggtaccgttagggtaaaccgacgggaacccggtacggtaaacccgaacggtaacccgtaagttaccgttacgtttaacgtacgtacgggtacgaacggtaacgaaccgtacgggtttaccggggaacggtaacccggttaaccccggtacggtacccggttacccgtaccgtacctcccggtaccgtacccccg

SEQ ID NO: 116018 - DNA, 987 bp, Homo sapiens
  misc_feature: GYAE6OF02FZ314.37.34.D01.1.454.CMB.1.raw
  modified_base (106)..(106): a, c, t, g, unknown or other
  misc_feature (106)..(106): n is a, c, g, or t
tcagtagtgtagatcacgaccggtgctcgatttagatcgtctgtgttgggtttgggggcaggagtcagacccactcaggacacagcatggacatgagggtccccgntcagctcctgggctctgctgctctggctcccgaggtcgccgagactgtgaccactccaaatcgaacccctgttctaccctactccctccctgtctgctatccgttaggtagagaacagtagtcatacactctcgttacgaccgacgaagtcggacgtacgtaagttaacgtaagttacgttaacgttaagggtcgttaggttaacgagaaccggtaccgtaaaacgggaaaaccggtaaaacggggtaaaccccgtaccccccgtaaacggttcccccgttaaccgttaacgtacgttaaccgttagggttacgggtacctaccggttaacctttaaccccggttaaaccggtttaaaacccgggttaaaccgggttaccgggttttaaaacccccgtaagggttttaaaccgttaaccggtttaacccggacgggaaccggtttaccggtaacggggtttacggtacccgttacgtacggtaacccgttaacgggtaactttccgtttacctacccttttaaccccaccgtaaccgttactaccgtaaccgtcccggttaaccgtccgtacggtaacgtacccgggttaaccgttaaaaggtttaccttttaaccggttttaaccgttaaaccgttttaaacggtttaaccttccggtttaaaccgttaacgttaacgtttaaaccgttaacccgtttaaaacccttacccgggttttaaccccgtacccgggtttaacgttacccccggggaaaccgggttaaaccggtttaaccggggaaacggtaaacccgggtaaaccgttaaacccccggggtttaagtacccggggttaaacgggtttaccccggtttacccggtaccaaccccggttttaacg

SEQ ID NO: 116019 - DNA, 589 bp, Homo sapiens
  misc_feature: GYAE6OF02F71U6.37.34.D01.1.454.CMB.1.raw
  modified_base (421)..(421): a, c, t, g, unknown or other
  misc_feature (421)..(421): n is a, c, g, or t
  modified_base (463)..(463): a, c, t, g, unknown or other
  misc_feature (463)..(463): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttaaaaggtgtccagtgtgaggtgcagctgctggagtctgggggagcttggtacaggccgggggggtccctgagactctcctgtgaagcctctggattcacctttgactaagtgtgccatgaccctgggtcccgcacggctccgagggaaggggctgggagtggggtcttcgaggtttataggttggtagtggtacgtaggcacagattacgcaagactccggtaggaacggggtccggtttacacccgntctccgaagacgacaattccaaacagcacgctgtattcgcanactgaacgagcctgagcggaccggaggaccgacggaccaatagttacttagttggtacgtacctaaactttcccttttaggacctttggtttaacttacgttccccttaggttcgaccctaacggg

SEQ ID NO: 116020 - DNA, 851 bp, Homo sapiens
  misc_feature: GYAE6OF02IBUUQ.37.34.D01.1.454.CMB.1.raw
tcagtagtgtagatcacgaccggtgctcgatttagatcgtctgtgttgggttttccttgttgctattttagaaggtgtccagtgtgacgtgcaactggtggagtctggggggaggcttggtccagccgtgggggggtccctgagactctcctgtgcagcctctggattcaactttggtagctattggatggactggggtccgccagtctccgaggggaagggggcgtagggagtggggtcggaccaacagtacgaggggtaggtggttaggaaaccgtaaaaactgtggtaggacgttacgtggtcgggcggggacccgtacttaccaccagtcctacccgaaggacgaacaaacccgaaccaaaaacctccacgttaggtactcgtacgactaaaggtccgggacggcctaggacgtacgtaccgggacggacgacggcttggttagttactttagttgtacggaggataacgtttatttacggaacctttaaacgtttaaacgggtttacgtaaggttcggtaacggttagggttatacggttagttacgttactttaagtaggtaaaccgttaccggggtaacgggggtaacccggtaaacgggaccgttacggtaccggtacccgttaccggtttcccttaccggttacctacccggtacccgtaccccgaaaccgggaaccccgtacccgttaccgggtttccccgtttaacccccgttcccccgggtaccggttacccccggtccccggttaccggtacccggtaaccccggaccgggaacccgtaccccggttacccggaccccgggaacggaacccggtaccccggaacggtacccccggggg

SEQ ID NO: 116021 - DNA, 675 bp, Homo sapiens
  misc_feature: GYAE6OF02II10D.37.34.D01.1.454.CMB.1.raw
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
  modified_base (393)..(393): a, c, t, g, unknown or other
  misc_feature (393)..(393): n is a, c, g, or t
  modified_base (530)..(530): a, c, t, g, unknown or other
  misc_feature (530)..(530): n is a, c, g, or t
  modified_base (565)..(565): a, c, t, g, unknown or other
  misc_feature (565)..(565): n is a, c, g, or t
tcagtagtgtagatcacgaccggtgctcgatttagatcgtctgtgttgggtttggggtctcagagaggagccttagcccctggactccaaggcctttccacttggtgatcagcactgagcacagaggactcaccatggaattgggctgagcgttggtttcctgtagctatttagaaggtgtccagtgtgacgtgnaacgtggtgacgtgtggggganccgttggtccaggccgttggggtccctgacgtctcgtcctgtgcacgtccgtacgtggtattacacgttttaggtcgacgttattcgggaatggaacgttcggtcccgcttacggcttaccggaagggttacgggcttggaaggttggaccgaccgtaactagttcggaaacgggnggttaaggtcgtaaaccgtaaaacgtaccgtgtaacggcttaccgtggaccgggtcgggtacccgtaatttaccaccgtatacgtcgaagacgaacgtaaccgaaactaaaacgtacacgttagtactacgcgtaanaaacgttgaccgtgtacgagtcgacgacgaacgtnaccgttggaacttagtacgttagaccgagtaggtaacgttcgttaacgacgtttaaaccggtaagttaacggtcggtaacggtcgtaaggttaccgtagtaacgttaccg

SEQ ID NO: 116022 - DNA, 627 bp, Homo sapiens
  misc_feature: GYAE6OF02HM6JI.37.34.D01.1.454.CMB.1.raw
  modified_base (129)..(129): a, c, t, g, unknown or other
  misc_feature (129)..(129): n is a, c, g, or t
  modified_base (286)..(286): a, c, t, g, unknown or other
  misc_feature (286)..(286): n is a, c, g, or t
  modified_base (358)..(358): a, c, t, g, unknown or other
  misc_feature (358)..(358): n is a, c, g, or t
  modified_base (533)..(533): a, c, t, g, unknown or other
  misc_feature (533)..(533): n is a, c, g, or t
tcagtagtgtagatcacgaccggtgctcgatttagatcgtctgtgttgggttggggtctcagagaggagccttagccctggactccaaggcctttccacttggtgatcagcactgagcacagaggactnaccatggaattggggctgagctggttttcctgttgctattttagaaggtgtccagtgtgacgtgcaacgtggtggagtcgtgggggagcttggtccagcgtgggggtccctgagacctctcctagtgcagcctcgtggtattcgtaacgtttggtancgtagtttcggattggacgtgggtcccgcgagtccgtccgaggggaagggcgtggaggtcgggtggaccaanagtacgaggggacggttggtacgggtaaacgtaaaaactgtacgggttcgaacttcgtaggtgggccggggactacttacgacctatcctcccgagaacgaaccaaaccgttaacccaaaacgtcaacgttagattctggacctaaagttcggaaccggtcgagagtccgaacgnggtacacggcgttacgtggtaacttagttgtagtcgtaagaggttaacttggtaactagttaagtttcgagtcggtaacgtgtacgtagattcg

SEQ ID NO: 116023 - DNA, 820 bp, Homo sapiens
  misc_feature: GYAE6OF02JRQG6.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacgagaggctcaccatggaattggggctgagcgtggttttccttgttgctatttagagtgtcagtgtgacgtgtcgaactggtggagtcgtgggggagcttgggtccaggtcccgtgggggtccctgacgtactcctccgtgtcgcgacgtcctcgtcggtacttaccgtaacgttttggtaacgccgttagtttggacgtggtaccgtcgggttcccgccgtaacggttccgtccggtaagggggaacgggtccgtaggggtaggttgggtcgggaacccctaaccggagtaaccgggaggggtaaggtcgggtagggttaaaaccgaaaaaaccgttagttcggtaacgggtaaccgttcgttaacgggtcggggtcccggggtaacgtaaccgtttcccgaacgttaccgttacccgtaccgaaacgtacggaaaccgtaaccggaaaccccgtaaaaacgttcccgaaacgtttacggtaacttcggttaaacgtaaccttaaacgggtaccgggaccggttaaaccgtggttaaacgaaccgggtttacccggaagggaaccggtacggtaccggttgttaacggtttaacgttagttagttacgttaccggaagttaacggtaaccgttttagaaccgtttaaaggttaacccgttggttagtacgttaacggtcggtttaaagtcggtacgttag

SEQ ID NO: 116024 - DNA, 702 bp, Homo sapiens
  misc_feature: GYAE6OF02FS352.37.34.D01.1.454.CMB.1.raw
  modified_base (320)..(320): a, c, t, g, unknown or other
  misc_feature (320)..(320): n is a, c, g, or t
tcagtagtgtagatcacgaccggtgctcgatttagatcgtctgtgttgggtttgggggtctcagagaggagccttagccctggactccaaggcctttccacttggtgatcagcactgagcacagaggacctcaccatggaagttggggctgagcttgggttttccttgtgcttattttagaaggtgtccagtgtgacgtgcaacgtggtggagtcgtgggggagcttggtccagccgtgggggtccctgacgactctcctgtgcacgcctcgtggattctaacgtttggtacgcttaagttggatggtactggggtcccncgtacgtcctcggaaggggacgggtctgggaggtgggtcgaccaagagtacgaggggtaggtggtacggtaaacaaaacgtgtggtacgtacgtcgtggtcgggccggggccttacgttccaaccctattcccgtaaccgaggaaccgaaccgaaaccgtaaacccgaaaaaccttccgtaaacgttcgttaaactcgttacggaactaaacgggtcggtaaccggtcttaggaacgtaccggtaccggacgtaccgacggtcgtagttagttaacgttagttcggtagagggtacgttaagttaacgtttaacgaaccgttaacggtttaaacgtttggtaacggttacgtaacggtttacgggatttacgggtactacgg

SEQ ID NO: 116025 - DNA, 782 bp, Homo sapiens
  misc_feature: GYAE6OF02FRGVU.37.34.D01.1.454.CMB.1.raw
  modified_base (161)..(161): a, c, t, g, unknown or other
  misc_feature (161)..(161): n is a, c, g, or t
tcagtagtgtagatcacgaccggtgctcgatttagatcgtctgtgttgggttttccttgttgctattttagaaggtgtccagtgtgacgtgcaactggtggagtcgtgggggaggcttggtccagccgtggggggtccctgagactctcctgtgcagcctntggattccaacttttggtagcttagttggatggactgggtcccgcagttctcgaggggagggctgggaggtgggtggacccaaacattaacgaggggtaggtgggtacggtaacgaaaaaacttgtaggtcggaacttcgtggtggccggggccgtagttaccaccgtacgtcctccgaagacgacaaccgaccaaaaactcactcgtatctgacaagtcggaccgcgtgagtacgtacggaacggacgacggtcgtgttacgttaatttacgttgtcggtacgaggtagttaagtttagaacgttacgtaaacgttcggtaaggtagtaacggttggttactaggttagttacgtacgtttaacgtagtaacgttaccgggttacgggaaccccgggtaaacgggaaccggttaacgttacgggttaccttacccggtttccgttaccgtttccggtaaccgttacccgtacccgtaaacccggtaccgggtacccgtaccgttacccggtttcccccgtttacccccggtacggtccccggtcccgttcggcccgttaccggaccgggtaccgtaccccgtaccgacccgggtaacgccggtaaccgccgtacccgggg

SEQ ID NO: 116026 - DNA, 787 bp, Homo sapiens
  misc_feature: GYAE6OF02JG5I0.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcacatggaattgggctgagctggtttcctgttgcttatttagagtgtccagtgtgagtgacaacgtggtggagtcggtagggggacgcttggccagtccggtgggggtcctgacgacctcgtccgtagtgcacgcctcgtggtattaccgtaacgtttggacgtctacgttggacgtcggacgttcggggtccgacccgaggttcgtccggaagggggaacggtccgtagggtaaggtgggtacggaccaactacgtaaccggaggggtcggttacgggttaacgggtaaacgtaaaaaaccgttggttaggttaacgggtaaccttcggttacggtacgggggtaccccgggggtacccgttaacgttttacccgaacccgtacgttacccgtacccgaaacggaaccgtaaacccgaaacccggtaaaccccaaaaacgttaccgaaactttacggtacgttaccggtacgtaaccgtaaagttacgggaacccggtaccgttacggaaggtaccgtaccgggaggaacccgcggtaccgttggttaagttacttttaagttcggtcgtacggtaagtaccggtaatttaacggaattaaacccggttaacgtttaacgacggttacggtagtttacgggtaattacgtaggttacg

SEQ ID NO: 116027 - DNA, 809 bp, Homo sapiens
  misc_feature: GYAE6OF02F8QCS.37.34.D01.1.454.CMB.1.raw
  modified_base (183)..(183): a, c, t, g, unknown or other
  misc_feature (183)..(183): n is a, c, g, or t
tcagtagtgtagatcacgaccggtgctcgatttagatcgtctgtgttgggttttccttgttgctatttagaaggtgtccagtgtgacgtgcaactggtggagtcgtggggaggcttggtccagccgtgggggtccctgagactctcctgtgcagcctcgtggtattactaacgtttggtacgnttaagttggactggacgtcgggtccgccagtctccgagggagggcgtaggaggtgggtcgaccaacgtataacggacgggtaggttcggttaggtaaaacgtaaaaacgtgtcggtaggtacctcgtggtcgggccgggtccgtaattccgaacctaccgtacctaccggtaagtacggaaaccgaacccgaaaccgtaaaaaccgtccgtaacgttacgtacgtcgtacgaacggtaaacggtcggacggtctacgtagtaccgtacggaacgccgtaacgggcttagggtttacgttaagtttaacgttcgggtaaggtaacggtaagtaacgttaaagtttaacgtaaacgttaaacggtttaacgttacggtagttacggtacgttaggtagtacgtaacgtgtaaacgttgtacggtacttacgggacggtacgaacggtcctagtacgtccgtacttccgtacgtcgtaccgtacccgtccgaaccgggacccgtaccgtacggttccccgttaccccgttcccggtaccgtccccggaaccttccgaccccggttacgaacccggtaccgtcccgttaacggaccgtaacccggtacggtacccgtacgggaccccggg

SEQ ID NO: 116028 - DNA, 727 bp, Homo sapiens
  misc_feature: GYAE6OF02I5GKU.37.34.D01.1.454.CMB.1.raw
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (601)..(601): a, c, t, g, unknown or other
  misc_feature (601)..(601): n is a, c, g, or t
tcagtagtgtagatcacgaccggtgctcgatttagatcgtctgtgttgggtttggggtctcagagaggagccttagccctggctaccgaaggcctttccacttggtgatcagcactgagccacgagagactcactatggaagttgggctgagtcgttgggttttccttgttgacttatttttagaaggttcgtccctagttgtgacgtgactaacgtggtggtacgtcgtgggggagtcgtttaggtccaggtcccggtgggggtacccctaggaccgtactccgttaccgtgtacgccacgtcctcgtaggtcttactaagtttcggtagtactacgttaggacgtggtacgtcgggtaccgtaccgtacgtccgtaccggaggggtaacggngtacggnggtcgggtcgacccgaataacggtacggagggtaggttggtaaacggttaaccgtaaaaaagttgtaggacgttaatcggtcggtcggcgggtactaccgttacaccgtaatccgtaacgtaacggaactaaccgaacgaaaacctaaaacctacgtattaactgttaccaagtaacgtaaacgtacggtacgtcgtaanacgggtactaacggacgacgtaggcgttaggtttacgttagttagacgttgagtacgtaagttacgttaacgtagttaaacgtaaggtttcgtaggttacgttgttacggtacgttagctttaagg

SEQ ID NO: 116029 - DNA, 827 bp, Homo sapiens
  misc_feature: GYAE6OF02I7QM0.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagtcttgggttttccttgttgcttattttagaggtgtccagtgtgacgtgacaacgtggtggagtcggtgggggaggtcgttggtccacggccggttcggggggtccctggacgacctcctcctggtgccacgccctcgtggtactttctaacgttttggtagcttagttgggattggacgtcgggtcccgccgagtccgtaccggagggggaaggggctggggtagggtgggtacggacccaaacgtagtaaccggaggggtaggttagggtagggtaaaaccgtaaaaacttgttggtacggtaccttcgttgggtacgggacccgggggtacccgtacgtttccgaacccgtattacccgttaccgaaaggtaacccgaaaccgaaacccggaaaccctaaaaaaaccgtccctaaaccgtttagttaaaccttaccgttacggtaaacgtaaacggtaccggggtacccggtacctaacgggtaacggttaacctaacccggggaacgggtaaaccccgacggggttccgtttacgggtttagttttaaaacgttttaggttacgggttacgacgggtaacggtaagtttaaacggttttaacgaacgttttaaaacgtaacggtttttaccggaaggtttacggtaacgtttacgggttattaggtagttaacgg

SEQ ID NO: 116030 - DNA, 772 bp, Homo sapiens
  misc_feature: GYAE6OF02JROXK.37.34.D01.1.454.CMB.1.raw
  modified_base (210)..(210): a, c, t, g, unknown or other
  misc_feature (210)..(210): n is a, c, g, or t
  modified_base (274)..(274): a, c, t, g, unknown or other
  misc_feature (274)..(274): n is a, c, g, or t
  modified_base (743)..(743): a, c, t, g, unknown or other
  misc_feature (743)..(743): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggtttccttgtgtacttattttagaggttcgtccagtgtgacgtgcaactggtaggntcggtggggagcttggtccaggcccggttggggggtccctacggacgaccgttcctccgttggngcctagcctcgtggacttaccttaacgttggtatcttagttggatcggcgttcgggtcccgtaccacggttctcccggaggggaacggggtcgtacggggtggtggggttacggaccgaactacggtaaccggtaggggaggggtacggtacggttaaaaccgaaaagttagtaggtacggtacgttacggttcggtcgggtccggggtacccgggtacttacccgtacgtaccttaccggttaccgaacggaacggaaaccccgaacccggaaaccccttaaaaccgacccgttaaaccttaccggtaacttcccggttaaccgaaacggtaaaccggttaacgggccgggttacccctaggtaacggacccgtaggaccggaacgtacccggtagttgtttacggtatttacggttaggtacgcgttaacggacgtttacggtaactcgtaaacgtagttacggtanaccggttaagtcggttaagtgttagttcg

SEQ ID NO: 116031 - DNA, 702 bp, Homo sapiens
  misc_feature: GYAE6OF02GR7EM.37.34.D01.1.454.CMB.1.raw
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggtttccttgttgctattttagaaggtgtccagtgtgacgtgcaactggtggagtcgtgggggagtcttggtccaggccgtggggggtccctggagactctctgtncagcctcgtggtacttcaacttttggagcttagttggatgggtaccttggggtcccnccgtagtccgtaccgaaggggaacgggtccgtgggaggttggggtcggacctaacgataccggagggggaggttagggtacgggtaaacgaaaaacgttgtacgggtaggaccttcgtagggttcgggccgggggtaccctagttcccgaactactccgtaccgaggtaacgaccgaaacgaacctaaaaacgtcctaacgtacgtagtcttacgaactaaagtcgggtaccgtaccgtaggacgaacgtcccggaaggaccgtaacggtcgttggttacgttaatttaacggtgtcggtacggtagtaaggttaaggtttaacgaaccttaacgttaaacgtttcggaagttacggtacgttagggtttacaggttagttaccgg

SEQ ID NO: 116032 - DNA, 737 bp, Homo sapiens
  misc_feature: GYAE6OF02GBI2R.37.34.D01.1.454.CMB.1.raw
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (404)..(404): a, c, t, g, unknown or other
  misc_feature (404)..(404): n is a, c, g, or t
tcagtagtgtagatcacgaccggtgctcgatttagatcgtctgtgttgggttttccgttgttgctattttagaaggtgtccagtgtgacgtgcaactggtggagtcgtgggggaggcttggtccagccgtggggggtccctgagactctcctgtgcagcctctggattcaactttggtagctattcggatggacctgggtcccgcctagtctccgagggagggctagggaggtgggtcgaccaanagtacgagggtaggtggtgtaacgaaaactntggtcgactcgtgtcggcggggctattcaccntctcagagacaacgcaagacctccgtgtactcgtanacaagtacgaactagtcgtagagagtctaggacgaccgacggtccttagttactttacgngttacgaacggtaaagtactacgtaagtactacgtaacgttggacttaggtaacttaaacgtttacgtttaggtacgtttaacggttaccggggaaccgtaacggcgttaacgtaagttcgggtataacgggttccgttacgttaccgttaccgtaacccggtacccgttaccccgaaacccgggtaaccgggttaccccttaacgggttccccggttttcccgttaacccccggtacgtacccccgtaaccccttacccgaaccgtaaccgtaccgtacccgtacgttccgggacggtaccaaccggtcggcccgtttaccggcggttaccg

SEQ ID NO: 116033 - DNA, 736 bp, Homo sapiens
  misc_feature: GYAE6OF02HPZG4.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaacgtggtggagtcgtgggggagcttggtccagccgtgggggtccctgagactcctccgtgtcgcgagccctctggatttcaacgttttggtagcttagttggatggacgtgggtcccgcagtcctccgagggaaggggctgggaggtgggtaggaccaacagtacgaggggaggtggtaggtaacgaaaaactgtaggtcggactcgtggtcggccggggaccgtacttccgaaccctacgtcccgtacccgaaaggtaacgggaaccctaaacccggaaaccctaaaaaacctccgtaacgtacggttaacttccgtaagtaacccgtaaaaggttcgggaaccggtcccgttaaggaacggtaaccgttacccgggaaggaaccccgacggggttcccgttaggttaacggttaatttacgtttaggtcggtaccggaaggttaacgttaacgttttaacggtaacccttaaaccgttaaaggttttaccggaacgtttaacggaccgtttagggttaacttacgggtatttacggg

SEQ ID NO: 116034 - DNA, 845 bp, Homo sapiens
  misc_feature: GYAE6OF02HXDA6.37.34.D01.1.454.CMB.1.raw
tcagtagtgtagatcacgaccggtgctcgatttagatcgtctgtgttgggtttgggggtctcagagaggagccttagccctggactccaaggccttttccacttggtgatcagcactgagcacagaggactcacatggaattgggctgagcgttggttttccttgttgtctattttagaggtgtccagtgtggacgtgcaactggtggagtcgtgggggaggtcgttggtccgagccggttcggggggtcccctggaacgtaccttcttaccgtgtacgtccagtcccttacgtcggtaacttaccttaacgtttttacgggagtacctttaggttacggtaagtacgggtaacgtacggggtccccgtacgtacgtttccaccgggtacgggggacgggtcgtagggtaggtgggtacggaacctaaagaacgtaaggagggtaggggttaggtaacgggttaaaaccgaaaaacgttgtaggtacggtacgtttcgtaggggtcgggtaccgggtaccgtaacgttaccgacttaccgttacctaccggagaaccgtaaacgaacccgaaaaccgtaaaacctcgaaacgttcgttaacgtacgttaaacggtaaactaaacgggttaccggtaaacggtcccgttaaagggacggtaacccgtaaccccgggttaaggaaacccgttaccgggagtttaagttttccggttaaattttaaacgggttgtacgggtactaaaggttacggtttaaacgtttaaaccgaaacttttaaaacccggttaaaggttttccggaaaggtccgtttaaccggttaagggtaataccggtttagtaagg

SEQ ID NO: 116035 - DNA, 735 bp, Homo sapiens
  misc_feature: GYAE6OF02HFKZA.37.34.D01.1.454.CMB.1.raw
  modified_base (213)..(213): a, c, t, g, unknown or other
  misc_feature (213)..(213): n is a, c, g, or t
  modified_base (285)..(285): a, c, t, g, unknown or other
  misc_feature (285)..(285): n is a, c, g, or t
  modified_base (703)..(703): a, c, t, g, unknown or other
  misc_feature (703)..(703): n is a, c, g, or t
tcagtagtgtagatcacgaccggtgctcgatttagatcgtctgtgttgggtttggggctcagagaggagccttagccctggactccgaaggcctttccacttggtgatcagcactgagcacagaggactcaccatggaattggggctgagctggttttcctgttgctattttagagtgtcagtgtgacgtgcaactggtggagtcgtgggggngcttggtccagccgtgggggtccctgagactctcctgtcgcagtcctctggacttacgtaacgtttggtacncttaagttggatcggacggttcgggtcccgaccgtaggtccctaccggaggggtacgggacgttgggacggttcggggtacgacccgtaaacgagtaaacggagggtaggtacggtagggtaaaaccgaaaaacgttattagggtacgtaccgttcgtaggtcggggtccggggacccgtacttaccgtacctacggtaccttaccggaagacgtaaaccgaaaacccggtaaacccaaaaacgttccgaacgttacggttactaccgttagaaccgtaacgtaaccggggtccgaccgttcggaagtccggtacgaccgggacgacgtcgttagttacgtaaagtttcgtcggtacgacggtagtaacggtttacgttaagtaacgttaaacgttaacggttttacaacggggtttntaaccggttaggttacgtagttacgttaacgg

SEQ ID NO: 116036 - DNA, 735 bp, Homo sapiens
  misc_feature: GYAE6OF02IOJ21.37.34.D01.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (326)..(326): a, c, t, g, unknown or other
  misc_feature (326)..(326): n is a, c, g, or t
tcagtagtgtagatcacgaccggtgctcgatttagatcgtctgtgttgggttttccttgttgctattttagaaggtgtccagtgtgacgtgcaacgtggtggagtcgtgggggaggcttggtccagcccgtggggggtccctgagactctcctgtgcagcctcgtggattcaacgttttggagcttattggatggctgggtccnccagtctccgaggggaacgggctgggnggtcgggtgaccaacatacgaggggtaggtaggtaggtaaacgaaaaaccttgtaggtacggacctgttggtacggcggggaccgtatcaaccgntccgtcgaagagaacgaaccgtaacccaaaaactaccacgtagtactctcgtaacaaagtcgggaccggctcgaagtcgtacggaacgacgtacgcgtaggtattgtttaagtcgtacggtacgaggtaacgtagttttaaacgaccttaaacgttaacggttcggtacgttagaaccggtttaggttatacggtatttcgtacggttataggtaacgtacccgggttacggtaacccggaaggtaccgagtcgggtaacctccgttacttccgttaccgaccgtcccgtaacccgaaccgtaccggggtcccaccgttaccgttccccgttccccgtcgggccccgtcctacccgccgttacccggagtacccggacctcccgtaacgccggactaccgacgacccgg

SEQ ID NO: 116037 - DNA, 866 bp, Homo sapiens
  misc_feature: GYAE6OF02FK0I1.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagcttgggttttccttgttgcttattttagaggtgtccagtgtgacgtgcaacgtggtggagtcggtgggggaggtcttcgggtaccaggcccggttcgggggggtcccctggacgtaccttcctccgttggtcgccgacggccccgttcgttacgggtacttttaccgttaaaccggtttttgggtacggtacctttaggtttagggaaggttcgggtaccgttcgggggtccccgcccgtacggttcccgtaccggaagggggaacgggggtcgttaggggtagggttgggggtacggacccgtaaacgtaacgttaaccggagggggtaggtacgggttaacgggtaaaaccggtaaaaaacttgttacgggttacggtaacgttcggttacgggtcggggcccggggggtacccgttacgtttacccgaacccgtacttacccgtacccgaaggtaacggaacccgtaaaccggaaacccctaaaaaccgtccgtaacgtttacgacgtttaccgacgtaacgtaaacggtacggacccggtactagggaccggtaacgtaccggacggtaaccgtacggtacttacgggttagtttaacggtttagttgggtacggtacggtaggtagtttaaacgtttaaccgtaaccgttaaacgtttaagggtttaccgtaggttacgttaaccggttaggtttacgtacgtagtttacgg

SEQ ID NO: 116038 - DNA, 788 bp, Homo sapiens
  misc_feature: GYAE6OF02JN11C.37.34.D01.1.454.CMB.1.raw
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagccgtggggggtccctgagactctcctgtgcagcctctggattcaacgtttggtagcttatggatggactgggtacccgccagtcctccgaaggggaacggggctgggagtggggtggccaacatacgagggaggtggtacggtaaacgaaaactntggtggactcgtgtggcgggccngttcacactctcgagacgacaaccgaccaaaaacctcacgttgtaactcgtacgactaaagtcgggaccgtcctgaacgtcgtacccgaggtaccacggtcttaggttagttaatttacgtttggacggtacgaaggtaagtttaagttacgtaaaccttaacggttaaacgtttcggaacggttacgtacgttaggttaacggtatacgttacgttacttaagtacggtaaccgttacgggtaccgggtaccgaaacgggtacccgttaggtccgtaccggtacccgttccgttaccgttaccgtaaccgtcccgttaacccgaacggtacccggaaacccgttcggttccccgtttaaccccgttccccggttacccggtccccggttccccttaccggtacccggttaccccggtaccggttacgtacccccggtcccgttaacccggttaaccgaccggtaccggtaacccgaccccggggg

SEQ ID NO: 116039 - DNA, 835 bp, Homo sapiens
  misc_feature: GYAE6OF02F761D.37.34.D01.1.454.CMB.1.raw
  modified_base (742)..(742): a, c, t, g, unknown or other
  misc_feature (742)..(742): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtggggggaggcttgggtccagcccgtgggggggtcccctgggacgtctcctcgtgcgcgacgtcctgtagttacttaacttacggttaggttactagttaggtaggtaggtacggttacgggtcccgggtccccgacgtaccggttcccggtaaccggggaacgggggggtacggggtacgggttaagggggtcgggggttacggggtacccggaaacccgtaaagtaacggttaacgggggaacgggggttaggggtttacggggttaaacgggttaaaaaaccgttaaaagttacggttaggggtaccgtacgttcgggttgggtaccgggggcccgggtaccgttacctaccgtaaccgctttacccgaacggacggaacccgaaaccgtaaacccgaaaaacccttaaaccgtccgtaaaggttacgtacctacggtaacgaaaccgttaaggggcccggacccgtcggaagaccgttacccggacgggaaccggtacccgccggttgtttagtgttaaatttcgggngacggtacggtaagtaacgtttaacgtaaacttaaaccgtaaacggttttacgtacggtacggtacgtacgggttaataggtctaagggttac

SEQ ID NO: 116040 - DNA, 755 bp, Homo sapiens
  misc_feature: GYAE6OF02F0CJZ.37.34.D01.1.454.CMB.1.raw
  modified_base (152)..(152): a, c, t, g, unknown or other
  misc_feature (152)..(152): n is a, c, g, or t
tcagtagtgtagatcacgaccggtgctcgatttagatcgtctgtgttgggtttgggggcaggagtcagacccactcaggacacagcatggacatgagggtccccgctcagctcctgggctcctgctgctctggctccaggtgccagatagtnccatccaatgacccagtctccatcctcctgtctgcatctagtaggatacagagtacatcgtaatcctacgttcggaccgggactaaggtccgaagggtcctaagttaacggaaatgtacgttaaggaccttaggttaatcgaacgtacgaacggaaaccggaacgggaaaccgtaccccgtaaagtcccttacctaccgtaacttacgtacgtgggttacactacttacgtaaaccgtttacgtaaaccggttccgggtaaccccaagtttaaccgtacgtttacgacggacgggtactaaacgggttgtaacccgttccggtaaggtaccctaacggtaaacgtttctttaaccgtactacctactaacctacggtactaacggactacgcccgttaacgacgaacgttcgtaacggttaacgttactttaccggtaactttaaacgttaacccgtttaagtttaccgttaaccaaaggttaaaccctattaaacccgttaacttaccgttaccggtaccgttaccggaacgtaaacggtacgtaaacggcgttaaagtacccggtaaacgagttccgggtataaccgttcaaccgtaaccg

SEQ ID NO: 116041 - DNA, 750 bp, Homo sapiens
  misc_feature: GYAE6OF02G87GT.37.34.D01.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (418)..(418): a, c, t, g, unknown or other
  misc_feature (418)..(418): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagcctgggggggtccctgagactctcctgtgcagcctcgtggattcaactttggtagctattggatggactgggtcctnagtccncgaggggagggctgggagtggggtgccaaacatacgaggggtaggtcgggttaggaaacgaaaaactgtggtggaaccttcttggtcgggcgggggcctagttccaaccatcctaccgagagaaccaacgaccaaaaactcactgtactcacacaaagtggacggcctaggacgataccggaggacaacggctagtagtatttacgttggngacgagtagtatttacgaattaacgtaaagtttcgagttacgacgttaggtactagtagtcgtacttaagtagtacgttaaccgggtcggggtaacccggtaaagggacccgtaaggttccggtaccgtacccggttcttacccgttcggaaccgtacccctacccgtaaaccgggtacccgggtacccctacgggttcccgttccccgtttacccccgggtacgggtcccccgttaacccgttccggtaccccgtaccggtaacccgggtaacgcccccggttaaccccggtcccggtaaccgggtaccgacccgtaccggtaccccgggg

SEQ ID NO: 116042 - DNA, 759 bp, Homo sapiens
  misc_feature: GYAE6OF02HT0EJ.37.34.D01.1.454.CMB.1.raw
tcagtagtgtagatcacgaccggtgctcgatttagatcgtctgtggttgggtttggggctcagagagagccttagccctggactccaaggcctttccacttggtgatcagcactgagcacagaggactcaccagtggaagttgggctgagtcttgggttttccttgttgtcttagttttagaaggtcgtccgagtggtgacgtgcaacgtggtggagtcgtgggggagcgttggtcacggtcggtcgggggtccctggacacttccgtccgtgtgacgacgtcctacgtggtacttactaacgttttggacgtcgttaagttcggagttggaccggttcgggtccccgcgttacgtccgtaccgggaggggaccgggtacgtagggtacgggtacgggtcggaaccaaacggtacgttacggaaggggtacggggttacggtaagggtaaacccgtaaaagttagttacgggtcggtaacgttacggtcggtacgggtccggggtacgtacgttccggaccttagtcccgtacccgaagaaccgaacccaaccggtaaacctaaaactccgtaaacgttcgtaagtcctaggtaacacggttacggaccggttacgacggtagaccggtaaccgggacgtacgaccggtcgttacgttcgttaattcgttaggtacgtacggtccgttagtaaacggtttccgaacgttaacgttaacgggtttccagggtttacgacgttaggtaatcgtagttaccg

SEQ ID NO: 116043 - DNA, 694 bp, Homo sapiens
  misc_feature: GYAE6OF02F89BE.37.34.D01.1.454.CMB.1.raw
tcagtagtgtagatcacgaccggtgctcgatttagatcgtctgtgttgggtttggggctcagagaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggagcgttggtccagccgtggggggtccctgacgactctcctgtgcacgcctcgtggattctaacgttttggtacgcttagttggatgggacttcggggtcccgccgtagttcctccggaaggggtaagggggcctgggaggttggggtacggacccgaaacagtacgaggggaggtggtaggtaaacgaaaaactgtgtcggacttcgtggtagggccgggggtacctagttaccgacccgtattcccgtccgaaggacgtaaccaaaccgaaccctaaaaactcctaactagttactacgtcgaactaaagtcgggaccgcctaggacgtacgtaccggaacggaccgaccggtgttggtacgttaagtttacgttggtagtacggaagtaaggttaacgttttaacgtaaccgtaaacggttaaacggttttacggaacgtttcggtaacgttagggttaccttaggtagttaccgg

SEQ ID NO: 116044 - DNA, 1073 bp, Homo sapiens
  misc_feature: GYAE6OF02GB77K.37.34.D01.1.454.CMB.1.raw
  modified_base (897)..(897): a, c, t, g, unknown or other
  misc_feature (897)..(897): n is a, c, g, or t
tcagtagtgtagatcacgaccggtgctcgatttagatcgtctgtgttgggttttccttgttgctattttagaaggtgtccagtgtgacgtgcaactggtggagtctgggggaggcttggtccagctggggggtccctgagactctctgtgcagccttctggtacttctaacgttttggtaggtcttaagtttgggaactggggaccgtcggggttcccgcccgtaaggttccgtacccggaaggggggtaacgggggccgttaggggtacgggttcgggggtacgggtacccaaaacgtaagttaaccggaagggggtacgggttacggggtaacgggtaaaaccgtaaaaaaacgttagttcggttacgggtaaccttccggttggttcggggccgggggttaccccggtaattaccccggtaaccctaacgttccccgtaaccgtacggtaaacggtaaccccgaaaacccggaaaacccctttaaaaaaaaccgtcccgttaaccggttaacgtttaacgttacccgttaaccgggtaaccttaaaaggttaccgggggtaaccgtcccgttaagggtaaacggtaaccgttcccgggtaacggtacccggtaaccgggttacggttacgggtttagggtttaaacgttttaggtttacgggttacgggaaccggttaagggttaaacgtttaacgggtttaacgtaaaccgtttaaaccggtttaaaacgggtttacgtaacggggttttacgaacggtttttaacgggttaaagttcgggtttaaacgttcggtttaacgttaacggtttacgaaaccgggtttacccgggaacggggtaacccggtaaacggggtaaccctacgggttaccggtaccgtaaccccggtttnttaaccggttccgaaccgttcctaccggtacggaaccccggttacgggtaacccttaccgggtcccggtttacccgtttccccgtacgggtaccccgttccgttaacccgggtcccgttacgtccgggaaccttcccgggtaacctacccgggtaggtaccgtacccggaaccggg

SEQ ID NO: 116045 - DNA, 792 bp, Homo sapiens
  misc_feature: GYAE6OF02IPBBB.37.34.D01.1.454.CMB.1.raw
tcagtagtgtagatcacgaccggtgctcgatttagatcgtctgtgttgggtttgggggtctcagagaggagccttagccctggactccaaggccctttccacttggtgatcagcactgagcacagaggactcaccatggaattgggctgagcgtggtttcgtgtgcttatttagaaggtgtcagtgtgacgtgcaacgtggtaggagttcggtgggggagtcgttggtccgagtcccggtcggggggtacccctggacgtaccgtccttccgtgtacgccacgtcccgttgtaggtactttacgtaacgttttagggtacgtcttaggttggtacgttacggaccgttcggggtccccgtacgtacggttccgtaccgggaaggggggaacggggtccggttaggggacggttggggtaccggaccaaaacgtcgtaacggagggtaggtagggtaacggtaaacgtaaaaagttacgtaggtacggtaacttcggttagggtaccggggtccggggtaacctacgttacccgaaccgttacgttaccgtacccgaaagaaccgaaaccgaaaccggaaaacccctaaaaacgtcctaaacgttacggtttaacctcgttaacggaaccgttaaaacgtccgggtaccgtacttaggaacggtaaccgtaccgggaaagtaccgaccgttgttacgtttaagttacgtttaagttcggagtacgtagtaacgttaatttaaacgacgttaacgtagtttacggattacgtacgttaggaagtgtaacgttcg

SEQ ID NO: 116046 - DNA, 805 bp, Homo sapiens
  misc_feature: GYAE6OF02FHZ8M.37.34.D01.1.454.CMB.1.raw
tcagtagtgtagatcacgaccggtgctcgatttagatcgtctgtgttgggtttgggctcagagaggagccttagccctggactccaagggcctttccacttggtgatcagcactgagcacagaggactcaccatggaattggggctgagctgggttttccttgttgctattttagaggtgtccagtgtgacgtgcaacgtggtggagtcgtgggggagtcgttggtcctaggccgttgggggggtcccctgacgacctcttcctgttcgcacggtcctcgtggtactttccgaaacgttttcggtacgcgttaagttgggaacgttagggtaccgtcgggggttccccgaccggttaggtcccgttacccggaagggggtaacggggtccggttaggggtacgggtcggggtacggggtacccctaaacgaacgttaaggacggggtaaggggtgggttagggtaaacgaaaaacgttagtaggtacggtacgttacgttgggtacgggccgggggttaccgacgttttccgaaccgtactacccgttaccgaacggaccgaaaccgaaacccggtaaacctaaaaacctccgtaaaccgttacgtacgttccgttaccgaacgtaaacgtcggaaccggccgtaacggtacggtaccggtaacggtaccggtacgtaaccgggtccgtttgtaacgtttacggttagtttcggaggtcgaaggttacgttaagtttaaccgtaccgttaaaccggttaagtttaccgtaggttacgtaaccgttggttaagttagtagttaccg

SEQ ID NO: 116047 - DNA, 386 bp, Homo sapiens
  misc_feature: GYAE6OF02FMOY2.37.34.D01.1.454.CMB.1.raw
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (353)..(386): a, c, t, g, unknown or other
  misc_feature (353)..(386): n is a, c, g, or t
tcagtagtgtagatcacgaccggtgctcgatttagatcgtctgtgttggggtttgggggggaagaggaagactgacggtcctgccacaggtggtgctgaggaagagatggaggtggacgtgtcagccacccagcgtgggcctgtccctggtccaccgtctcctcacgccctccaccgaacgggcccagtccggtccttcccccgtggccgccctggcctccgaggacgccacctccggagagccacgacggcccggtcccgtgggcctgccgttggtacaaggtaccttaccttccattcctacaccttacgtggacggccggggctgggcaacggggtccnctaatagnacnnnnnnnnnnnnnnnnnnnnnnnnnnnnnnnnnn

SEQ ID NO: 116048 - DNA, 960 bp, Homo sapiens
  misc_feature: GYAE6OF02H41OT.37.34.D01.1.454.CMB.1.raw
  modified_base (129)..(129): a, c, t, g, unknown or other
  misc_feature (129)..(129): n is a, c, g, or t
tcagtagtgtagatcacgaccggtgctcgatttagatcgtctgtgttgggtttggggctcagagaggagccttagccctggactccaaggcctttccacttggtgatcagcactgagcacagaggactnaccatggaagttgggctgagctgggttttccttgttgcttagtttagaaggtgtccagttgtgacgtgacaacttgggtggagttcggtgggggaggtccgttggtcccaacggcccgggttcgggggggtccccttaggaacggtaaccctccgttcccgtaggtcgacgtacggtcccttcgttacgggtaactttaccgttaaacgtttttaggggtaacgtccgtttaaggttttacggggtaactcggggtaaccggtttccggggggtaccccccggtccggttaacgtttaccccggttaccgggaaacgggggggtaaaccgggggtccgttaggggggtaacggggttcgggggttaaccgggaaccccgtaaaacggtaaccggtaaccgggtaagggggtacgggggttacgggttaaggggtaaaaacccgttaaaaacgttggtagggtaaggttacgttacgttggggttcccggacccgggggtaaccgtacgttacccaaacccgtacgttaccctaccggtaaccggaaaccgaaccgaaaaccccgaaacccgtaaaaacttcccgaacgttacgttaacctccgttaacgtaacgtaaaccggttacgggacccggtaccgttaagggtaacccgacgtaacccgggtaaccggaaccggttaccggtaccgtttaagggttcttaaggtttaacgttggtcgtaaccggtaagttaaagttcggtttaaacgtaaacccgtttaacggttaaaacggttttacgaggttttaacggacgttttaacgggtaattacccgttagttacccgg

SEQ ID NO: 116049 - DNA, 844 bp, Homo sapiens
  misc_feature: GYAE6OF02HG3BK.37.34.D01.1.454.CMB.1.raw
  modified_base (265)..(265): a, c, t, g, unknown or other
  misc_feature (265)..(265): n is a, c, g, or t
tcagtagtgtagatcacgaccggtgctcgatttagatcgtctgtgttgggtttggggctcagagaggagccttagccctggacctaccgaaggcctttccacttggtgatcagcactgagcacagaggactcaccatggaattggggctgagtcgtgggttttccttgttgcttatttaggaaggtgtcctagttgtgacgtgccaacgtgggtggacgtcggtgggggaggtcttgggtccaggtccggtaggggggttccccnggtacaccgttcctccgtgtgccacggccttcgtggactttacgtaacgttttggtactacgtttaagttcggtagttaccggaccggttcggggtacccgtcccgtacggttaccgttacccggaaggggggttaaccggggcgtacgggtagggtacggggtacgaacccaaacgtacggttaaaccggaggggtacgggttagggttaacgtaaaaccggtaaaacgttggttaggtacggtacgttcgttacggtacgggcccggggttaccgtaaaccgtttcccgtaaccgtacttccgtaacccgtaaggaaccgaaacccgaaccggtaaaaccccaaaaacgttctaagttacggtaacttaccgtagaaccgtaaacggtcgggtaacccgtctaaggacgtacctaccgggtaaccgaccggtaaccgtcgttaggttaacgttaactttacggttcgaagggcctaaaggtaggtttaaccgttaaacggttaacgttaaaccggttttaaacggtttacggaacgtttacgggtaacgtttaggttaaggttaccgtattaccggg

SEQ ID NO: 116050 - DNA, 658 bp, Homo sapiens
  misc_feature: GYAE6OF02JPWFU.37.34.D01.1.454.CMB.1.raw
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
  modified_base (261)..(261): a, c, t, g, unknown or other
  misc_feature (261)..(261): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
tcagtagtgtagatcacgaccggtgctcgatttagatcgtctgtgttgggttttccttgttgctatttagaagtgtccagtgtgacgtgcaactggtggagtctggggaggcttggtccagcctggggggtccctgagactctcctgtgcagcctcgtggattcaacgtttggagctattggatggactgggtccnccagtctccgagggagggctggagtgggtgccaagntacgagggagtcggtagaacgaaaaactntgtggactctgtgcggggccattcgacatctccgagngacaacgaccaaaactcacgtgtactntgactaagtcggacggtcctgacgagtccggagaccgacggcttggtagtatttagtggttacgcgaagtagttacgtttagaactaacgtaaggtttacgtagtacgtaagtcggttaatacgtagttacgtacgttaacgtacgtaacgtccggttacgggtaccgtaaacggaccgtagtacggtaccgtaaccgttcgtactcgtaaccgtccgtacccgaaccgtaaccggaccgtacgtccggttacccgttcccgtcgtcccgtccgtaccgtcgtcccgtagacccgtacgacccggttccgacggtacgacgtaccgtaccggg

SEQ ID NO: 116051 - DNA, 601 bp, Homo sapiens
  misc_feature: GYAE6OF01DYZ8X.4.19.B08.1.454.CMB.1.raw
tcagagcactgtagcacgaccggtgctcgatttagtgagtcagtaaagggaaaggggcagcttcagctgtgctagagaagacaggattcaggacaatctccagcatggccggcttccctctcctcctccaccctcctcactcactgtgcagggtcctgggtccagtctgtgctgactcagccaccctcagcgtcgtcgggacccccgggcaggagggtccaccatctcttgttctggaagcaactccaacatacgaaacttattatgtatactggtaccagcagtcccgacggaaccggacccccaaactcctcactctaataagaataatcagccggccctacgacgggtccctagaccgtattctctggcctccgaacgtcccggcacctcacgtccctcccgtggcccatcgaggtcgggccgtccgggtccgaggatggacggtctagtacttattactgtcgcgacaggtggatcggaccggtcgtggtcgttaggggtactcggttccgttacggaccgtagggacccgtaacggtccgaccgttccgtacggtccaccggtacccgaaacggccccaaaccccgtgtcgtaccc

SEQ ID NO: 116052 - DNA, 633 bp, Homo sapiens
  misc_feature: GYAE6OF01CEKB2.4.19.B08.1.454.CMB.1.raw
  modified_base (210)..(210): a, c, t, g, unknown or other
  misc_feature (210)..(210): n is a, c, g, or t
tcagagcactgtagcacgaccggtgctcgatttagtgagtcagtaaagggaaaggggcagcttcagctgtgctagagaagacaggattcaggacaatctccagcatggccggcttccctctcctcctcaccctcctcactcactgtgcagggtcctgggtccagtctgtgctgactcacgccaccctcagcgtcgtcggggacccccggnagagggtcaccatctcttgttctggaacgccaactccaaacataccgaaaacttattatgtaatacgtcggtaccagcacgttcccgaacggaacccggacccccaaactcctacactactaataaagaataatcacgccgacctcgacgggtcctagaccgtattctcgtcggtacctaccgaaacgtcccggacctacctcacgtcccttcccgtggcccactcgacggtcgggccgtccggtaccggacgagtcggaggtctagtacttacgttacgtgtcgcgactagtggagtcggaccggtccgtaggtccggttagggtacgtcggttccgttacggtaccggtacgggaccgtaacggtccgtaaccggtccgtacggtacgacggaccccaacggacccaaccccgtgtcgtcc

SEQ ID NO: 116053 - DNA, 710 bp, Homo sapiens
  misc_feature: GYAE6OF01B9CLB.4.19.B08.1.454.CMB.1.raw
  modified_base (218)..(218): a, c, t, g, unknown or other
  misc_feature (218)..(218): n is a, c, g, or t
tcagagcactgtagcacgaccggtgctcgatttagtgagtcagtaaagggaaaggggcagcttcagctgtgctagagaagacaggattcaggacaatctccagcatggccggcttccctctccctcctccaccctcctcacctcactgtgcgagggtcctgggtcccagtctgtgctgactcacgcccaccctcagccgtccgtcgggacccccgggnaggacggtccaccatctcttgttctggaagcaactccaaacatacgaaattattatcgtaatactcggtaaccagactacgttcccgaaggaacccgaccccctaaactccctactactacctaaataaacgaattaactcgaacgcccggtacccctacgaccggggtccctacggacccgtagttccgtcgtcggcctacccgaacggtcccggacctaccctacgaccgtcccctcccgtacgcctacgtcgtacggtcgggtaccgtcccgggtaccggaggtagtcggacgtcgtagttaattacgttacgtgttacgacgtacgtggtacggtacgtacggccggtaccgtgggttacggttgggttacttcggttccggttaccggtccggtaacggaaccggtacggttcccgtaacccggttccgtaacggtcccaaccggtaccccgaaccggaacccccaaccccgtagtccgttaccccg

SEQ ID NO: 116054 - DNA, 848 bp, Homo sapiens
  misc_feature: GYAE6OF01E2KEE.4.19.B08.1.454.CMB.1.raw
  modified_base (546)..(546): a, c, t, g, unknown or other
  misc_feature (546)..(546): n is a, c, g, or t
tcagagcactgtagcacgaccggtgctcgatttagtgagtcagtaaagggaaaggggcagcttcagctgtgctagagaagacaggattcaggacaatctccagcatggcccggcttccctctcctcctcaccctcctcactcactgtgcgagggtccgttcgggtcctagtctggtcgtcgtcgactcacgcccaccctcacggtccgtccggtccggggaccccccgggcgaagggtacggggttccaccgtacgtttcctttcgtttacggtttcgtacgggaacgacctaaacgtacccaaaaccgtattaaccgttaaaactttacgtttaattacggttaacttaccgttacgggtaaccacgtaccgttaaccggttacccgaaaccggtaaccccggaaccccctaaaccttccctactactacttaaactaaagtaaaattaactaccgacggcccgtacccgtcgggtaaccgggtcccgtacgtaccgttacttaccgtcgtaccggtacctaccggtaccggtcccgacctaccnccgtccggtcccctacccgtcgacccgttgacccgttaccgggggtaccggtccccggttcccgggtacggtacgggtacttcgggacggttaccttaggtttaaacgttttctttaggtccggtacggaacgttacgtacgggttgggacgtaccgggtccgggtcgtagggttcggttaaggtcgttaacggttcggttaacccgggtaacgtacggggtaacccttaacgggtccctaccggttcgaacggtccccaaccggaacccgtacccggaacccccaccgttgtcccttaccg

SEQ ID NO: 116055 - DNA, 661 bp, Homo sapiens
  misc_feature: GYAE6OF01A1T32.4.19.B08.1.454.CMB.1.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (355)..(355): a, c, t, g, unknown or other
  misc_feature (355)..(355): n is a, c, g, or t
  modified_base (428)..(428): a, c, t, g, unknown or other
  misc_feature (428)..(428): n is a, c, g, or t
tcagagcactgtagcacgaccggtgctcgatttagtgagtcagtaaagggaaaggggcagcttcagctgtgctagagaagacaggattcaggacaatctccagcatggccggcttccctctcctcctccaccctcctcacctcactgtcgcgtacgggtccgtgggtcctagtctggtgctgactcacgcccaccctgacgccgtccgtccggggacccccggnacggaggtccacctnttccttcttcgttcgtaggaacgtacaacctaccaactacgtacgtaaacttattatagtatacgtgtaaccagctacgtccgaacggacccgaccccaactcctacactactaanaagaatacacgacggccgtcctaccggacggtccctcgaccgtctctcgtcgtacctacctacggtcccgacncctcgaccgtccctccgtcgtcctagtcgtcgggtcgtaccgtcggaccgaggtactggacgtgtagttacttacgtcgtgtcggacgacgtagggtacgtcggtacggaccgggtcgttcgggtcggttacggtagttccgtccggtaccggtccggtacgggaaccgtccggttaccgaccgttccgtacgacctaccgaccccgaaccgacccaaccctcgtcctacccg

SEQ ID NO: 116056 - DNA, 903 bp, Homo sapiens
  misc_feature: GYAE6OF01BY9X0.4.19.B08.1.454.CMB.1.raw
  modified_base (120)..(120): a, c, t, g, unknown or other
  misc_feature (120)..(120): n is a, c, g, or t
  modified_base (230)..(230): a, c, t, g, unknown or other
  misc_feature (230)..(230): n is a, c, g, or t
tcagagcactgtagcacgaccggtgctcgatttagtgagtcagtaaagggaaaggggcagcttcagctgtgctagagaagacaggattcaggacaatctccagcatcggccggcttcccnctcctcctccaccctcctcactcactgtcgcgaggtccgtcgggtccagtcgtgtgactgactcacgcccaccctcgacgtccgttccggtacccggggaccccccgggngacgggtacgggtccaaccctactttcctttccgtttacggtttaccgtacgggaaactccctaaaacctacccaaacgtaaccgttaacgttaaaacctttaagttttagttacgttaacttaaccggttacgggtaaccctacgtaccgtaaccggttaccccggaaaccgggaaaccccggtaccccccctaaaattcccctaacactttaacgtaaactaaacgtaaactaaccgtaccggacggccccggttacccgtaccggtaccggggttcccctacggtaccttagtttcccttcggtacgtaccccgtaccggtaaccggtcccgtaccctacccgtacgccctccccgttacccgtcggaccctacggtaccggtacgggtcccggggttaccggttaccccgggtacggtaagggtaccgttggggaacgtttcgttaacggtttaactttacgtttacggtcgttccggacgtaccgttagggtcggtaacggtccggtaccgggtccgtttcgggtcggttagggttaccgttccgggtttaccggtaccgggtacccgggtacggttaacccggtccgttacccggtacccggtccggtacggtacccgacccggtacccgtaacccgaccccggtaaacccttccggacgttacccg

SEQ ID NO: 116057 - DNA, 790 bp, Homo sapiens
  misc_feature: GYAE6OF01DIBVW.4.19.B08.1.454.CMB.1.raw
  modified_base (172)..(172): a, c, t, g, unknown or other
  misc_feature (172)..(172): n is a, c, g, or t
  modified_base (234)..(234): a, c, t, g, unknown or other
  misc_feature (234)..(234): n is a, c, g, or t
  modified_base (555)..(555): a, c, t, g, unknown or other
  misc_feature (555)..(555): n is a, c, g, or t
  modified_base (632)..(632): a, c, t, g, unknown or other
  misc_feature (632)..(632): n is a, c, g, or t
  modified_base (781)..(781): a, c, t, g, unknown or other
  misc_feature (781)..(781): n is a, c, g, or t
tcagagcactgtagcacgaccggtgctcgatttagtgagtcagtaaagggaaaggggcagcttcagctgtgctaagagaagacaggattcaggacaatctccagcatggccgtcttccctctcctcctcctaccctcctcactccacgtgtgcgagggttccgtgggtaccngttctgtcgctgcctacgacgccctaccctgacgtccgtcgtacccggggacccccgggtanaacgggtacggggtacaaccctacttcgtttacgtttcggttccgtaaggggaaaccttaccaaacctccctaaaacgtactttaaaccggtaaacttttaagtttaacgtggtttaacctacggttacgtacccgagtacctaacggttacccgaaccgggtaacccggaaccccctaaacttccactactactaaagtaacgttaatacgtacacggcccggttcccaagggttcccggtccgagtaccgttcgttcgtaccgtgaccctacgtaaaccgtccggaacctacctcggacctcccgttaccgccggtacncgttacggtacgggtccggttccgtacccgggtcgaggtaggtaaccggcgttacggtagtttaagtttacttacgngtacggcgtaacgtcggtaaggtcgtacggtccgtaccgggtcgttaggttgggtttacgtggttcccggttacgaccggttcgggaacgttaaccgggtccgtaacggttcgaccggacccgacgacccgtaaccgacctaacccgtnttcgacccg

SEQ ID NO: 116058 - DNA, 830 bp, Homo sapiens
  misc_feature: GYAE6OF02GY4LI.4.19.B08.1.454.CMB.1.raw
tcagagcactgtagcacgaccggtgctcgatttagtgagtcagtaaagggaaaggggcagcttcagctgtgctagagaagacaggattcaggacaatctccagcatggccggcttccctctcctcctcaccctcctcactcactgtgcgagggtccgtgggtccagtctgtgctgactcacgcccaccctcacgcgtcgtccggggacccccggcgaggacggtccacctatcttcttgttctaggaacgcaacctaccaaactactaaccgttaaaactttattaagttagttaactaacgttacggtaaccagtaccgtaacgttaccccgaacgggaaaccccggaccccctaaaaccgttcccctactaacttactaaagttaaagtaaactaactaccgaacggtccgtccgtaccggtaccgggttaccctcgaacctacttcctcgtccggtacctaccgaaccggtccgacctacccgtctaccggtacccctcccgtacggacctacgtaccgtacgggttcccgggtcccgtacccggggtaccggtaaggtacgtacgggtaccggtacgttaacggtttaacgttttaacgtttaccggttacggtccggtaacccggtaacgttaacgggtcggggttaaacgtcgggtaacccgggttccggttaggggtccggggtttaagggttctttaccgggttccgttaaccggggtaccgttacgggtaaaccgtacgggttaacctacccgggttaccgtaacggtaccgaacccgtacccggtaaaccggacccctaacccgtacgttaccgtacccg

SEQ ID NO: 116059 - DNA, 155 bp, Homo sapiens
  misc_feature: GYAE6OF01CH8VC.19.65.F10.1.454.CMB.1.raw
  modified_base (153)..(155): a, c, t, g, unknown or other
  misc_feature (153)..(155): n is a, c, g, or t
tcagtactctcgtgcacgaccggtgctcgatttagctacgctctaagggggaggtgtgtcacaagatttgggctctgggcacagcggccctgggctgcctggtcaaggactacttcccacgagagtactgagcgggctggcaaggcgcatagnnn

SEQ ID NO: 116060 - DNA, 437 bp, Homo sapiens
  misc_feature: GYAE6OF02G9TFJ.19.65.F10.1.454.CMB.1.raw
  modified_base (243)..(243): a, c, t, g, unknown or other
  misc_feature (243)..(243): n is a, c, g, or t
  modified_base (423)..(437): a, c, t, g, unknown or other
  misc_feature (423)..(437): n is a, c, g, or t
tcagtactctcgtgcacgaccggtgctcgatttagctacgctctaagggcaagggctggagtgggtggcagttatatcatatgatggaaacaaaaatattatgcagactccgtgaagggccgattcaccatctccagagacaattccaagaacacgctgtatctgcaaatgaacagcctgagagctgaggacacggctttgtattactgtgccgaccccccactccggggatcctagcccctnaggtgactactggggccagggaaccctggtcaccgtctcctcagcttccaccaagggcccatcggtcttcccctggcgccctgatccaggagcacctctgggggcacagcggccctgggctgccctggtcaaggctacttcccacgagacgtactgagcgggctggcaaggcgcgatagnnnnnnnnnnnnnnn

SEQ ID NO: 116061 - DNA, 515 bp, Homo sapiens
  misc_feature: GYAE6OF01ALYEB.42.58.F03.1.454.CMB.1.raw
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggctggttggcctggtatcagcaaaaaccnggggaaacncccctaaactcctgatttcaaggcatctactttagaaggtcgagtcccatcaaggttcagcggcaatagatttgggacagaattcactctcaccatcagcagcctgcagcctgatgtattttgctaacttattactgacccaacagtaacaagagtagaatttgggtagacggttcggaccgaagggacccgaggggtaggaggagggaaacgacgtggtggctgcaccatcgtgtcc

SEQ ID NO: 116062 - DNA, 554 bp, Homo sapiens
  misc_feature: GYAE6OF01D5E9N.42.58.F03.1.454.CMB.1.raw
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggctggttggcctggtatcagacaaaaaccagggaaacgcccctaaactcctgatttcaaggcatctactttagaagtcgagtcccatcaaggttcagcgcaatagatttgggacagaattcactctcaccatcagcagcctgcagcctgatgtattttgactaactttattactcgaccaacgtaacgtaacaaaggtagttagtaaagtttgggtagtaccggtttcgggacccgaaaggggacccgaaggggttaggaaggaagggaaacggtaacgtggtagggaccgttggaccaacctatccgtgttacc

SEQ ID NO: 116063 - DNA, 582 bp, Homo sapiens
  misc_feature: GYAE6OF01C8JOL.42.58.F03.1.454.CMB.1.raw
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggctggtggcctggtatcagacaaaaaccgagggaaacgacccctaaaactcctagtactttactaaggctattactaactttaaggaaggtcgagtacccatacgtaaggttcaggcggacaaagttaggtaagtttagggaactaagtaacttcacttctacacctatcagcagcctgcagcctgattgtattttgactaactttattactagacctaaagagtaacaaggtagtagaagtttgggtacgtacggttaccgggaccgtaaagggaccgtaggggtaggaaggaagggaaacgtacgtggtaggacgtaggaccaacctacgtcgttgttacc

SEQ ID NO: 116064 - DNA, 564 bp, Homo sapiens
  misc_feature: GYAE6OF01BC7A9.42.58.F03.1.454.CMB.1.raw
  modified_base (229)..(229): a, c, t, g, unknown or other
  misc_feature (229)..(229): n is a, c, g, or t
  modified_base (368)..(368): a, c, t, g, unknown or other
  misc_feature (368)..(368): n is a, c, g, or t
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccggccagtcagngtgttggaggctggttggcctggtatcagacaaaaaccagggaaacgcccctaaactcctagatttcaaggcatctaactttagaaggtcgagtcccatcaaggttcagcggacaatagatttgggacagattcactcncaccatcagcagcctgcagctgatntatttgactaatttatactagacccaanacgtaacaagtacgtagtaaagtttgggtacgtaccggttacgggacccgtaaaggggacccgtaagggggtagggaacggaagggaaaccggaacgttgggtagggccgtaggaccctaaccgtaagttccgtggtttaccc

SEQ ID NO: 116065 - DNA, 539 bp, Homo sapiens
  misc_feature: GYAE6OF01D51JG.42.58.F03.1.454.CMB.1.raw
  modified_base (276)..(276): a, c, t, g, unknown or other
  misc_feature (276)..(276): n is a, c, g, or t
  modified_base (420)..(420): a, c, t, g, unknown or other
  misc_feature (420)..(420): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggcagtcagagtgttggaggctggttggcctggtatcagacaaaaaccagggaaacncccctaaactcctagtatttctaaggcatctactttagaaggtcgagtccatcaaggttcagcgacaatagatttgggacagaattcactctcacatcagcagctgcagcctgactgtatttgctaactttattactgaccaanagtaacaaggattagaattggtagtacgttcggaccgtaaaggggaccgaaggggtaggaaggaaagggaaacggtaacgttaggtcgggacgtcgaccaacctagttccgtggttacc

SEQ ID NO: 116066 - DNA, 583 bp, Homo sapiens
  misc_feature: GYAE6OF01AJJ90.42.58.F03.1.454.CMB.1.raw
  modified_base (278)..(278): a, c, t, g, unknown or other
  misc_feature (278)..(278): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggctggttggcctggtatcagacaaaaaccgagggaaacncccctaaactcctagatttctaaggcatctacttagagtcagtccatcaggttcagcggcaatagatttgggacagaattcactctcaccatcagcagcctgcagcctgatgtattttgctaactttattactgaccctaacgtagtaaccaaggtagttagaaagtttgggtacggtacggttaccgggaccgtaagggggtacccgtaagggggttacgggaacgggtaaaggggaaaaccggtaacgttcgggttacggggaccgttacgggacccaacccgtacgttccgttgtttacccg

SEQ ID NO: 116067 - DNA, 515 bp, Homo sapiens
  misc_feature: GYAE6OF01AFFKH.42.58.F03.1.454.CMB.1.raw
  modified_base (278)..(278): a, c, t, g, unknown or other
  misc_feature (278)..(278): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggctggttggcctggtatcagacaaaaaccaggggaaacncccctaaactcctagatttctaaggcatctactttagaaggtcgagtccatcaaggttcagcgcaatagatttgggacagaattcactctcaccatcagcagcctgcagcctgatgtattttcgactaactttattactgaccaacagtaacaagagttagaaatttgggtagtacgttcgggaccaaggggaccaggggtggaacggaaggaacgagtgngctgcacntcgtgtcc

SEQ ID NO: 116068 - DNA, 555 bp, Homo sapiens
  misc_feature: GYAE6OF01BJUHH.42.58.F03.1.454.CMB.1.raw
  modified_base (377)..(377): a, c, t, g, unknown or other
  misc_feature (377)..(377): n is a, c, g, or t
  modified_base (424)..(424): a, c, t, g, unknown or other
  misc_feature (424)..(424): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggctggttggcctggtatcagacaaaaaaccgagggaaaacgccccctaaaactcctagtatttctaaaggcatctaactttagaaggtcgagtcccatcaaggttcagcgacaatagatttgggacagaattcactcncaccatcagcagcctgcagcctgatgtattttgactaacttattacngacccaactagtaacaaaggtagttagtaagtttgggtagtacggttacggaccgaaaggggtaccgagggggtaggaggaagggaaacggacgttggtacggctacggacacctagttccgttggttacc

SEQ ID NO: 116069 - DNA, 621 bp, Homo sapiens
  misc_feature: GYAE6OF01CCDVG.42.58.F03.1.454.CMB.1.raw
  modified_base (605)..(605): a, c, t, g, unknown or other
  misc_feature (605)..(605): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtcctccttccaccctgtctgcatctgttggagacacagtcatcatcacttggccgggccagtcagtagtgttggaggctggtggctggtatcagacaaaaccgagggaaacacccctaaactcctagtactttacgaaggctattcttaacgtttaaggaacggtcgacgtcccaatacgtaaggttcagcggactaaagtagtagtttgggaacaagtaacttcactctacacatcagcacgtcctgactagtcctagtattgttattttcgaaccttaactttataccgtataaccctaaacgtaagtaacgaagtaaggttagttaaaggttcgggtaacgaccggttacgggaccggtaaacggggaccggtaaggggtacgggaacggtaaaggaaacggtacgtgggtacggtcctacggaaccctaaccgtnttccgttcgtttaccc

SEQ ID NO: 116070 - DNA, 528 bp, Homo sapiens
  misc_feature: GYAE6OF01CTJX9.42.58.F03.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (399)..(399): a, c, t, g, unknown or other
  misc_feature (399)..(399): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtgganacacagtcatcatcacttgccggcagtcagngtgtggaggctggtgctggtatcagacaaaaacgaggaaacaccctaaactcctagattcaagcatctacttagagtcagtccatcagtcagcgacaatagagtttggactagattcactctacacatcagcagcctgcagcctagattgtattttgactaacttacttacncaccaataagtaacaagtagtagtaagtttgggtagtacggttccggaccgtaacggggaccgtagggggtacggaaaggaaggaaaacggacgtgggtacggacgtcggaccacctattcgtgttacc

SEQ ID NO: 116071 - DNA, 641 bp, Homo sapiens
  misc_feature: GYAE6OF01ADUTP.42.58.F03.1.454.CMB.1.raw
  modified_base (102)..(102): a, c, t, g, unknown or other
  misc_feature (102)..(102): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
tcagtgacgtatgtcacgaccggtgctcgatttagtctgatcgagaagggaaagggggagtcagacccagtcaggacacagcatggacatgagggtccccgntcagctcctggggctcctgctgctctggctcccaggtgccagatgtgacatccagatcgacccagtcctccttccaccctgtctgcatctgtggagacacagtcatcatcacgttggccggcagtcagagtgtggagctggtgctggtancagacaaaaccgngggaacncccctaaatcctagactttcaaggctatctacttagaggtcgagtccatcgaaggttcgagcgacaagtgtagttgggacaggtaattccgaactcctacacctataccagtcaacgtcctacggcctaacgcccgttagtacgttacgttaacgtttttcgaaccttaaacttttacttaaccgtacgtacctaaacgtagtaaccgtaagtagttaacgtagttacgggttacgtaccgggttacgggacccgtaaacggggtacccggtaagggggttacgggaaacggtaaggggtaaacccggtaacgggttacgggtacgttaccggtaccgaccgtaacccgtacttccggttctttacccg

SEQ ID NO: 116072 - DNA, 576 bp, Homo sapiens
  misc_feature: GYAE6OF01B1O96.42.58.F03.1.454.CMB.1.raw
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggcgtggttggcctggtatcagacaaaaaccgagggaaacgacccctaaactcctagtactttacgaaggctattctaactttagaaggtcgacgtcccatcaaggttcagcgacaagtagtagttagggacagtattcactctcacatcagcagcctgcagctagattgtattttcgacttaactttacttactacgacctaaacgagtaacaaggtagttaggtaatttcgggtacgtaccgtcggaccgtaaacgggtccgtaaggggtaggaagggaaggaaaccggtacggttggtacggtacgtacgacctaaccgtacttcgtgtttaccc

SEQ ID NO: 116073 - DNA, 588 bp, Homo sapiens
  misc_feature: GYAE6OF01A5K27.42.58.F03.1.454.CMB.1.raw
  modified_base (348)..(348): a, c, t, g, unknown or other
  misc_feature (348)..(348): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttggccggccagtcagagtggttggaggctggttggcctggtatcgagacaaaaaccgagggaaacacccctaaatcctagtactttacgaaggctatctactttagaagtcgagtcccatacaagtcagcgganaatagtagtttagggactaagtaattccaactctacaccatcagcagcctgcagcctgatgtatttgacttaacttattactcgaacctaacagtaacaaggtagtagtaagttaggtacgtaaccggttccgggaaccgtaaggggacccgtaaggggtacggaaacggtaaagggaaaccggtaacgttcggggtaaggtaccgtacggacctaaaccctaggttccgttggttaccc

SEQ ID NO: 116074 - DNA, 606 bp, Homo sapiens
  misc_feature: GYAE6OF01ELWDG.42.58.F03.1.454.CMB.1.raw
  modified_base (102)..(102): a, c, t, g, unknown or other
  misc_feature (102)..(102): n is a, c, g, or t
  modified_base (195)..(195): a, c, t, g, unknown or other
  misc_feature (195)..(195): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
tcagtgacgtatgtcacgaccggtgctcgatttagtctgatcgagaagggaaagggggagtcagacccagtcaggacacagcatggacatgagggtccccgntcagctcctggggctcctgctgctctggctcccaggtgccagatgtgacatccagatgacccagtctccttccacctgtctgcatctgtgganacacagtcatcatcacttcgccggcagtcagngtgtggagctggtgctgtancagacaaaacgaggaacaccctaaactcctagtactttacgaagctatactactttagaagtcgatccatacgaagttcagcgacaagtagtagttagggactagtaatcactctacaccatcagccagcctgactacgcctagtattagttatttcgaaccttaactttactaccgtacgaaccgtaactacgtaaactaaggtacgttagttaaagtttgggtacggttaccggttaccgggaaccgtaaagggtacccggaagggggttacggaaacgggtaaacgggtaaaccggtaacggtcgggttacgggaccgttacggacccttaaaccgacgtttccgtcgttaccccg

SEQ ID NO: 116075 - DNA, 698 bp, Homo sapiens
  misc_feature: GYAE6OF01EMURR.42.58.F03.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
tcagtgacgtatgtcacgaccggtgctcgatttagtctgatcgagaagggaaagggggagtcagacccagtcaggacacagcatggacatgagggtccccgntcagctcctggggctcctgctgctctggctcccaggtgccagatgtgacatccagatcgacccagtctcctccacctgtctgcatctggtagganacacagtcatcatcacttcgccggcagtcagagtgtggaggtctggttgctggtatcagacaaaaccgagggaaacctaccctaaactccgtagtaatttaccgtaaaggacctagttaccttaacgttttaacggaacgggttaccgaacgtaccctaagttaccgtaaagggtttccaaggtaccggtaactaaacgttaacggtaagttttacgggaactaaggttaaacttacctaaccgttacctaaccacctaacttaccgaacgtccgtaacgccctaggacccaacggtccgtacgtattacggtttaactttcgaaccgttaactttaacgttacctacgaacctaagtaacgtaacgtaagtaggttagtaaggttacgggtacgtacggttaccgggaccggtaaagggtccgaaggggtaggaacggaaaggtaaccgtaacggttcggacggtacgtcgaacccgtaactacggttccgtggttaccc

SEQ ID NO: 116076 - DNA, 737 bp, Homo sapiens
  misc_feature: GYAE6OF01CK8VI.42.58.F03.1.454.CMB.1.raw
tcagtgacgtatgtcacgaccggtgctcgatttagtctgatcgagaagggaaagggggagtcagacccagtcaggacacagcatggacatgacgggtccccgctcagcctccgtggggcctcctgctgctctcggctcccgaggtgccagatgtgacatccagatcgacccagtcctccttccaccctgtctgctatctggtggacacacagtcatcatcacgttcggccggcctaggtcaggtaggttgttgggacggtcgttgggttcggccgtggtactcgaacgtaaccgaaaaaccggtagggaaaacctaccccttaaaacgttccgtaacgtactttaaccgaaggtaccttaacgttccttaacgttttaggaacggttccgaaccgtaccctacgtacgtaacggtttcgacggtacggactaagttaggtagttacgggaactaaggtaacttctaactcctacaacctatacgacgtcacgtcctcgacgaacgtctagtagttacgttacgttttacgaacctttaactttactaacgtacgaaccctaaacgtacgtaaacgtaggtaaccgttgtaacgtttgggtaccgtaccgggttacggaaccggtaaacggggacccggtagggggtaacggaacggggtaaaccgggtaaacgtaaccgggttggtaaccgggaccgtacggtaacccgtaacgcgtttaccgttccggtttacccg

SEQ ID NO: 116077 - DNA, 616 bp, Homo sapiens
  misc_feature: GYAE6OF01EHBUX.42.58.F03.1.454.CMB.1.raw
  modified_base (198)..(198): a, c, t, g, unknown or other
  misc_feature (198)..(198): n is a, c, g, or t
  modified_base (353)..(353): a, c, t, g, unknown or other
  misc_feature (353)..(353): n is a, c, g, or t
  modified_base (394)..(394): a, c, t, g, unknown or other
  misc_feature (394)..(394): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtcctccttccaccctgtctgcatctgttgganacacagtcatcatcacgttcgccggcagtcagtagtgttggaggcgtggttcgcctggtatcgagaacaaaaaccgaggaaaccacccctaaactcctagtatttacgaagctatacttacttagaagtcgacgtaccatacgaaggtcagcganaatagtagttggatagtactcactctacacactcacgcacnccgtgaccgacgtccgtaatcgttaactttcgacttaaactttactacgtacgtaaccaacgtaacgtaacaaggtaagtagtaaggttggttacggtacggttaccggaccggaaacgggtacccggtaaggggtaacgggtaaacggaaacgggttaaacggacggttcgggtacggtacgacggttaccaaccgttagttacgttccgttacttacccg

SEQ ID NO: 116078 - DNA, 996 bp, Homo sapiens
  misc_feature: GYAE6OF01B47UA.42.58.F03.1.454.CMB.1.raw
  modified_base (145)..(145): a, c, t, g, unknown or other
  misc_feature (145)..(145): n is a, c, g, or t
tcagtgacgtatgtcacgaccggtgctcgatttagtctgatcgagaagggaaagggggagtcagacccagtcaggacacagcatggacatggacgggtccccgctcagctccgtggggcctcctgctgctcgtggctcccaggtnccagtatgtagacactccagtatcgacccagttcctcccttcccacccttgtctcgcttacgttcgttaggttaggactaaccaagtacgtactaactacctaacttccgtaccggttccggggcccggacccgtaggtacgacggtaggttacgggttagggtacggttcggtttaggggttccggaccgttaggggttaactaccgtaaaccggaaaacccgtaaaaaccgggtaaccggggtaaaccccttaacccccgttaaaaccgttcccggttaattaccggttttaacggtaaaccggtactttaaccgtttaacggttttaaccggtttaagggaaccgggttaaccggtacccgttaccgtaacgtttaacgttaacgggtaccgaagggtaccgtaaagttaagttaacggtttaggtttaaccggagttaacgtttaaccttaccgtaaccgttacctaccgtaacctacgtacggacgtaccgacgttaccgtacgtaacccgtcgtacgttacgggtattttaccggtttaaacttttacccgtaaaccttttaaaccggtttactttaaccccggtaaagtaaaccccgttaaacggtttaacggaaacgttaaggtaaccggttttaaggttacgggttttaccggttaccggttaaccggggttaacccgggaaacccgggggaaaacggggttaccgggtaaacgggggtaaacggggtaaggggtaaaaaacccgggtaaccggttcgggttaacggggtaacccggtttacccggtaacccgttaaccggtaaccttttaccccgggttcgtttttacccggtttaccccg

SEQ ID NO: 116079 - DNA, 865 bp, Homo sapiens
  misc_feature: GYAE6OF01D1FW3.42.58.F03.1.454.CMB.1.raw
  modified_base (102)..(102): a, c, t, g, unknown or other
  misc_feature (102)..(102): n is a, c, g, or t
tcagtgacgtatgtcacgaccggtgctcgatttagtctgatcgagaagggaaagggggagtcagacccagtcaggacacagcatggacatgagggtccccgntcagctccgtgggcctcctgctgctctggctcccaggtgccagatgtgacatccagactcgaccctagttcctcccttccaccctgtctgctatcgtggtaggagacacagtccatcatcctacgttcggcccggcagtcgagtaggttggtggaggtcgttgggttcggccgttaggtactacgaacgaaaccgaaaaaccggtacggaaaaccccgtacccccttaaacgtccttagttaacgtttacgtaaggtcctaatttccgtttaaacgtttaaggaaccggtaccgtaccgttaccctaagtaccgttaacggttcgaggtaccggtaactaaggttacggtaaggtttaacgggaactaacgtaactttacgacttacccactaacccgtatccgaagccaacgtccgtagacccgtaacggtccgtaaggttactttagtttaacgttttaccgtaacccgttttaaactttaaccgtttaacccgtaacgttaacccgtaaaacgttaacggttaaaacccggtagggttaaacggtttacggggtttaaaccggttttacgggtaacccgggtttacccggggttaacccggggtaaaccccgggaaaaccgggggttaaccggggtaaaggggggtttaaaccggaaaacgggggttaaaacgggtaaaccgtaaagggttccggggtttaacgggcccgttaaaccggtacccgttaaccgttacggttccgtttaccggtttaccccg

SEQ ID NO: 116080 - DNA, 832 bp, Homo sapiens
  misc_feature: GYAE6OF01EW7GX.42.58.F03.1.454.CMB.1.raw
tcagtgacgtatgtcacgaccggtgctcgatttagtctgatcgagaagggaaagggggagtcagacccagtcaggacacagcatggacatgagggtccccgctcagctcctgggctcctgctgctctggcctcccaggtgccagatgtgacatccagatcgacccagtcctcccttccaccctgtctgctattctggttggactacactagtcatcactctacgttcggccggctagtcgaggtaggttggttcgggaggtcgttgggtcggccttaggtactacgaagaaccgtaaaaaaccggacgggtaaaccgccccttaaaactccgttagttaacgttttacgaaggtacctaacgtttaccgtttaacgtttaagggaacgggttaccgtaaccgttacccaagttacgtaacggttacgacggtacgtactaaagtacggttaacgtttagggaactaagttaactccgtaacgtcctaaccgtaacctatacgacgtaccgtaacgacccgtaggtaccaacggtacgttagtaagtttactttaacggtttaccgaaactttaaaccgtttactttaaccgtacgtaaccgtaaacgtaacggttaaacggtaaacggtaggtttaacggtaagggttttcccggggtaacggttaacccggggtttacccgggaaaccgggttaaacccgggggtaacgggaaacggggggtttaacgggtaaaaccggggaaagggttaaaacccgggttaggtaccgggttacggtaacccggtccgtaaccgtaaaccggttccgttaacggttacgtttaaccccgg

SEQ ID NO: 116081 - DNA, 556 bp, Homo sapiens
  misc_feature: GYAE6OF02IVF2T.42.58.F03.1.454.CMB.1.raw
  modified_base (377)..(377): a, c, t, g, unknown or other
  misc_feature (377)..(377): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagtgacgtatgtcacgaccggtgctcgatttagtctgatcgagaagggaaaggggagtcagacccacgtccagggtaccacagcatggtacatgagggtccccgctcagctcctgggctcctgctgctctggtcgtcccaggtgccaggtattgttgacattaccagatgacccagtctccttccacctgtctgcatcgtgttggagacacagtcgatcatcacttgccgggccagtcagagtgttgagctggtggccttggtatcagcaaaaaccagggaaagcccctaaactcctgactttacgaaggcagtctactttagaagtcgagtccatcaaggttcagcgacaatagatttaggacagaattcactntacaccatcagcagcctgcagcctgatgatttgactaacttnttactanccaanagtacaagagtagaattggtagtacgttacgggcctaaagggacctaaggggttacggaaggaagttaacggaaaacggtaacgttagggttacgggcttacggacgtaccgtaggtccttacgg

SEQ ID NO: 116082 - DNA, 557 bp, Homo sapiens
  misc_feature: GYAE6OF02IGEK6.42.58.F03.1.454.CMB.1.raw
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggctggttggcctggtatcagacaaaaaccgagggaaaacgcccctaaactcctagtacttttacaaggcatctactttagaaggtcgagtcccatcaaggttcagcgacaatagatttgggacagaattcactctacacatcagcagcctgcagctgatgtattttagactaactttattactacaccaaatagttaacaagagttagaagtttgggtacgtacggttcggaccgtaaggggaccgtaggggtacggaaggaacgggaaacgtacgttaggtacggcgttaggaccgaccgtagttccgtagttaccg

SEQ ID NO: 116083 - DNA, 579 bp, Homo sapiens
  misc_feature: GYAE6OF02I7LCR.42.58.F03.1.454.CMB.1.raw
  modified_base (342)..(342): a, c, t, g, unknown or other
  misc_feature (342)..(342): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggccagtcagagtgttggaggctggtggcctggtatcagacaaaaaccagggaaacgcccccttaaactcctgatttcaaggcatctactttagaaggtcgagtcccatcaaggttcagcganaatagatttgggacagaattcactctacacatcagcagcctgcagcctgatgtattttgactaactttattactcgaccaacagtaaccaagtagttagtaagtttgggtacgtaccggtttaccgggaccgtaaagggggtccgtaagggggttagggaaagggtaaacgggtaaaaacgtaaccgttgggtagggcccttagggaccctaacccgtacgtttccgttcggttacc

SEQ ID NO: 116084 - DNA, 530 bp, Homo sapiens
  misc_feature: GYAE6OF02H0QWL.42.58.F03.1.454.CMB.1.raw
  modified_base (416)..(416): a, c, t, g, unknown or other
  misc_feature (416)..(416): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccggcagtcagagtgttggaggctggttggcctggtatcagacaaaaaccagggaaaacgccccctaaaactcctagatttctaaggcatctactttagaagtcgagtcccatcaagttcagcgcaatgatttgggactagaattcactctacaccatcagcagcctgcagcctgattgtattttgctaacttattactnaccaataagtaacaaagtagtgtaagtttggtgtacgttacggccgaagggtaccgaggggtacggaaggaaggaaacgaagttggtaggactcggacctaaccatcgtgttcc

SEQ ID NO: 116085 - DNA, 664 bp, Homo sapiens
  misc_feature: GYAE6OF02H7KDW.42.58.F03.1.454.CMB.1.raw
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggcagtcagagtgttggaggctggttggcctggtatcagacaaaaaccagggaaaacgcccctaaaactcctgatttcaaggcatctaactttagaaggtcgagtcccatacaaggttcagtcggacaaatagtacgtttgggaactagtaatttcaacttcctaccaacccattcaacgccaaggccctggccagtccctgacttggtattttcgaccttaactttattacctcgtaccctaaactagttaaaccaaggtaagttagtaaagtttcgggtacggtaccggtttaccgggacccggtaaacggggtacccggtaagggggttacggggaaacgggtaaacggggtaaaaacccgggtaacggtttacgggtaccgggggtacccgtaacgggtaccccgtaaacccggtacgtttaccccgttggttttaccccg

SEQ ID NO: 116086 - DNA, 541 bp, Homo sapiens
  misc_feature: GYAE6OF02HZWGQ.42.58.F03.1.454.CMB.1.raw
  modified_base (276)..(276): a, c, t, g, unknown or other
  misc_feature (276)..(276): n is a, c, g, or t
  modified_base (351)..(351): a, c, t, g, unknown or other
  misc_feature (351)..(351): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccggcagtcagagtgttggaggctggttggcctggtatcagacaaaaaccgagggaaacncccctaaactcctgtatttcaaggctatctactttagaagtcgacgtccatcaagttcagcgacaatgattgganagaattcactctacacatcagcagcctgcagcctgatgtatttgactaactttattactcgacctaagtacgttaacaagtagtagtaagtttggtacgtacgttcgggacctaaggggaccaggggtaggaaggtaacgggaaacgtaacgtgggtacggactacggacctaccgtatccgttgttacc

SEQ ID NO: 116087 - DNA, 650 bp, Homo sapiens
  misc_feature: GYAE6OF02IXRXG.42.58.F03.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (356)..(356): a, c, t, g, unknown or other
  misc_feature (356)..(356): n is a, c, g, or t
tcagtgacgtatgtcacgaccggtgctcgatttagtctgatcgagaagggaaaggggagtcagacccagtcaggacacagcatggacatgagggtccccgctcagctcctgggctcctgctgctctggctccaggtgccagatgtgacatccagatgacccagtctccttccaccctgtctgcatctgtgganacacngtcatcatcacttgccggcagtcagagtgttggagctggtgctggtatcagacaaaacgngggaaaacgcccctaaaatccgtagtactttacgtaaaggctaatactaacttttagaaaggttcgacgtacccaattacgtaacgttcaagtcgganaacgtagaactttagggactaagtaaacttacacgtacctacaactactacacgacctaaggcccttagcgtaacgccgttagaactggttactttagaactaacttacttacgtcgtaacccaaagtataacgtaagtagttagtaaactttcgggtacgttaaccggtaccgggtacctaaagggggtaccctaagggggttaacgggaaacggtaaaccggtaaacgggaacctttacggggtagacccggtttacgaaccggaaccctaggtttaccgagtttaacccgg

SEQ ID NO: 116088 - DNA, 617 bp, Homo sapiens
  misc_feature: GYAE6OF02J1HD5.42.58.F03.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (273)..(273): a, c, t, g, unknown or other
  misc_feature (273)..(273): n is a, c, g, or t
  modified_base (436)..(436): a, c, t, g, unknown or other
  misc_feature (436)..(436): n is a, c, g, or t
tcagtgacgtatgtcacgaccggtgctcgatttagtctgatcgagaagggaaaggggagtcagacccagtcaggacacagcatggacatgaggtccccgctcagctcctgggctcctgctgctctggctcccaggtgccagatgtgaccatccagatgacccagtctccttccaccctgtctgcatctgttganacacagtcatcatcacttgccggcagtcagngtgtgngctggttgctggtntnagacaaaacgngggaaacnccctaancagattcaagcatctactttagagtcagtcccatacgagtcagcgacaatagatttcgggaacagtaacttcactctacacctgtaccagcaacgtccctgtaccagtacccgtgtagtacggtactttttaccgaacgttaaaccttttacgttaccgttanaccccgttaaataacggtaactacggtaagttgtaaacgtttgggaccgtaaccggtttacgggaacccgtaagggtacccgagggggtttaaggacggtaaacggtaaaccggaaccgtttagggacgggttaccgtacggtaccctaaacccggtacgtttaccgttccggtttaaccc

SEQ ID NO: 116089 - DNA, 585 bp, Homo sapiens
  misc_feature: GYAE6OF02IVTG3.42.58.F03.1.454.CMB.1.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (338)..(338): a, c, t, g, unknown or other
  misc_feature (338)..(338): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccggccagtcagngtgttggaggctggttggtctggtatcagacaaaaaccgagggaaacncccctaaactcctgtatttcaaggcatctattagaaggtcagtccatcaaggttcagcganaatgatttggactagaatcactctaccacatcacgacagctagccagtccctagacttggtacttttagaccttaaacgttttattaccgtacgaccctaaagtacgttaaacaacgggtagttaggtaacgtttcgggtaaggtacccgttacgggaccgtaaggggacccgtaagggggtacggaaggtaacgggaaaccgtaagtacgggtaggacctggacctaccgtacttccgtggttacc

SEQ ID NO: 116090 - DNA, 776 bp, Homo sapiens
  misc_feature: GYAE6OF02G8IBK.42.58.F03.1.454.CMB.1.raw
tcagtgacgtatgtcacgaccggtgctcgatttagtctgatcgagaagggaaagggggagtcagacccagtcaggacacagcatggacatggagggtccccgctcagctccgtggggctcctgctgctctggctcccaggtgccagatgtgacatccagatcgacccagtcctccttccaccctgtctgcatctgtggacacacagtcatcatcacgttcgccggccagtcagtacgtgttggaggtcgttgggttcggccgttaggtactcgaacgtaaccgaaaaaaccgaggggaaaacctacccccttaaaacgtcccgttagtaacgttttaccgaaaggtctaacgttaccttaacgttttaaggaacggttaccggtaccgttaccctaagtacgtaaacggttaccgaacggtaccggtaataagttaggttacggttaagggaataagtaacttccgacttccgtaccaaccgtataccacgtcgaacctccgtacggactaacggtccgttagttaacggttacgtttaactttccggtaaactttaacctttacgtttaccggaccgtaaacccgtaaacgttaacgtaaacggtaacgggtttaagttaacggtaacgggtttggttaaccgggttaacccggtttaaccggggaaggtaaacccggggtacggtaaggggtaaacgggaacgggttaaaacgaaaccggtgggttaacggtggtaacctaccggccgttaaacgttctacggttaccttaccg

SEQ ID NO: 116091 - DNA, 841 bp, Homo sapiens
  misc_feature: GYAE6OF02ILUDA.42.58.F03.1.454.CMB.1.raw
  modified_base (159)..(159): a, c, t, g, unknown or other
  misc_feature (159)..(159): n is a, c, g, or t
  modified_base (558)..(558): a, c, t, g, unknown or other
  misc_feature (558)..(558): n is a, c, g, or t
tcagtgacgtatgtcacgaccggtgctcgatttagtctgatcgagaagggaaagggggaggtcgagacccagtcaggacacagcatggacatgagggtccccgctcagctcctggggctcctgctgcctctcggctcccaggtcgccagactggtgacntccagatcgacccagtcctccttccacctgtctcgactatcgtgtcggactacacagtcatcagttccacttcggcccggcgagtcgagaggttggttaggacggtcgttgggtttcggcccgttgggttactacgaacggaaacccgaaaaaccgtagggggaaacccgtaccccttaaaaccgtccttagtaaccgttttaccgaaaggtacctaattacccgtttaacggttttaaacggacgggttaccgttaaccgtccccgtaattaccgtaacgggttaccacgggtaccgaattaaagttcgggtttagtttacggggaaactacgttaacgttacctacctaaccgttaccaccgtaattaaccgcgtaacgacgtccgtacgcgtaccncttacggtattacgtattttaccgatttaaaccgtttatacgttaccgaacccttaataacgggtaaacctaaacgggtagtttaggggtaaactttttcgggggaaccgtttaaacgggtcccggaaaccggggttaaaccgggtaaccgggtttaagggggggttacggaaaaaccgggttaaaccggggtaaacggttttaaacccgggtgggttaaccccgggtacgtaccggggtaaccttaaaccccgggtttacttaccccgggtttagttacccg

SEQ ID NO: 116092 - DNA, 569 bp, Homo sapiens
  misc_feature: GYAE6OF02FKJS6.42.58.F03.1.454.CMB.1.raw
  modified_base (273)..(273): a, c, t, g, unknown or other
  misc_feature (273)..(273): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (423)..(423): a, c, t, g, unknown or other
  misc_feature (423)..(423): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggcagtcagagtgttggaggctggttgctggtatcagacaaaacgagggaaacncccctaaatcctagtatttacaagcatactacgttagagtcgacgtccatcaaggtcagcganaatagagttagganagtaattcactctacacatnagcacgcctgacacgtcctagactagttatttacgacttaaactttacttacncgtaacccaaatagtaactaagtagttagtaagtttgggtagtaccggttcgggaccgtaaggggaccgtaggggtacggaaagggaacggtaaacgtacgtaggtaggtaccgtacggaccgtaacgtacgttcgtacgttaccg

SEQ ID NO: 116093 - DNA, 604 bp, Homo sapiens
  misc_feature: GYAE6OF02GPJYM.42.58.F03.1.454.CMB.1.raw
tcagtgacgtatgtcacgaccggtgctcgatttagtctgatcgagaagggaaagggggagtcagacccagtcaggacacagcatggacatgaggtccccgctcagctcctggggctcctgctgctctggctcccaggtgccagatgtgacatccagatgacccagtctccttccaccctgtctgcatctgtgagacacagtcatcatcacttgccggcagtcagtagtgtgagctggttgcctggtatcagacaaaacgaggaacaccctaaactcctagattacgaagcatctaattagagtcgactccatcgaagttcagtacgctaagtagtagtttggactagaacttcgaccttctaccacctatcaacgactacgcctgacgtacgccgtagtaacttggttattttacgacctttaactttactttacaccggtacctaaacgacgtaaacctaaggtacgtagttaagttacgggttacggtaaccggttccgggaacccggaacgggttacccggtaaggggtacggtaaggaaacgggtaacggtaacgtaggtacggtactacgggaaccctacgacgtttaccgtgttaccc

SEQ ID NO: 116094 - DNA, 619 bp, Homo sapiens
  misc_feature: GYAE6OF02FVDI6.42.58.F03.1.454.CMB.1.raw
  modified_base (122)..(122): a, c, t, g, unknown or other
  misc_feature (122)..(122): n is a, c, g, or t
  modified_base (132)..(132): a, c, t, g, unknown or other
  misc_feature (132)..(132): n is a, c, g, or t
  modified_base (196)..(196): a, c, t, g, unknown or other
  misc_feature (196)..(196): n is a, c, g, or t
tcagtgacgtatgtcacgaccggtgctcgatttagtctgatcgagaagggaaaggggagtcagacccagtcaggacacagcatggacatgaggtcccatcagctcctgggctcctgctgctntgctccagtnccagatgtgacatccagatgaccagtctccttccacctgtctgctatcgtgttaggacgtacanagtcacgtcatcacttcggcccggtcagtcagtacgtgtcggagccgttggtcgcgtgtatcgagacgaaaacgaggaaccgtacccctaaacgtccgtagtactttacgtaacggctacttacgttacttaagacggttaccgacgtaccctagtacgtaaggttccaaggtcggacaagttaggtaagtttacggacgtaacgtacttaccgacttcgtaccacctatccagctacgccgtgaccgacgtcgtaagccgttagttaacgtttaccgacttaacgttctacgtcgaacctaagtaacgtacaacggtagttcgtaacttcgggaactccggtagcccgaagggtccgaggggtagtaacggacgtaacgtacgtacgtcggtactacgtccgacgttagtccgttatacccg

SEQ ID NO: 116095 - DNA, 666 bp, Homo sapiens
  misc_feature: GYAE6OF02F06UG.42.58.F03.1.454.CMB.1.raw
  modified_base (475)..(475): a, c, t, g, unknown or other
  misc_feature (475)..(475): n is a, c, g, or t
  modified_base (497)..(497): a, c, t, g, unknown or other
  misc_feature (497)..(497): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacactccagatcgaacccagtcctccttccacccttgtctgcctatcgttggttaggacacacagtacatacacttaccgacgttcggcccggtacctaggtacgagtaggttggttgggacggttcggttgggttcggtcgttaggtactaccgaaacggtaaaccgaaaaaccggacgggtaaaccctacccttaaacgtccgtagtacttacgaagtctacgttacttagtagacgtcgactccgagtacgtagtcgacgcgtaactagtacgtagtacggacaatactactactacaccaactctacgacgtactcgtccgngtacgacgtacttgtaacgttnttacgttactaactttacttaacgtaccataaaccgtacgtaaagtaacggttagaagtttacgggttagttaccgggtaccgtaacggtacggaaccggttaggggacggaacggtaaggaacggtaacgtaagtcgagacgcgtacgtcctattcgttactctaccc

SEQ ID NO: 116096 - DNA, 706 bp, Homo sapiens
  misc_feature: GYAE6OF02FLX4Q.42.58.F03.1.454.CMB.1.raw
  modified_base (200)..(200): a, c, t, g, unknown or other
  misc_feature (200)..(200): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (670)..(670): a, c, t, g, unknown or other
  misc_feature (670)..(670): n is a, c, g, or t
tcagtgacgtatgtcacgaccggtgctcgatttagtctgatcgagaagggaaaggggggagtcagacccagtcaggacacagcatggacatgagggtccccgctcagctcctggggctcctgctgctctggctcccaggtgccaggatgtgacatccagatgacccagtcctccttccaccctgtctgcatctgttgganacacagtcatcatcacttgccggcagtcagagtgttggaggctggttggcctggtatcagacaaaacgngggaaacncccctaaaactccgtagtactttacgaacggctaacttacttaacgttttaggaaacggttcgaacgtcccctaattacgtaaggttcaagtccggactaaagtagtacgtttacggggaactaacgtaaattccgtacgtctaccaaccgtataccgaaggtccaacggttccctacggacctaacgtccgtacgtacgttcggttaatttttcggacctttaaacgtttactttaaccgttacggtaaccctaaaaccgtaggttaaacccaaggtaacggttacgtaacggttttagggtacgttaaccggttccgggaaccgtaaacgggggtacccgtagggggttaacggaacgggtaaacggtaaacggtaaccgtgggttacggngttacggaccctaaccgtacttcggtaccgtttacg

SEQ ID NO: 116097 - DNA, 884 bp, Homo sapiens
  misc_feature: GYAE6OF02GA3OE.42.58.F03.1.454.CMB.1.raw
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatcgacccagtcctccttccaccctgtctgcatctgttggagacacagtcatctatctacttacggccgggccagtacgagtaggttggttgggaggtcgttgggttcgggtccgttagggtactaccgtaacgaaaccgtaaaaaccggaacgggaaacccgtacccctaaaacgtcctacggttaactttaccgaacggtacctaacgttacgtttaacgtttaagggaacggttacgtaccgtaccctaacgtaaccgtaagggtttaccaacgggtaccggaaccgtaaagttagggtaaggttttacggggaaacgtaacgttaaactttcccgtaaccttaccgtaacctacccgtaacgttaccgaacggtaccgaccgtccgtcggtaccctaacgtaccggtgttaaacggttagtttaacggttttccgaaaccgttttaaaccttttaacgttacccgttaacgtaaaccccggtaaaaccgttaaacggtaacgtaaacgggtaaccgggtttaacggttaacgggttttaggggttaacccggggtaaaccggggttttacccggggaaaacccgggaaacgggggttaccggggtaaacgggggtttaagggggaaaaccgggtaaaaccggtaaaaccggggtaaaccgttcgggggtacggttacccgttacgggacccgttaacccgtaggtttccgttacctttacccg

SEQ ID NO: 116098 - DNA, 670 bp, Homo sapiens
  misc_feature: GYAE6OF02FZRZ1.42.58.F03.1.454.CMB.1.raw
  modified_base (500)..(500): a, c, t, g, unknown or other
  misc_feature (500)..(500): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtcctccttccaccctgtctgcatctgttggagacacagtcatcatcacttggccggcagtcagtagtgtggaggctggtggcctggtatcagacaaaaccgagggaaacacccctaaactcctagtactttacgaagctattacttaactttagaacggtccgtacgtacccatacgtaaggttcgaggcggactaaagtaggtaagtttaggggaactaagtaatttccaacttctacccaccgacttacgacgacgaaccgtccgtagccgacgtaccctggaacttagttacttttagaccttaaacgtttattacctacgtaccctaaanaaggtaaactaaggtaacgttaggtaacgtttagggtcgtaaccgggtttccgaaccgggtaacggggaccgttaagggggtacggaaagggtaaaacgggtaaaccggtaaccggtcgggttagggtacctacggacccgtaacgtacggttaccgtacgtttaacccg

SEQ ID NO: 116099 - DNA, 547 bp, Homo sapiens
  misc_feature: GYAE6OF02FJ4PQ.42.58.F03.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
  modified_base (445)..(445): a, c, t, g, unknown or other
  misc_feature (445)..(445): n is a, c, g, or t
tcagtgacgtatgtcacgaccggtgctcgatttagtctgatcgagaagggaaaggggggagtcagacccagtcaggacacagcatggacatgacgggtccccgctcagctcctgggctcctgctgctctggctcccgaggtgccagatgtgacatccagatgacccagtctccttccaccctgtctgcatctgttggagacacagtcatcatcacttcgccggccagtcagagtgttgagntggtgcgtgtancgagacaaaaccgnggaaacncccctaaatccgtanactttacgaagcattactacgtttagaacgttcgacgtcccatacaaggttcaggcgtanaattagattcggacagtaacttcactccacaccatcancacgcctgcagcctgacgtgtatttcactaactttattacacgtaccaaagactaaanaagtacgtagtacttggtactaacggtcgaacgaagggtccgaaggtcggaaaggaaggaacgtacgtaggtcggactaggcctaacgtcttacgtagttcc

SEQ ID NO: 116100 - DNA, 695 bp, Homo sapiens
  misc_feature: GYAE6OF02G3DQ3.42.58.F03.1.454.CMB.1.raw
  modified_base (202)..(202): a, c, t, g, unknown or other
  misc_feature (202)..(202): n is a, c, g, or t
  modified_base (677)..(677): a, c, t, g, unknown or other
  misc_feature (677)..(677): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctccttccacccttgtctgcatcgtgttggacacncagtcatcactcacgttcggccgggctagtacagtaggttggttggaggtcgttgggttcggtccgttggtaattacgagaaaccgaaaaaccgacgggaaaacgtacccctaacgtcctaagtactttacgaaggactagtacttaacgttaggacgtcgactacccgtagtactaacggtcgaggaccgtactaacgtagtagtttacggaacgtaagtaactttaccaacgttacttaccgactactacgacgtacacgtaccgtagaccgtacgccgtagtacttgttatttaccggaacttaaccgttacgttactacgaacctaaacggaacgttaacgaagtaacgttaagtaagtttacggtaacggttacccggttacgaaccggtaacgggtaccggtaagggttaacgggaaggtaaccggtaaaacgacggtacggttcggaacgcggttaccaacccggttntttccggtaccttaccgg

SEQ ID NO: 116101 - DNA, 964 bp, Homo sapiens
  misc_feature: GYAE6OF02JOA44.42.58.F03.1.454.CMB.1.raw
  modified_base (141)..(141): a, c, t, g, unknown or other
  misc_feature (141)..(141): n is a, c, g, or t
  modified_base (145)..(145): a, c, t, g, unknown or other
  misc_feature (145)..(145): n is a, c, g, or t
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (572)..(572): a, c, t, g, unknown or other
  misc_feature (572)..(572): n is a, c, g, or t
tcagtgacgtatgtcacgaccggtgctcgatttagtctgatcgagaagggaaagggggagtcagaccagtcaggacacagcatggacatgagggtcccgctcagctcctggggctccgtgctgctgtcgcctccgaggtcncagntgtacgactactcagatccgacctacgttcctccttacccacccgtnttcgngacttctcggttggtacggaactaccaactgtactacttcaactccgtaacgtccgggacccgtacgtcgtacgaacggtttggttacgggttagggaccggttcggttttcgggggcccgttaccggtaaggttcaccgaagtaaaaacccggaaaaacggtacgggaaacccttaaccccgttaacttacgtattttaaccgttaacgtaacgactttactaaccggtttttataaaaggggtaaccgtcgttaacccccgttacgttagtaaccggtaaccggtttcgaccgggtaacccgtttaaagtaaacgttaacggggtttttacgggtaaaacgacgtttaaaaaccttaccggtttttaaacccnccgggtttaaccctaaaacctacgttaaaggtaaccgtaactaacccgggtaacgtaccgttaccgaaaccggttccgaaccgtttagtaaccgttagtttacgttaaccgtaaccttttaaaccgttacttaacccgtttaccgtaaacaacggtttaaacgtaaccggtaaacgtaacgttaaacgggttagtttaccgggtaaccgggtttttaacccggaacccggttaaaccgggggtacccggggtaagggaacccggggggtttaaagaaacccgggggtaaaacgtttaaaccgggggtaccggttaaacggggttaccgggtttaaccggtaaccggtacccggttaaccgttaacggttacccccgtttaggttaaccccgg

SEQ ID NO: 116102 - DNA, 947 bp, Homo sapiens
  misc_feature: GYAE6OF02IPC3F.42.58.F03.1.454.CMB.1.raw
tcagtgacgtatgtcacgaccggtgctcgatttagtctgatcgagaaggggaaagggggagtcagacccagtcaggacacagcatggacatgagggtccccgctcagctcctggggctcctgctgctcgtggctcccgaggtgccagatgtgacatacagactcgaccctagtccttcccttccacccttgtctacgctacgttcgttggttacgggaacgaccaccgtacgtactacttaccacttaccgtacggttccgggaccccgggtaccgtaacggttaccgtaacgggttagggtttcggggtttacggggaaccgggttcggttttacgggggtttaccgggtccccggtttagggtaacgttaccgaaaacggtaaaaaccccggtaaaaaaccgggaccggggtaaaaccccgtaacccccttaaaacgttccgttaagtttaaccgttttacgaaacggtctaacgtttacgttaacggtttaacgggtaaacggttccgtacgtacccgtaagttaccggtaaggttccgaacgtacggtaacgttaaagttacggttaacggttaacggaaactaacttaacgttaaccctacttaccgaaccacgttacgacgacgtacctacggtcctacggtaccgtacgtaccgttagtaaccggtttagtttaaccgttaacgttaaaccttacggttttaacgttacctaacggtaaaccctaaacggttacgttaaacgggtaaggttaacgtttaacgggtacgtttcgggtaaccggttacgggtaacccgggttaaaccggaaggggttacggaaacgggggttaggaaaaccggggttaaacggtaaaccgggttaacgggttcggtaaccggttacccgtaccgggtaaaaccctttcccgggtaagtttttaccccgtcgggttttaaccc

SEQ ID NO: 116103 - DNA, 1012 bp, Homo sapiens
  misc_feature: GYAE6OF02IK2YT.42.58.F03.1.454.CMB.1.raw
tcagtgacgtatgtcacgaccggtgctcgatttagtctgatcgagaaggggaaagggggagtcagacccagtcaggacacagcataggacatggacgggtccccgctcagctccgtgggcctcctgctgctctggctcccaggtcgccagatgtgactatccagaatcgaacccctagtccttcccttacctacctggtctgcgtattcgtggttacggaacgtactacgatacactaccattccgtacgttccggcccggtacctaaggtacaaggtaggttcggttacgggaggtccggtttggggttaccgtaccggttagtacgttaaccgaacggtaaaccgaaaaaacgggtaccggaaaacccgtaaccccttaaaccgtcccgttaaaggttacgtttaacggtaaacgaccgtttaaactttaccccggtttaaaagttttaaacgggtaaaccgggtttaccggtaaaacccgtttaccccggtaaattaaccgggtaaaaccggtttccggaacggttaacccgggtaaataaaaccggtttaggttaaaccggttttagggaaaccgttaaacggtttaaccttacggtaaccccttacccgaacttaaccccgtaaacggttaacctaacggtaaccccgtaacggtaccccgttaaggaccgtaaccgggttacccgttaagtttaagtttaccgtttaaacgttttaccggttaaacctttaaaccgttttaacgtttacccgtaaaccggtaaacccgaaacggttaacggttaaacgtaaacggttcgggtaaacgtttaaacgggtttacgggtaaacggtttaacccgggttaacccgggaaccgggaaacggggttacccggttaaagggggttaaccggaaacggttaaaaacccgggggtaaagtaacccggttaaggggttaaccggtacggttaaccccggtaacggttaaccccttttaaacgggttccttaacccgggtttaaccc

SEQ ID NO: 116104 - DNA, 863 bp, Homo sapiens
  misc_feature: GYAE6OF02I6T0R.42.58.F03.1.454.CMB.1.raw
  modified_base (143)..(143): a, c, t, g, unknown or other
  misc_feature (143)..(143): n is a, c, g, or t
tcagtgacgtatgtcacgaccggtgctcgatttagtctgatcgaggaagggaaagggggagtcagacccagtcaggacacagcatggacatgagggtccccgctcagctccgtggggcctctgctgctctgctcccaggtacnccagtatgtagactataccagagtccgtacccgagttccttcccttaccctacctgtctcgctattccgttaggtagacgtacacgtacgtacactacgactctacgttcggacccggtacctagtacctaggttaggtttacggacgtcgttaggttcgtccgtaggttacacgaactaaaccgaaaacggtaccggtaaacctaccccttaaacgtaccgtagttacgttaacgtaacggacgttacttaccgttacgttacgttaaccgttaccgtacgaccttagtacctaacggttccagtaccggtataagtaggttacgtacggtaacaacgttatttccgtaactacctaaccgttaccgcgtaaccgacgtacgacgtacccctacggtacctagtacccgttggaacgtttcgtaacggttttacaaccggtttaaactttaccgttaccgtacgaaaccggtttaaaccaaacggttaaacgtcggttaacgttaacgttaaggtttacccggtaacgggtttacccgttaaccgggaaaccgggttaaccgggttaaacggggttacggggttaaccggtaaaacgggttaacccggggtaaaaaccgttaccgggggtttaacggaacggtttaacccgggtaccgttaaaccggttaacccccggttaatttaaccccggggtttaccgttccttttaaaaccccg

SEQ ID NO: 116105 - DNA, 867 bp, Homo sapiens
  misc_feature: GYAE6OF02GMMLR.42.58.F03.1.454.CMB.1.raw
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
tcagtgacgtatgtcacgaccggtgctcgatttagtctgatcgagaagggaaagggggagtcagacccagtcaggacacagcatggacatgagggtccccgctcagctcctggggctcctgctgctctggctcccaggtgccagatgtgacatccagatgacccagtctcccttccaccctgtctncatctgtganacacagtcatcatcacgttcgccggcagtccgagtaggttgttggaggtcgtggttggccgtggtactcgaacgaacaaaaaccgaagggaaaccacccctaaacttcctagtaactttacgtaacggtctaacgtttaccttaacgtttaacggtaacggtaccggtaacggtaccccctaagttaccgtaaagggttacgaacgggtccggtaaactaaaggttaaggtttaacggtttaggggaaacgtaaacggttaaacttaccgtaacccttccctaaccctaacccgtaacgttaccgaacggtacgaaacggtccctacggacccgtaccgtaccgttagtacgtttacgttaacgtttttacggaaccttttaaaccgttttaacgttttaacccgtaaccgttaacccctaaaacggttaaaccggttaaaaccggttaaacgtaaacgggtttaaacggttaaagggtttaacgggttaccggggttaaacccgggtttacccgggaaacccgggtaaacgggggtaccgggttaaagggggttaaccgggggaaaaggttaaaacccggggaaaacggttaaaccggttcggggttaacgggtccgttaacgggacccccgttaaacggtaccttttacccggtttacgtttaaccccg

SEQ ID NO: 116106 - DNA, 154 bp, Homo sapiens
  misc_feature: GYAE6OF01CVGZ9.29.77.G11.1.454.CMB.1.raw
  modified_base (154)..(154): a, c, t, g, unknown or other
  misc_feature (154)..(154): n is a, c, g, or t
tcagatagagtactcacgaccggtgctcgatttagctagtcactcaagggaaagggaccaaggtggaagtcaaaggaactgtggctgcaccatctgtcttcatcttcccaccctcctcatagcgtactctgagcgggctggcaaggcgcatagn

SEQ ID NO: 116107 - DNA, 153 bp, Homo sapiens
  misc_feature: GYAE6OF02HWMGL.29.77.G11.1.454.CMB.1.raw
tcagatagagtactcacgaccggtgctcgatttagctagtcactcaagggaaagggaccaaggtggaagtcaaaggaactgtggctgcaccatctgtcttcatcttcccgccctcctcatagcgtactctgagcgggctggcaaggcgcatag

SEQ ID NO: 116108 - DNA, 154 bp, Homo sapiens
  misc_feature: GYAE6OF02G6SH4.29.77.G11.1.454.CMB.1.raw
  modified_base (154)..(154): a, c, t, g, unknown or other
  misc_feature (154)..(154): n is a, c, g, or t
tcagatagagtactcacgaccggtgctcgatttagctagtcactcaagggaaagggaccaaggtggaagtcaaaggaactgtggctgcaccatctgtcttcatcttcccgccctcctcatagcgtactctgagcgggctggcaaggcgcatagn

SEQ ID NO: 116109 - DNA, 585 bp, Homo sapiens
  misc_feature: GYAE6OF02F2A0L.29.77.G11.1.454.CMB.1.raw
  modified_base (325)..(325): a, c, t, g, unknown or other
  misc_feature (325)..(325): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (488)..(488): a, c, t, g, unknown or other
  misc_feature (488)..(488): n is a, c, g, or t
tcagatagagtactcacgaccggtgctcgatttagctagtcactcaaggggaaagggggggagaggagcccagcactagaagtcggcggtgtttccattcggtgatcagcactgaacacagaggactcaccatgggagtttgggctgagcttgggtttttcctcgttgcttcttttaaggaggtgtccagtgtcaggtgcagctgggtgagtcgtgggggagcgtggtccagccgtgggacgtccctgacgtactctctgtacgcacgcctgtaggactttccacctttcgagttcgtactatgactatgctaccgtgggtcccncgacggcctccgagggacgaaggggtctgggaggttgggtgactagttatatacatagtgacgtaggaagtatatactatagtgactagaccgtcgagacggctactcactctacgagtacactactacgaanacacgtntattagtacaactaagtagaacngtacgtcgaagacgtgacgagaccgtaggtcgtagtacgttacgtttgacgtacggtacttaacgttaactcggaacggtaccggtaaccgtaccgg

SEQ ID NO: 116110 - DNA, 537 bp, Homo sapiens
  misc_feature: GYAE6OF01DEF95.47.81.H04.1.454.CMB.1.raw
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagataccactggagaaatagagatgacgcagtctccagccaccctgtctgtgtctccgaggggaaanagccaccctctcctgcagggccagtcagagtatagcagcaacttagcctggtaccagcaagaaacctgggcaggctcccaggcctcctnatctagtggtgcactcccaccgacgggccacgtggtactcccagccaggttcagtggcaggtggtctgggacnggtagttcactctcaccatcagcagcctgcagtctagaagtnttttgacttaatttattactgtacagtactaagttataatactggcctcgtcttccggaccgtaacggacgtaccgagtaggacgtaagttaaaccgacgtggtacggacttacgcctacgtacg

SEQ ID NO: 116111 - DNA, 555 bp, Homo sapiens
  misc_feature: GYAE6OF01BLPBC.47.81.H04.1.454.CMB.1.raw
  modified_base (209)..(209): a, c, t, g, unknown or other
  misc_feature (209)..(209): n is a, c, g, or t
tcagagctcacgtacacgaccggtgctcgatttagtagtgtagattcgcgggggctctggagaagagctgctcagttaggacccagagggaaccatggaagccccagctcagcttctcttcctcctgctactctggctcccagattccaccggagacattgttttgacacagtctccagccaccctgtctttgtctccgaaggggaaanagcccaccctctcctgcagggccagtcagagtgttggcagctacttagcctaggtaccaacagaaacctggaccaggcctaccgaggctcctcatctatgatgcatccaacgagggccaacgtggcactcccagccaggttcagtgcagtgagtcgtgggacagtacttcactctacaccatcagcacgcctagacgcctagaagtattttcgacttacttttatactgtacagctagtcgtagactaactcggacctctacgtacgtttccgggacgggtacgggaccgtaggggtcggaacgagtaacggaaacggtacgttaggtaggtactcggcgtaaccg

SEQ ID NO: 116112 - DNA, 519 bp, Homo sapiens
  misc_feature: GYAE6OF01DKPC8.47.81.H04.1.454.CMB.1.raw
  modified_base (313)..(313): a, c, t, g, unknown or other
  misc_feature (313)..(313): n is a, c, g, or t
tcagagctcacgtacacgaccggtgctcgatttagtagtgtagattcgcgggggctctggagaagagctgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaanagggccacgtggcatcccagccaggttcagtggcagtgagtctgggacagacttcactctacaccatcagcagcctagacgcctagaagtattttgactacttttattactgtcagcagcgtagcaactcggctctctacgttcggcggacgggaccgtaggggtggacagtacgaaacggtacgtaggtaggcctggcctaaccg

SEQ ID NO: 116113 - DNA, 638 bp, Homo sapiens
  misc_feature: GYAE6OF01CFNDX.47.81.H04.1.454.CMB.1.raw
  modified_base (205)..(205): a, c, t, g, unknown or other
  misc_feature (205)..(205): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggcaccctgtctttgctccaggggaanagccaccgtctcctgcagggccagtcagagtgttggcagcaactactagcctggtaccagcagaaatcgtggccaggcctccgaggctcctcatctatgatgcgtaccaccagggcccacgtcggtttcccagccaggttcaggtggcaggtgcgtcgtgggactaggacgtttcactcctacaccgatccaacacgccctgactagtcctagtaagttattttacgactaacctttactaacttacgtacaaacgtacgttaacggttaacccgggtaaccccgttaacgttaccgttttacgggacccgtaacggggtaacccaaacgttaccgggaacctaacgttaacccgtaaaacggtaaccggttacgtacgggtacccgttacggtaacccaacccgtaccttaccttcggttccctttaacccg

SEQ ID NO: 116114 - DNA, 758 bp, Homo sapiens
  misc_feature: GYAE6OF01DX5HT.47.81.H04.1.454.CMB.1.raw
  modified_base (212)..(212): a, c, t, g, unknown or other
  misc_feature (212)..(212): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggcctcccagatatcgccggaagaaattgtgttgacgcagtctccaggcaccctgtctttgtcctccgaggggaaagngccaccgtctcctgcgaggccagtcagagtgtggcagacaactacttagcctaggtaaccaagaacgaaaccgtggaccaggcctacccgaggcctcctacatcgtaggatgccaactaccgaacgacgggccgacgtcggaccactccccgaggccctaagggttccaagggtcggacgtagggtcggggtacgtaggggaactacggtaacctttccgaaccttccgtaccaacccgtaacttaccgaacggtaccaacggtaccccgttaaacggaaccggttacccgttaagggtaaacgttttaacgttttttacggaacccgttttaaagtttttaaccgtttaacggttacgttaaccgtaaacggttaaccgtaaaaccgttaaacggttaccgttacccgggtacccccttacgtacccgttaccggttaccgtttaccgggggaccgggtaacggggtaccgtaacggggtacggaacgtaggtaacggtaaaccgtacgttcggtacggacttacggaccctacgtacgttaccg

SEQ ID NO: 116115 - DNA, 508 bp, Homo sapiens
  misc_feature: GYAE6OF01AR0HV.47.81.H04.1.454.CMB.1.raw
  modified_base (396)..(396): a, c, t, g, unknown or other
  misc_feature (396)..(396): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggcaccctgtctttgtctccaggggaaagagccaccgtctcctgcagggccagtcagagtgttggcagcaactacttagccctggtaccagcagaaatctggccaggctcccaggctcctcatttatggtacatacaacagggccactggcactcccagacagattcagcggcagtgagtctgggacagacttcactctcaccatcagcagactggancctgaagtatttgcagtatactactgtcagcagtatgttggacacagtcgacgttcggaccgaagggaccgaggggtgaaacgtacgaagacggaactgtcggcgtgtaccg

SEQ ID NO: 116116 - DNA, 590 bp, Homo sapiens
  misc_feature: GYAE6OF01CPH9N.47.81.H04.1.454.CMB.1.raw
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
  modified_base (381)..(381): a, c, t, g, unknown or other
  misc_feature (381)..(381): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttgggctgagcggtggtttcgtcgtaggcgtactaattagagtgcagtgtgagtgcagntggtggnggtcgggggagcctggacagccgtgggggtcctggagtactctccgngtgctgcctgtggcttcatcttagagtagttgngngtcgctcgtcggtcncacgcacgagggagngtgtggtgtcgtacgtacgtattactctgtagtagtacgcgacaacaacgtacgacgtacgcgngacgacgtactacacactactacgacgacgacaacgaacgaacgaacgacgactacgtactcgtacgaactaacgtacgacgacgtacgtacgtagacgacgaacgtacgtacgtacggtaccggtcgttacgttacgttacgtttgtaggtacgtaacgtaagtaacgtacgttaacgtaacggttacggttacggttaccgttaacg

SEQ ID NO: 116117 - DNA, 771 bp, Homo sapiens
  misc_feature: GYAE6OF01DBIAS.47.81.H04.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggccaccctgtctttgctccgaggggaangccaccgtctccngcnggccagtcagagtgtcganagacaactacttacgccgtacggtaccagacaagtaactcgtacggccgaacggtcctacccgacggtccttacctacttactttagtacggtaactaacgtaaaccgaacggacgggtaccctaacggttcgggacctaaccgtacccgaacggtaaacctaacggttaactttaccggaacgggaccgggtaacgtacggggttaaggtaaccgggtttacgggtacggggaaactaaccgggttaccgttacctaacccgttaccttaacccgaaccctaaccgttaccggtaaacgacccgtaaacggtaacgtacgggtaaaccggtacccgttaagggtaaacgtttcgttttaacggaacttaacgttaactttaaccgtaacgttcgttaaccgagtacgttaaggttacgttcggtaacggacctaagtaccggtacggtaccggtacggaccggtaacggtacggtaacgggtacgaaacgtaccggaaagtccggtaataggtcggtacgcgtaaccg

SEQ ID NO: 116118 - DNA, 464 bp, Homo sapiens
  misc_feature: GYAE6OF01BOZWX.47.81.H04.1.454.CMB.1.raw
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (387)..(387): a, c, t, g, unknown or other
  misc_feature (387)..(387): n is a, c, g, or t
  modified_base (456)..(456): a, c, t, g, unknown or other
  misc_feature (456)..(456): n is a, c, g, or t
  modified_base (458)..(464): a, c, t, g, unknown or other
  misc_feature (458)..(464): n is a, c, g, or t
tcagagctcacgtacacgaccggtgctcgatttagtagtgtagattcgcggggagctctgggagtggagccccagccttgggattcccaagagtttgtattcagtgatcaggactgcacacagagagctcaccatggagtctgggctgagctgggttttccttgttgctcttttaaaaggtgtccagtgtgaggtgcaggtagtggaggtccgggggaggcttagttcagcctgggggagtccctgagactctcctgtgtagtctctggaatcagtttcagtaccttctggatgcactgggtccgccaaactccagcctccaccaacgggcccatccggtcttcccccnggccgccctgcctccacggngcaccctccgagagcacncgcggcctgggctgcctggtcaaggctacttcctacgtgagctctgagcgggctggcaaggcgcatagnannnnnnn

SEQ ID NO: 116119 - DNA, 549 bp, Homo sapiens
  misc_feature: GYAE6OF01D4X7F.47.81.H04.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacacagtctccagccaccctgtcttgctccaggggaangccacctctcctgcagggccagtcagaatatcactcctacttagcctggtaccaacagaaacctggtcaggctcccaggctctcatctatgatgcatccaacgngggccacgtggccatcccagacaggttcaggtggcaggtgggtctggggacaggtacttcactctacaccatccagcagcctagacgctagaatcgtttaggtactttattactgtacagcaggcgtagacgttcgtacggtccttccgctcgtaacgtttcgggacggacgggaccgtaggggtcggaagtacgtaacgaaaccgtaacgttggtcgggactggacctaccgtgttcccg

SEQ ID NO: 116120 - DNA, 836 bp, Homo sapiens
  misc_feature: GYAE6OF01DOHP3.47.81.H04.1.454.CMB.1.raw
  modified_base (210)..(210): a, c, t, g, unknown or other
  misc_feature (210)..(210): n is a, c, g, or t
tcagagctcacgtacacgaccggtgctcgatttagtagtgtagattcgcgggggctctggagaagagctgctcagttaggacccagagggaaccatggaagccccagctcagcttctcttcctcctgctactctggctcccagataccatcggagaagttgtgttgacacagtctccagcccaccctgtctttgtctccgaaggggaaanacgccaccctctcctgcagggccagtacagaatattcactcctacttagcctaggtaaccaacacgaaacctggtacacggcctacccgaggtctcctcatctatgatcgacatcccaaacgacgggccaacgtcggccaactcccgaaggaacctaggggtttccaagggttcgggactaaggggtttcgggggtaccgttaggggggaaacctaacgggtacccttttaccgaacccttttcccgtaacccgaaccccgtaatttaccggaacgggtacctaacgggaccccgttaaagggaaccggttaccccgttaagggtaaaacggtttacccggttttttaacggggttaaacctttttttaaacgtttaaccggttacgggtttaacccaaggtaacccgtaacgggttaccggttacgggttaacgggtttttcccgaccggggttacccccttcccgggtacctttaccccggttaaccgggtttttccggggggacccggggtaaacgggggtaccccgggtaaggggggttacgggaaacggttaaacgtaccggtaaaaaaccggtaaccggtgggtttacgggaccgtttacggaccgtaacccgttaacgg

SEQ ID NO: 116121 - DNA, 676 bp, Homo sapiens
  misc_feature: GYAE6OF01DC9F0.47.81.H04.1.454.CMB.1.raw
tcagagctcacgtacacgaccggtgctcgatttagtagtgtagattcgcgggggctctggagaagagctgctcagttaggacccagaggaaccatggaaaccccagcgcagcttctcttcctcctgctactctggctcccagatatcgccggagaaattgtgttgacgcagtctctaggcaccctgttcttgctccgaaggggaaagagccaccgtctcctgcgagggccagtcagtagtgttggcagctactagcctaggtaaccaagacgaaaccgtggaccacgggcctacccgacggaccttccctcaactctacttggacttcgaccaacgttaccaaaacggacgggacctacgtcggacactcccgaagacgtacggttcgaacggtgtaccgaggtgtacggtcgtagggacctagtaccgttcaccgttctaccacctagtaccgagtcacgtaaccctagaccgtacttaagaagtttacttcgtaactttactttaacttagtacgtacgtagtacgtacgtacgttacgaccgttaacttccggtacccttacgtaccgttaaccgggtccgggtaaccggggtacggtaaaccgggtagggtacggtaacgtaccgtacggtaaacggtaccggtaaagtgggtaccggcgttacggaacccg

SEQ ID NO: 116122 - DNA, 615 bp, Homo sapiens
  misc_feature: GYAE6OF01APWML.47.81.H04.1.454.CMB.1.raw
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
tcagagctcacgtacacgaccggtgctcgatttagtagtgtagattcgcgggggctctggagaagagctgctcagttaggacccagagggaaccatgggaaaccccaggcgcagcttctcttcctcctgctactctggctcccagagtatcgccggagaaattgtcgttgacgcagtctccaggcaccctgtctttgtctccaggggaaagagccaccgtctcctgcagggccagtcacggagtgttggctaggctaactacttagcctggtaccagcagaatctggccaggctccaggctctcatttanggtacatacgaaacgcgggaccacggtggctactcccgagtacagattccagtcggcaggtanacgtctggaccagaccttcactctcacctacgtcacgcaaggaccgtaggacgaccgtagtaagtagttttagacgtaagttactaacttacgttagtacgacgtactaggttacgttaggttacgggtacgtacggtacggtacgggtaaccggttacgggtacccggtaacggggtacccgtaaggggttacggaaacgtaccgaacggtaacggacgtaggtcggtccgtcggtacccg

SEQ ID NO: 116123 - DNA, 552 bp, Homo sapiens
  misc_feature: GYAE6OF01EQ8W8.47.81.H04.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
  modified_base (407)..(407): a, c, t, g, unknown or other
  misc_feature (407)..(407): n is a, c, g, or t
  modified_base (435)..(435): a, c, t, g, unknown or other
  misc_feature (435)..(435): n is a, c, g, or t
tcagagctcacgtacacgaccggtgctcgatttagtagtgtagattcgcgggggctctggagaagagctgctcagttaggacccagagggaaccatggaaacccccagcgcagcttctcttcctcctgctactctggctcccagatatcgccggagaaattgtgttgacgcagtctccaggcaccctgtctttgctccaggggaangccaccgtcncctgcaggccagtcagagtgttggccagcaactacttagcctggtaccagcagaaatctgccagctcccaggctccnctatttanggtacatacaacagggccactggcatcccagacagattcagcgacagtgagtcngggacagacttcactctaccacctatcagcagacgtggacgcctaggaaatnttttgactaagttatacctaactcgtanagcctagttagtgttagggacctacgtagtccgggtacgttaccgggaccgtaaacggggtaccgaggggtacggaaactcgaaacggacggtaacgtacggtggtccgtgaacccg

SEQ ID NO: 116124 - DNA, 859 bp, Homo sapiens
  misc_feature: GYAE6OF01D5HOR.47.81.H04.1.454.CMB.1.raw
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacacagtctccagccaccctgtctttgtctccaaggggaaagacgcccaccctctcctgcagggccagtcagaatattcactcctactagcctggtaccaacacgaaacctggtcaggcctcccaggctcctcatctatgatgcactaccaacgacgggccacgtcggacactcccagtaccgtaggtttacgaggtcggacgtagggttcgggtaccgttaggggaacctaacggtacccttttaccaacctttccgtacccaacccgtaagttaccgaacggtacccacggttaccccgtaaaggtacggtacccgtaagggtaaaacggtttaccgttttttaacggggttaaacccttttttaagtttaaaccccgtttcgggtttaacccgtaaggggttacccgtaaacggggtttccggtttaacgggtttaaaccggttttaccgggttaacccggggtttccccccttacccggtttacccgttacccggttttaacccgggtttttaccccgggggaaccgggggggtaaaccgggggtaaccccgggttaagggggggttaaccggggtaaaaccgggtaaacggtttaaaacccccgggaaaaaaaccgggttaacccgggttacggggtttacgggtaacccggtttggtaaacccgtttacgtaccggtttaaacccgg

SEQ ID NO: 116125 - DNA, 846 bp, Homo sapiens
  misc_feature: GYAE6OF01AL80P.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggaggtcggggggagcctggtacagccgtggggggtccctgagactctcctgtgcagcctctggattcatcttcagtgactacgacatgcacgtcgggtcccgaccgtaaggttcgacgagggaacgtaacccgttcgtagggaaacgttcggggttccttacccggtttaagtttcggaccgtttaaccggttgggggttacggttccggaccccgtaaaccgtaacggtaacccgtttaaaggtccggtaccggtaacggggtccccgtttacccggggtacggggtaaccggggggtaccccgttaacgttttaccccgaaccccgttaacgttaccccgttacccgaaagggtaaaacggtaaaaacgttccggggaaccgtaaaaacgggttaaccctttacccgttttaacggttaacgtttacctttaaacccgaaaagtttcggaaaacctacggtaccccgttaagggaacggaaccggggtacccgggggaaccgtaaccggggtaccgggttacgttaaacgttaaccggttagggttaacggtaaaggacggtaacggtaccgttaacggtaacggttaacgggttaaaccgggtaacggggttaaactttaaaggttcggttttaacgg

SEQ ID NO: 116126 - DNA, 539 bp, Homo sapiens
  misc_feature: GYAE6OF01BU8XF.47.81.H04.1.454.CMB.1.raw
  modified_base (207)..(207): a, c, t, g, unknown or other
  misc_feature (207)..(207): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagataccatcggagaagttgtgttgacacagtctccagccaccctgtctttgctccgaggggaaangcccaccctctcctgcagggccagtcagaatattcactcctacttagcctggtaccaacagaaacctggtcaggctcccaggcctcctcatctatgatgcactaccaacgagggcccacgtcggcactcccagactaggttcagtggcaggtgggtctgggacagtacttcactctcaccatcagcagcctagacgcctagaagtgtttgactagttttacttactgtacagtactaaacgttaaactacgtcggtcccttccgctcgtacgttcgggcgggacggaccgagggtgactagaggaaacgacgtggngctgacacngtcgtcg

SEQ ID NO: 116127 - DNA, 537 bp, Homo sapiens
  misc_feature: GYAE6OF01E1B6R.47.81.H04.1.454.CMB.1.raw
  modified_base (209)..(209): a, c, t, g, unknown or other
  misc_feature (209)..(209): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (530)..(530): a, c, t, g, unknown or other
  misc_feature (530)..(530): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggcaccctgtctttgtctccgaggggaaagngccaccgtctcctgcagggccagtcagaatattcactcctacttagcctggtaccaacagaaacctggtcaggctcccaggctcctcatctgggatgcatccaacngggccnctggcatcccagacagttcagtggcagtggtcgtgggacagacttcactctccacatcagcagcctagagtcctagtaacgtactttagtactttattactgtcagcagtcgtgtagttcgtcggtcctccgtctccgtacgtttcggcgggtacgggaccgtagggtacggacgtatacgaaacgtacgtgtacggtctcgacacctntcgtccg

SEQ ID NO: 116128 - DNA, 843 bp, Homo sapiens
  misc_feature: GYAE6OF01D02N8.47.81.H04.1.454.CMB.1.raw
  modified_base (206)..(206): a, c, t, g, unknown or other
  misc_feature (206)..(206): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggcctcccagatatcgccggataaattgtgttgacgcagtctctaggcacctgtctttgtctcgaggggaanacgccaccgtctccgtgcgacgggccagtcaagaattacttcaccttaccttacttacgccttacggtaacccaaacgaacggtaaaaccctggtaccgaacggtccctacccgaggtcccttaccctactacgttcttaagtcgtatccgactaacctacccgaaaccggacgggaccctacggtcggacctaccgtacccgaaggtaccgtagggtttaccgaagggttcggaccgtagggttcgggtacggttacggggaacctaaccgggttaccctttactacccgttactaacccaaccgttacgtccgaaacggtcctaaccggtacccgttaaacggaaccgttacccgtagggttaaaaccgtttccggttttaaccgggtttaaccttttttaacgttaccggttaccggttacgaacgggttacccgtaaggggtttcccggttaacggttaccggtttcccgtacccggtttccccgttacccggttcgtttacccggttaacggggttcccggggaaccggggtaccgggtaaaccggtaggggttacggaaacgttaaccgttaaacccggtaaaccgttcgggtaggttaccgggctttaacgccctaacgttgttaccccg

SEQ ID NO: 116129 - DNA, 722 bp, Homo sapiens
  misc_feature: GYAE6OF01B7IY2.47.81.H04.1.454.CMB.1.raw
  modified_base (261)..(261): a, c, t, g, unknown or other
  misc_feature (261)..(261): n is a, c, g, or t
  modified_base (314)..(314): a, c, t, g, unknown or other
  misc_feature (314)..(314): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctggttttccttgttgctatattagaaggtgtccagtgtgaggtgcagctgggtggagggtcggggggaggcctggtacagccggtggggggtccctgacgactctcctgngcagcctcgtggacttcattcttcagtcgactacgacatgcacgtcgggtccnctaagtgacaggacaacctcgtaggagtggtactcgttattgactacgtgggtcgtcgaccacgagtactagcgtacacggccgtcggtcgggacggggcctacgtttaccacccgtatcccgtaccgaaggaacgtaaactgggaacctaaagttaacccttccgttagtttaaccgttactttaaccgaaagtacgtaaaccgtcggaaccttacgggaagggtaacccggggaccccgggggtaacggtaaaccgggttcggggttaagtttaaccggtttaacggttagggttaaaggttaaacgggtaaggtaaccggttaccggtaacgggttaaacggtttaccgggggtaaaacgggtacgggggtttaaaccttttaaaggtccgggtttttaaaccgg

SEQ ID NO: 116130 - DNA, 669 bp, Homo sapiens
  misc_feature: GYAE6OF01A380L.47.81.H04.1.454.CMB.1.raw
  modified_base (154)..(154): a, c, t, g, unknown or other
  misc_feature (154)..(154): n is a, c, g, or t
  modified_base (210)..(210): a, c, t, g, unknown or other
  misc_feature (210)..(210): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctccagatatcgcggaanaattgtgttgacgcagtcctccaggccaccctgttctttgtcctccgaaggggaanacgccaccgtctcctgcgacgggccagtcaggtagtgtggcagacaacttactacgccgtaggtaccagacaagaactcgtcggaccgacggtcctaccgacggtcctacctctaagtttagtacggtaccaactaaccgaacgcgggtaccacgtacggaccacgtacccaagtaacagtactcgacggcggacgagtgtacggtcgtagggaactaggtaccttcacttaccacctaccactacgagtacacgtacggtaggacctccggtaagtattacgtttacgactacgttaactacgtttacgcgttaacgtcgaacgttaggttacgttagggttacgaactccggtaacggttaccgggtaccgtaccgggaaccggtaacggggaccggtaagggtacggaaactaccggaacgtacggtaaccggttagggtacgtcgtcgtaacccg

SEQ ID NO: 116131 - DNA, 671 bp, Homo sapiens
  misc_feature: GYAE6OF01BT2NV.47.81.H04.1.454.CMB.1.raw
  modified_base (535)..(535): a, c, t, g, unknown or other
  misc_feature (535)..(535): n is a, c, g, or t
tcagagctcacgtacacgaccggtgctcgatttagtagtgtagattcgcgggggctctggagaagagctgctcagttaggacccagagggaaccataggaaaccccagcgcagcttcctcttcctcctgctactctggcctccagatatcgccggagaattgtgttgacgcagtctccaggcaccctgtcttgctccgagggaagacgccaccgtctccgtgcgaggccagtacagtagtgttggcagacaacgtacttagccgtaggtaccagacaaagtaatccgtacggaccgtacggccgtaccccgacggtccttcccgtactacgttccggtaggggtactgaccgtactaccgaacgacgggtcccgcgtcgaccaccgtcccgaggtaccgtagggttccaggtcggcgtagggtcggtacgtcgggactaacggtaccttcactcctaccgactagtaccgaacgccaacgtaccgagtaccgtacgtaggtaacgtacgttttacgtaactttacttctgtacgngacgtagtacgtagttccgttcgtccgtccgtacgtaccgtcgttaccggtacgggaccgggtacgggtacggacgggggttacgaacggtacgtaaccggtaaacggtacgttacggtcgtacgtcggtaacccg

SEQ ID NO: 116132 - DNA, 798 bp, Homo sapiens
  misc_feature: GYAE6OF01CWXHH.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcacatggagttgggctgagtctgggttttccttgttgctatattagaaggtgtccagtgtgaggtgcagctggtggaggtcggggggagccgtggtacaggccgtgggggtccctgagctctccgtgtcgcacgcctcgtggtattcattcttcagtgactacgacagtcgacgtacgttcgggtacccaccgtaagttcggaccgaacggaacgtaacccttcgtaggtaacgttcgggttccgttaccgtttagttcggtaccgtagttggggtcggtcgacccagacgtacgttacgcgtacgaccggtccgtacgggtaccgggaacgggtacccgttactaccccgtaacgtacctacccgtaacgaaacggaaaacgtaaacggtaccgggaaaccgttaaacggtaaccctttaccggtttaactttaacgttaaccgttaaacgtaaaacgttaccgtaaaccgtacccgtaacggggtacggtaaccgggggaacggggtaaccccggggtaaccggacggggttacggtttaacggttaacgttaccgggttaagggtaaacgggtaaagggtacggtacgggttaccgtaacggggttaaaggtaaaccggggttaaaccgggttaaagggtttacgttaaggtttggttttaaccgg

SEQ ID NO: 116133 - DNA, 834 bp, Homo sapiens
  misc_feature: GYAE6OF01ECYL0.47.81.H04.1.454.CMB.1.raw
  modified_base (276)..(276): a, c, t, g, unknown or other
  misc_feature (276)..(276): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagcgtgggttttccttgttgctatattagaaggtgtccagtgtgaggtgcagcgtggtgggaggtcggggggaggccgtggtacaggccgtggggggtccctgacgactctcctgtgcagcctcgtgnttcatctcagtgactacgacatcgctacgtgggtaccgaccgtaaggtttcggacgaacgggaacgtaacccgtccgtaggggtaaacgttcggggttacccttttacccgtttaaggttcggtacgtttaaccgggttggggttacgggttaccgacccgtaacgaacggttacctaaggttcgaccgtaacgggtcccgttaccgggtagggtaccggggtacccgtacgtttaccgacccgttaacgttacccgtaaccgaaggtaaaacgtaaaacggttacgggaactaaaccggtaaacccgtttaccgtttacgtttaacgtttaacctttaacgaaaacgttaaccggtaaacgtaccggtacccggttaacggaaccgggtaacggggtaacccggggaaccgggtaaccggggttaccggggttacggttaaaccgtttaaccggtgggtttaaacgggtaacggtaacggtacgggtaccgtaccggtaaggtttaacggggtaaaccggtaacgggggttaaacttttaaggttcggttttaacgg

SEQ ID NO: 116134 - DNA, 778 bp, Homo sapiens
  misc_feature: GYAE6OF01BWGNL.47.81.H04.1.454.CMB.1.raw
tcagagctcacgtacacgaccggtgctcgatttagtagtgtagattcgcgggggctctggagaagagctgctcagttaggacccagagggaaccatcggaaaccccagcgcagcttctcttcctcctgctactctggctcccagatactcgccggaagtaaattggtgttgacgctagtctccgaggccacccttgttcctttgtcctaccggaaggggaaacgcgccctaccctctcctgcgacgggccagtcaagagtatagcagtacaacgttacgccgtaggtaccagaccaaggtaaacccgtggaccaaggcctacccgaggcccttaccgtctattccgtagtgtaacgtcgactacgtaacccgaacggcggaccacgtcgaccaccgtacccgaggtcccgtaaggttcgaacggttcgggacgtaacggtgtacgggttccgagggaacctaagtaccttccgacctacgtacctaccgtacacgtacgaccgacgtaccgtagaccgttcgtaaaggttacgttacttttaacggaccttttaacgtttttaacgtacgttacggtactaacggtaccgttaacgggtaccttaacggtaaacccctggttaaccgggttccccttacgttaacccggttaccggggttaaccgggggaccggttaaaaccgggggtacgttaacggggggcgtaaaaccgggtaacgttacccgggaaacggggttaaaccttaaccggggttgtaaccggggaccttaaaccggg

SEQ ID NO: 116135 - DNA, 753 bp, Homo sapiens
  misc_feature: GYAE6OF01DCFKD.47.81.H04.1.454.CMB.1.raw
  modified_base (246)..(246): a, c, t, g, unknown or other
  misc_feature (246)..(246): n is a, c, g, or t
  modified_base (314)..(314): a, c, t, g, unknown or other
  misc_feature (314)..(314): n is a, c, g, or t
tcagagctcacgtacacgaccggtgctcgatttagtagtgtagattcgcggggagctctgggagtggagccccagccttgggattcccaaagagtttgtattcagtgatcaggactgaacacacaggactcaccatggagttgggctgagctggttttctgttgctatatagaaggtgtccagtgtgaggtgcagcgtgggtggaggtcggggggagccgtgggtacaggtccgtggggggtcccnggaacgcttcctccgtgtcgcgagcccgttctggtaattctattccttcgagttcgaacctacgaacngtacgccgacgtcggggtcccgaccgtaaggttcgacgaggacgaaaccctttggtaggtaacgttccggggtttacccgttccgttttaacgttcggtaccgttaaccggttggggttaccggtacgtacccgtaacgtaacggtaccttagtcgaccgtcgggtccgttaccgggtcggggacggggtccgtaacgttcccaacgtacctcgtacgaagaaaacgtaagtacggaactaaacgtaccttacgtttagttaacgttacttaacgtaaacgtagaaacctaccggtaccgtaggacgggaccgggtacccgggtaccggaaccgggtacggttaggtaacgtttacggttaggtagtaaagggtacgtacggtaccgtaggtaaggttacgggtaaaggtacggggtttaaactaggtttgtttaacgg

SEQ ID NO: 116136 - DNA, 791 bp, Homo sapiens
  misc_feature: GYAE6OF01A9PJH.47.81.H04.1.454.CMB.1.raw
  modified_base (186)..(186): a, c, t, g, unknown or other
  misc_feature (186)..(186): n is a, c, g, or t
tcagagctcacgtacacgaccggtgctcgatttagtagtgtagattcgcggggagctctgggagtggagccccagccttgggattcccaagtagtttgtattcagtgatcaggactgaacacacaggacctcaccatggaggttgggctgagtcttgggttttccttgttgctatattagaaggtntcagtgtgaggtgcagtcgtgggtgggagggtcggggggaggtccgtggacgacggtccggttcggggggtccctggacgtaccttcctccgtggtcgccacgtccttacgtggtactttactaccttctttaccgaggttacgaaccgttaaccgtacctacgttcgccgtaccgggttccggggttacccgtaaccgtaacggttcgacggtaacgggtaaccgtaacctcggtagggtaacgttccgggtttaccgttaccggtttaagttcgtaccgtttaacggttcggggtacggtccgtaacccgaacgtaacgtaacttacgacggtaccggaccggtccgtaccgggtcgggaccgggtaccgtacttacccgacttacgttacccgaaccggaagtaaagaaacggtacgacgtaaacgtacctttccgttagttaccttactaacaaagtccaagaccgtgtaacgggacggtaccgggaacccgggtacgaaccgggtttggtaattaacgtacggttaggaaaccggtaaggaggtaacgtcgtaaggtacggtaacgggtaaggtacgggtaagtttacgtggtttaaccg

SEQ ID NO: 116137 - DNA, 652 bp, Homo sapiens
  misc_feature: GYAE6OF01EUBO2.47.81.H04.1.454.CMB.1.raw
  modified_base (517)..(517): a, c, t, g, unknown or other
  misc_feature (517)..(517): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatatagaaggtgtccagtgtgaggtgcagctgggtggaggtcgggggagccgtggtacaggtccgtggggggtccctgacgtactctcctgtgcgacgcctctggtacttccattccttcagtcgaactacgactattcggctacggtcgggtcccgcctaaggttcgcgaaggacgtaaccctcgtagggaagttcgggtcctaccgtttattcgacttacgtgggttcggcaccgacacgtactagtcgcgtagggtccgtccggagggacggggcctattccgactcgtcctacgagaagaaacgtcgaataacgtaacttcttagtacttctaagaatcgaacncggctaggacggacggaccgggacgcgggtacgttagttacttaccggtagtaaccgtaggtaaccgttaggtccggggtacggtacctttacggtacggtaacgttcccgggtaacgggacccgtaacccgggg

SEQ ID NO: 116138 - DNA, 842 bp, Homo sapiens
  misc_feature: GYAE6OF01B7XRO.47.81.H04.1.454.CMB.1.raw
  modified_base (201)..(201): a, c, t, g, unknown or other
  misc_feature (201)..(201): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggacctcaccagtggaggttgggctgagtcgttgggttttccttgttgcttatattagaagtgtccagtgtgaggtncagcgtggtggtaggtcgggggagccgtggaacgcggtccggtgggggtccctaggacgtaccgttcctccgtgtcggacgtacgccttcgtagtaacttctacttcgtcgtagtccgaactacgactagtcgtcgtaccggtcggtaccacgttaagttcgacgaacggtactaaccgttcgtaagggtacgtcggtaccgttcgtttacgcgtgtacgtcggttcgcacgtaacagtactagacgcggtacgtcgtacgggacgggaccggtaccctacgttacccgaacgttacccgtcgaaaccgttaaacggaaacgttaaaccggacgggtaaaaccgtaaccgttaaaccgtttcccgggtttaaattaccctttaaaccgggtaacttaaaacgggtaccctaaaacggttcccggtacgggttaacgggaaacccggggttccgggggaaaccccccgggtaggttaaacccgggggttacgttttaaccggttaaaacgtttaacgggggtttaaccggtaaaccgggaaaggttaaccggtttaaccccggagggttaaccccgggttaaagggtaacgggttaaaccggttaaagggttaaccccttttaggggttaaaccgtttacgg

SEQ ID NO: 116139 - DNA, 885 bp, Homo sapiens
  misc_feature: GYAE6OF01DOPT4.47.81.H04.1.454.CMB.1.raw
  modified_base (316)..(316): a, c, t, g, unknown or other
  misc_feature (316)..(316): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagcttgggttttccttgttgctatattagaaggtgtccagtgtgaggtgcagctgggtgggagggtcggggggaggccgtgggtaacacggccggtcggggggtccctggacgacttctcctgtgcagtccttgtggtattccaattcctttacagttgacctacganatcgactaccgtgggtccaccgtaaggttcgacgtaagggaactaacccgtcgttagggtaaacttcggggtaccttccgttattcggtaccgttaacggttcggggttcggtacgacccgacgtaacggtaacctagtcgccgaacgggttccgtacccgggtagggggaccgggggtaccctaacggttacccctaaccccgtacgttaccccgtacccgtaaaagggtaaaacgtaaaaccggtgggtaaacccggtaaaacgttaaaccccgttttaaccggttttaaggttttaaaccccgtttacttaaaccgtaaaacggttaccgtaaaaccggtaccggttaaccccgttaggggtaaccggaaacccgggggtaccccggggtaaccgggtaaccggggttaacccggggttaaggtttaaaccgtttaccgggtaagggtttaaaccgggtaaaagggaccgggttaacgtacccggttaaccggtaaacgggtttaacgggaaaacccggggttaacgggggttttaaacttaaacggttcgggtttttaaacccgg

SEQ ID NO: 116140 - DNA, 503 bp, Homo sapiens
  misc_feature: GYAE6OF02GNBKR.47.81.H04.1.454.CMB.1.raw
  modified_base (207)..(207): a, c, t, g, unknown or other
  misc_feature (207)..(207): n is a, c, g, or t
tcagagctcacgtacacgaccggtgctcgatttagtagtgtagattcgcgggggctctggagaagagctgctcagttaggacccagagggaaccatggaagccccagctcagcttctcttcctcctgctactctggctcccagataccatcggagaagttgtgttgacacagtctccagccaccctgtctttgtctccaggggaaanagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagtactttggacttttattactgtcagcagcgtgagttctggcctccgctcactttcggcggagggaccgaggggtggagatacgaaacgactggtggctgcaccta

SEQ ID NO: 116141 - DNA, 548 bp, Homo sapiens
  misc_feature: GYAE6OF02GMZ81.47.81.H04.1.454.CMB.1.raw
  modified_base (207)..(207): a, c, t, g, unknown or other
  misc_feature (207)..(207): n is a, c, g, or t
  modified_base (384)..(384): a, c, t, g, unknown or other
  misc_feature (384)..(384): n is a, c, g, or t
tcagagctcacgtacacgaccggtgctcgatttagtagtgtagattcgcgggggctctggagaagagctgctcagttaggacccagagggaaccatggaagccccagctcagcttctcttcctcctgctactctggctcccagagaccactggagaaatagtgatgacgcagtctccagccaccctgtctgtctctccaggggaaangccaccatctcctgtagggccgtcagagtattagcatcaacttagcctggtaccagcagagacctgggcaggctcccaggctcctcatctatgatgcgtccaccagggccactggtttcccagccaggttcagtggcagtgcgtcgtgggacagacgttcactctcaccatcaacancctgccagtctgaagtattttgctagtttattacttgtcagctagttatctaattaactcggccgtctcctacccgttccggacccgtaaacgggaaccaaccggaaccgttacgggaagtaacgttaaaaccgaaccgttggtacgggtcgtacggtaacccg

SEQ ID NO: 116142 - DNA, 512 bp, Homo sapiens
  misc_feature: GYAE6OF02F7MTI.47.81.H04.1.454.CMB.1.raw
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagagaccactggagaaatagtgatgacgcagtctccagccaccctgtctgtctctccaggggaaagagccaccatctcctgtagggccggtcagagtgttggcagctacttagcctggtaccaacagaaacctggccaggcctcccgaggctcctcatctatgatgcatccaacagggccactggcactcccagccaggttcaggtgcagtgagtctgggacagacttcactctcaccatcagcagcctagacgcctagaagtatttgcttactttattactgtcagtcagcgtagacaactcggcctctctacgttcggacggtagggaccgaggggtggagtagtcgaggaccgtagtcggtggctcgg

SEQ ID NO: 116143 - DNA, 518 bp, Homo sapiens
  misc_feature: GYAE6OF02H68VY.47.81.H04.1.454.CMB.1.raw
  modified_base (361)..(361): a, c, t, g, unknown or other
  misc_feature (361)..(361): n is a, c, g, or t
  modified_base (458)..(458): a, c, t, g, unknown or other
  misc_feature (458)..(458): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatggggtctccgttattgctactggtggtgccanagactatgcaggctcgtgagggccgattcacatctccagagaaatggacaagactcttgtatcttacaatgaacagcctgacgagccgggacacggnggtgtattacgtggtgtaagagagctacggagtaggtaacgaggggtacttaagtgttcg

SEQ ID NO: 116144 - DNA, 501 bp, Homo sapiens
  misc_feature: GYAE6OF02HE5A4.47.81.H04.1.454.CMB.1.raw
  modified_base (207)..(207): a, c, t, g, unknown or other
  misc_feature (207)..(207): n is a, c, g, or t
  modified_base (398)..(398): a, c, t, g, unknown or other
  misc_feature (398)..(398): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccagccaccctgtctgtctctccaggggaaanagccaccatctcctgtagggccggtcagagtattagcatcaacttagcctggtaccagcagagacctgggcaggctcccaggctcctcatctatgatgcgtccaccagggccactggttcccagccaggttcagtggcagtgcgtctgggacagagttcactctcaccatcaacagcctgcagtctgaagnttttgctagtttattactgtcagcagttatacattaactgccgctcgaccttcggaccaaggaccacgactggaacgaattaaacgactgtcgcgtgcactac

SEQ ID NO: 116145 - DNA, 512 bp, Homo sapiens
  misc_feature: GYAE6OF02FT8ID.47.81.H04.1.454.CMB.1.raw
  modified_base (415)..(415): a, c, t, g, unknown or other
  misc_feature (415)..(415): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggcaccctgtctttgtctccaggggaaagagccaccgtctcctgcagggccagtcagagtgttggcagcaactacttagcctggtaccagcagagacctgggcaggctcccaggcctcctcatctatggtgcatccaccagggcccactggtactcccagccaggttcagtggcaggtgggtctggggacaggagttcactctcaccatcagcagcctgcagtctgaagtattttgntaatttattactgtcagcagtacgtagacaactcggcctctctacgttcggacggaggaccgagggtggagagtcgagacgaacgtggtcggcgtcg

SEQ ID NO: 116146 - DNA, 524 bp, Homo sapiens
  misc_feature: GYAE6OF02FLR2N.47.81.H04.1.454.CMB.1.raw
  modified_base (379)..(379): a, c, t, g, unknown or other
  misc_feature (379)..(379): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctgagactctcctgtgcagcctctggattcatcttcagtgactacgacatgcactgggtccgccaagttgcaggagaacctctggaatggggtctccgttattgctactggtggtgccacagactatgcaggctccgngaggggccgatcaccatctccagagaaatggacaagactcttgtatctacaatgaacagcctagagacgccgggacacgggcggtagtagttacgtgtaggtaagagagtcgtacgagtggtaacgaggggtacttagtgttacg

SEQ ID NO: 116147 - DNA, 525 bp, Homo sapiens
  misc_feature: GYAE6OF02FUSJH.47.81.H04.1.454.CMB.1.raw
  modified_base (359)..(359): a, c, t, g, unknown or other
  misc_feature (359)..(359): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctgggtacagcctggggggtccctgagactctcctgtgcagcctctggattcatcttcagtgactacgacatgcactgggtccgccaagttgcaggagaacctctggaatgggtctcgttatgctactggtggtgccanagactatgcaggctccggtgaggggccattcaccatctccagaagaaatggacaagaactcttagtatcttacaaatgaacagcctagagagaccggggacacgggcggtgtattacgtggtgtaagagagcgtacgagtggtaacgaggggtacttagtgttacg

SEQ ID NO: 116148 - DNA, 623 bp, Homo sapiens
  misc_feature: GYAE6OF02GFUPR.47.81.H04.1.454.CMB.1.raw
  modified_base (304)..(304): a, c, t, g, unknown or other
  misc_feature (304)..(304): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagccgtggggggtccctgagactctcctgtgcagcctctggattcatcttcagtgactacgacatgcactgggtccnccaagttcgcagggagaacctcgtggaatgggtcttccgttattgctacgtggtggtcgccacagactatgcaggctccggtggacggggccgtattcgacctatcctaccgaagaagaaaagtcggacaaagaaccttcttagttactcttacaaatacgaacacgccctaggaacgacgggacccggggaacgaccgggtcgggttcgttaagttacgttaggttaaggttaaaggaaggtaacggtaccgttaccggtaaggttacggggttaaaccggaacgggggttaaacgtttaacggttaggttttaacgg

SEQ ID NO: 116149 - DNA, 639 bp, Homo sapiens
  misc_feature: GYAE6OF02IB2P4.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagctgggtggaggtcggggggaggcctggtacagccgtgggggtccctgagactctcctgtgcagcctctggattcatcttcagtgactacgacatgcactcggggtccgccgtaagttcgacgagggacgaacctcgtaggaacgtggtcctccgttatcgctacgtgggtggtcgaccaacgacgtactagtcgacaggcctccggtggacggggccgtagttccaccgatccgtaccagaaagaaagtcggacaaagtaccttccgttagtacttaccttaacaaagttacgaaacgcgtacccgtaggaacgtacgggacccggggaacgtaccggggtcggttagttacttaacggttggttaacggtaaggacgtaggtaccgtacggtaggttaacgggtaacggtaacggggtaactttaacgtggttttaacg

SEQ ID NO: 116150 - DNA, 585 bp, Homo sapiens
  misc_feature: GYAE6OF02I03A9.47.81.H04.1.454.CMB.1.raw
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttcctgttgctatattagaaggtgtccagtgtgaggtgcagctggtggagtcggggggaggcctggtacagcctggggggtccctgagactctcctgtgcagcctctggattcatcttcagtgactacgacatgcacgtgggtccgccaaggttgcgtagggagaaccctcgtaggaatggggtcctcgttattgctacgtgggtcggtgccacagactagtgcgaggctcggtggacggggccgattcaccntctcaganaaatggacaagaactccttagtacttctacaaatcgaacagcctagagtaccccgggtaggggaccgacgggtggttacgtagtttacgtaggtaggttaaaggaggtaaggtcgtacggtaagttacgggtaaacggtagggggttaactttaaggtcggttaacg

SEQ ID NO: 116151 - DNA, 533 bp, Homo sapiens
  misc_feature: GYAE6OF02IEHEX.47.81.H04.1.454.CMB.1.raw
  modified_base (206)..(206): a, c, t, g, unknown or other
  misc_feature (206)..(206): n is a, c, g, or t
  modified_base (304)..(304): a, c, t, g, unknown or other
  misc_feature (304)..(304): n is a, c, g, or t
  modified_base (353)..(353): a, c, t, g, unknown or other
  misc_feature (353)..(353): n is a, c, g, or t
  modified_base (403)..(403): a, c, t, g, unknown or other
  misc_feature (403)..(403): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggcaccctgtctttgtctccaggggaangccacgtctcctgcagggccagtcagagtgttggcagcaactacttagcctggtaccagcagaaatctggccaggctcccaggcctcctctattttanggtacataacaacgagggcccatggaccatcccagacagtattcagcgnagtgacgtcgtgggacagtacttcactctcaccatcagcacgactggacncgtagaatatttgactagtactactatcgtacagctagttagtgttggacagacgtcggacgttcggacggaacgggtaccgaggggtacgaacgtacgaacggtcgaacgttggaggtccgagtacccg

SEQ ID NO: 116152 - DNA, 612 bp, Homo sapiens
  misc_feature: GYAE6OF02GBJKG.47.81.H04.1.454.CMB.1.raw
  modified_base (339)..(339): a, c, t, g, unknown or other
  misc_feature (339)..(339): n is a, c, g, or t
  modified_base (382)..(382): a, c, t, g, unknown or other
  misc_feature (382)..(382): n is a, c, g, or t
  modified_base (523)..(523): a, c, t, g, unknown or other
  misc_feature (523)..(523): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctcttttaaaaggtgtccagtgtgaggtgcaggtagtggagtccgggggaggcttagttcagcctggggagtccctgagactctcctgtgcagcctctggattcaccttcagtcgactactacatgagctggactccgcaggctccgagggaggctggagtggattgcttanatcgagtagtagtgtacttacattatactacgcagactcgtgngaacgggcctaattcgaacccgttctaccgagggaccaacgaccaagtacgtcaattaggactcgtagacgtaatcggaaacacggtcctaggaacggacgacccggaaggaccgaccgggttaccgttttaacttaccgnggtaccggacggtacggtaacggtccccttccgtccctaccccgtagttacccggttacgggttttcggaccggttcggtaccgggggg

SEQ ID NO: 116153 - DNA, 729 bp, Homo sapiens
  misc_feature: GYAE6OF02JMRWV.47.81.H04.1.454.CMB.1.raw
  modified_base (286)..(286): a, c, t, g, unknown or other
  misc_feature (286)..(286): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttgggctgagctgggttttcctgttgctatattagaaggtgtccagtgtgaggtgcagctggtggagtcgggggagcctggtacaggccgtggggggtccctaggacgacgttctccgtgtcgccgagccctctggattcatcttcngttagacctacgacagtgcacgtgggtcccgccgtaaggttcgcgaagggtacgaaaccttcgtaggtaagttcggggtccttccggtttaattcggtacgttaccgtgggttcggtcggacctaaccgagtacctaagttcgacggtacggtccgttacggtacggacgggggtacccgagtttaccaacccgtacttcccgttaccgaaggtaaacgtaaaacgtacggacaaacggtaacccttaccgtttcgtaaacgttcttaaccgtaaatcgtaaactcgtacccgttaggaacggttagggtaccgggaaccggaccgggtacggtttacggttaactttacggtacggttaagggtaaccgtaagggtacgtaaccgttacggtaaggttacgggtaaacgtaaggggttaacctttaaaggtcgtttaaccgg

SEQ ID NO: 116154 - DNA, 635 bp, Homo sapiens
  misc_feature: GYAE6OF02F6A7J.47.81.H04.1.454.CMB.1.raw
  modified_base (207)..(207): a, c, t, g, unknown or other
  misc_feature (207)..(207): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggcaccctgtctttgtctccgaggggaangccaccgtctcctgcagggccagtcagagtggttggcagcaactacttagcctaggtaccagcaagaaatcgtggccaggcctcccgaggcctcctactatttacgtggtacaataacaacgacgggacctacgtcggactactcccaagacacgtacttacgaggtggactaggtcgggtacgtggggacacggtacttcgacttctacaacctatcgacgcgacgccgtagacgccgtagaacgttactttaggttactttagttacgtgtacgagtcacggtcgtagtacggttcctacggtccccttacgtccgttaccgttaccggtttccgggaccgggtaacgggtaccggtaaggggtacggtacgtaacgtaaccggtaaacggtaccggttggtacggtacgttacggacctaaccgg

SEQ ID NO: 116155 - DNA, 619 bp, Homo sapiens
  misc_feature: GYAE6OF02I73QB.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagcgtgggttttcctgttgctatattagaaggtgtccagtgtgaggtgcagctggtggagtcgggggagccgtggtacagccgtgggggtccctgagactctcctgtgcagcctctggattcatcttcgagtgacttacgacatgctacgtggtcccgcctaaggttcgccaggactaacctcgtggaatcgggtcttaccgttattcgctagttcggtaggtcgcacgagtactagcgacacggctccggtggacgggaccgtacgttaccgacctacgtcctaccgagaacgtaaagtcggacaagtaccttcgttactactacgtttacaagtaacgacacgtacctagacggtacggacccgggaacggtaccgggacgttagtaccttacggttacgtaaggttaacgtaagtacgtacgttacggtagttacggtaacggtacggggaactttagtggtttaacg

SEQ ID NO: 116156 - DNA, 558 bp, Homo sapiens
  misc_feature: GYAE6OF02J2TLA.47.81.H04.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (341)..(341): a, c, t, g, unknown or other
  misc_feature (341)..(341): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccagcaccctgtctttgctccagggaaacngccaccgtctcctgcagggccagtcagngtgttggcagcaactctagcctggtaccagcagaaatctggcctaggcctcccaggcctcctctatttatcggtacatacaacgagggccacgtggcacgtccagacngtatcgagcgacagtgagtcgtagggacacgtacttcactcncgactctcgancagactggacncgtacagttctttgactagtactactaagttcacagtactagttagttaggtacgacgacgtacgtcggtaccgttaccggtaacggaaccgggaccggtagggtaacgaaacgtcgtaaggtaccggaacgtggtacggtccgtagtacccg

SEQ ID NO: 116157 - DNA, 547 bp, Homo sapiens
  misc_feature: GYAE6OF02IGMAW.47.81.H04.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
  modified_base (541)..(541): a, c, t, g, unknown or other
  misc_feature (541)..(541): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggcaccctgtctttgtctccaggggaanagccaccgtctcctgcagggccagtcagagtgttggcagcaactacttagcctggtaccagcagaaatctggccaggcctcccaggcctcctctatttagnggtacatacaacgagggccacgtggcactcccagacagtattcgagcgacagtgagtcnggggacagtacctttcactctcaccatcagcagacgtggacgcctagaagttattttcgctagtatactactcgtacagctagttagtggttaggacacgtagtcggtacgttccggaccgaacgggaccgaggggtaacgaacgtacgaacgacggtaacgtggtacggtacgngtaccc

SEQ ID NO: 116158 - DNA, 712 bp, Homo sapiens
  misc_feature: GYAE6OF02IR5VO.47.81.H04.1.454.CMB.1.raw
  modified_base (371)..(371): a, c, t, g, unknown or other
  misc_feature (371)..(371): n is a, c, g, or t
  modified_base (701)..(701): a, c, t, g, unknown or other
  misc_feature (701)..(701): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttgggctgagctgggttttctgttgctatattagaggtgtccagtgtgaggtgcagcgtggtggaggtcgggggagccgtggtacaggccgtgggggtccctggacgactcgtccgtgtgcacgcctctggtattcactcttcagtgactacgacatgcacgtggtccgcctaagttcgacaggacgaacctcgtagacgtaggtcctcgttagtgcgtacgtggtacggtnccgaacgtacgacgttatcggacacggtcgttaccggtgggaccggggtccgtaacgtttccgaacccgtacgtaccttaccgaagggtaaacgtaaaaacgttcggaactaaacggtaaaccttaccgttttacgaacctttacgttaaccgtaaaagttaccgaaaccgtacgtacccggtaaggtaaccgggtaaccgggtacccggggtaaccgtaaccgggttcggggttaacttacggtttacggtagggttaacggtaaacggtgggtaacccgtcggtaccgttaaggttaacgggtaacgggtaagggttaactttaaggngttttaaccgg

SEQ ID NO: 116159 - DNA, 717 bp, Homo sapiens
  misc_feature: GYAE6OF02HZU7I.47.81.H04.1.454.CMB.1.raw
  modified_base (207)..(207): a, c, t, g, unknown or other
  misc_feature (207)..(207): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtagttgacgcagtctccaggcaccctgtctttgctccaggggaaangccaccgtctcctgcgagggccagtcagagtgttggcagcaactacttagcctggtaccagcaagaaactcgtggccaggcctacccgaggcctcctactagtttataggtacataacaaccgacgggccaacgtcggactacgtacccaagacaagtactttacgaacggccggtacgtaggtacggagttacgtacgggggaacctacggtaccctttccgaaccgttccgtaccaacccgtaactaccgacggtaccgaacggtaccgttacgggaccgtacccgttaaggtaaacgtttgttttacggaccgttaacgttaacttaaccgttacgttcggtacctaacgtaccgtaagttacgttagggttaccgggtaaactaaccggtaacgttaccgggtacggtttccggaaccgggtaaacggggtaacccgggtaaggggtaaccgtaaacgtacggaacggtaccgttaacggtagggtcccggtagtacccggtaccg

SEQ ID NO: 116160 - DNA, 794 bp, Homo sapiens
  misc_feature: GYAE6OF02JEC35.47.81.H04.1.454.CMB.1.raw
  modified_base (227)..(227): a, c, t, g, unknown or other
  misc_feature (227)..(227): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttgggctgagcggtggttccgtgtaggcgtatagttagagtgtcagtgtgagtgcgagtcgtaggtggaggtcggggagtcctggacngtccgtagggggcctagacgactcgtccgtagtcggacagtccgtacgtaggtacgttactacttcgtacagggttacgacgttaacgactaattggcctaaccgtggggttacccgcctaaaagggtttcgaccaagggtacgtaaaacccgtcgttaaggaaacttgggggttacctaccggtttaattaggaccttaaccggtgggtaggttcgaccgtaacgacgtaacgtagtacgcgaaacggtcctaccgggtaggtaaccggggaccctaaagtttccgaaaccgatttaccgaaccgtaagtaaacccgtaaaagttcgggaaccttaacggtaaacccgttacgttacggttaacttaccgttaacggtaaagtaccggttaaacacggttaacccgttgggaaaccgttacgggaacccgggtaacgaaccggggtaccggtttaagttaccgttaaccggttaggttaacggtaaacggtacggttaacgtacccggttaagtaccggttaacggtacgggtaaaccggggttaacttaacggtacgtttaacgg

SEQ ID NO: 116161 - DNA, 733 bp, Homo sapiens
  misc_feature: GYAE6OF02ICHSG.47.81.H04.1.454.CMB.1.raw
  modified_base (201)..(201): a, c, t, g, unknown or other
  misc_feature (201)..(201): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaattgtgttgacgcagtctcaggcacctgtctttgctcgagggaancgccacgtctcctgcagggccagtcagagtgtggcagacaactacttagccgtaggtaccagacaagaaatcgtaggccaggcctacccgaggcccttcctacgttacttttagtacggttactacgttaaccgaacgtacgggtacccaacgtcggcctaaccgtaccccgaggaacccgtaaggtaacgttacgacgggtacccggacgtaggtcggtaaccgtttaggtacgggaacgttaacggtacccgttttaccgtaaccgttccctacctaacccgtacttaccggaacgtaccgaacggtaccggtacgggacgtaccgttaaacggtaagtttacgtttacggacgtaagtttaacgtaaacctttcgtaacgtacgtaagtccgtaaggttcgttacgggttacgtacggtaacctcggttacggttaccggttacccgggaaccgggaacgggtacccgtaaggggtaaccggtaacgtaaccggtacgaccggtacgttaggccgttacgcgtaacccg

SEQ ID NO: 116162 - DNA, 619 bp, Homo sapiens
  misc_feature: GYAE6OF02GAPAQ.47.81.H04.1.454.CMB.1.raw
  modified_base (206)..(206): a, c, t, g, unknown or other
  misc_feature (206)..(206): n is a, c, g, or t
  modified_base (358)..(358): a, c, t, g, unknown or other
  misc_feature (358)..(358): n is a, c, g, or t
tcagagctcacgtacacgaccggtgctcgatttagtagtgtagattcgcggggggctctggagaagagctgctcagttaggacccagagggaaccatggaaaccccagcgcagcttctcttcctctgctactctggctcccagatatcgccggagaaattgtgttgacgcagtctccaggcaccctgtctttgctccaggggaaangccaccgtctcctgcagggccagtcagagtgtgcagcaactactagcctaggtaccaacagaaacctggccaggcctcccgaggctcctcatttatggtacatacaacgacgggccacgtggcctactcccagaccagtacttcaggccggnaggtgagtcgtagggaacaggtacttcgacctctaccacctatcagtcaaggtacctgggactccgtagaagttactttaggacctaaggttaactaaccgttagtacggtacgaacgtcgtaagtttagttggttacgggaacctaacgtacggttaccgggtacgtttcccgggaccgtaacggggtaccggtaggggtaaggttaaccgacggtaaacggccggtaacgttcgggtacggtctcggacctaccgtacg

SEQ ID NO: 116163 - DNA, 629 bp, Homo sapiens
  misc_feature: GYAE6OF02GU6N5.47.81.H04.1.454.CMB.1.raw
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggagaaattgtgttgacgcagtctccaggccaccctgtctttgtctccgaggggaaagngccaccgtctcctgcagggccagtcagngtgttgcagcaactactagcctggtaccagacaagaatcgacggccgaggcctcccgaggcctcctctatttagtcggtaacataaccaacgtacgggccacgtggactactccgaagacaagtacttacgacggcggactaggtaggacgtcggtaggggaactacggtacctttacaccttcctaccaacctagtaccgacgaccgaacgtacgtacggaccgtccgtaaggtaacgttagtttcgacttaagttactaccttacgtgtacgagtactagtagttcggtaggaactagtacgtacggtacggtcggaaccggaacgggtaacggtagggtacggaacgtcggaacgtacggtaagttcgggtacggtcgtacgtaaccg

SEQ ID NO: 116164 - DNA, 827 bp, Homo sapiens
  misc_feature: GYAE6OF02INOVL.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcaccatggagttgggctgagcttgggttttccttgttgctattattagaaggtgtcagtgtgaggtgcagcgtggtgggagggtcggggggaggtccgtggtacgacggtcccggttcggggggtcccctggacggaccttccgttcccgtggtcgaccgacgtcccttcgtggtactttcgactttccgttctacgttcgaaccgttaacggtactaagtcggactaccggttcgggtaccccgaccgtaaggttcgaccgtacgggtaacgtaaccttcggtaagggtaacgttcggggtaccttaccggtttattcgtaccttagttggggttcggttcgaccgtacgacggtactacgtcgacgacggtcgttccgggtgggacgggtcctacgttaccgaaccgtacgtcctaacgaaggtaaacgtaaaacggtcggaaacctaaacggtaacctttaccgttaacggttacttaacttaaccgtaaagtaaccggtaaccgtaaccgtcgtaacgggtaacggtaccggggtaacccggggtaacgtaaccggggttcggttaacgtttaacggttaccggttacgggttaaagggtaaccgtaagggttaaccggttcccggttaagggtaacgtttaccgggggtaaacggttaacggggtttaactttaagggtaccgtttttaacgg

SEQ ID NO: 116165 - DNA, 746 bp, Homo sapiens
  misc_feature: GYAE6OF02JDUNC.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctattttagaaggtgtccagtgtgaggtgcaattggtgcaatcgtgggggagcttggtccaggccgtggggggtccctcgacgactctcctgtgctagcctcgtggtacttctaccttttacgttccttcttggtattgtagttcgggtccgtccgagtactccgaaggggacgggccgtagggtacggtcgggttacgggactaacgtaagttaaacgtccgaagagtaggaaacgtacgaaacgaaaaccttagtaggtacgaaccttacgtacgtaggtaaccgggtccgtacttaccacctacttaccctacgaacgtaaacggacccaaacgacccgaaagtaaccttccgttacttagttttacgacgaaccgttaaagtaccggaacaccggtaccttagggaacgttacggaaccgacgtaaccgccgggtaccttggttaaccgttaatttaccgttggttacgttacgttccgttacggttaccggaaccccggttcccgtaccggggttacccccggttccggttaggttccccgtttacccgggtcggggtaccccgttaaccgggg

SEQ ID NO: 116166 - DNA, 865 bp, Homo sapiens
  misc_feature: GYAE6OF02IBP7H.47.81.H04.1.454.CMB.1.raw
  modified_base (182)..(182): a, c, t, g, unknown or other
  misc_feature (182)..(182): n is a, c, g, or t
tcagagctcacgtacacgaccggtgctcgatttagtagtgtagattcgcgggggagctctgggagtggagccccagccttgggattcccaagagtttgtattcagtgatcaggactgaacacacaggactcaccatggagttgggctgagcttgggttttcctgttgctatattagaaggtntccaggtgtgaggtgcgagcgtgggtggacggtcggggggacgccgtggtacaggtccggtagggggtcctaggacgaccttcctccgtgtcgctacgtccgttcgtaggtacttactacttcttaccgtaggtacgtacgtaccgacagttacgacgtacggtcgggtaccgtaccgtaacggttcgacggaaggaaccgtaacgtcggtaagggtaacggttcgggttaccgtttaccgttagttcggtacgttacggtttggtacgggtcgtaacccgtaacgtaacgttacgtaagtcggtaacgtccgggtaccgttaccgggtacggggaccggggtccttaaacgttaccccgtacgtaaccttaccgtaaccgaaaggaaaaccgtttaaggaaccggtaaccgttaaacgttacccgtttaaccggtttaagttaccgtttaacctttaaccggaaacgtaccgtaaagggttacccgtagtaacggggaccggggttaacggggaacccgggtaaccggtacggggtaacgtttcgttaaacccggtttaggtaaggggtaaacgttacggggaacggtttcccgggtaagttaaccggggttaaacgggttaacggggttaaaaccggggttaacgggttaaccgtttttaaggtccgtttttaaaccgggg

SEQ ID NO: 116167 - DNA, 757 bp, Homo sapiens
  misc_feature: GYAE6OF02FO4M7.47.81.H04.1.454.CMB.1.raw
  modified_base (280)..(280): a, c, t, g, unknown or other
  misc_feature (280)..(280): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggtttccttgttgctatattagaaggtgtccagtgtgaggtgcagctggtggaggtcggggggaggcctggtacagccgtggggggtccctggagactctcctgtgcagcctctggtattcatcttnagtgactacgacatgacacgtcgggtccgccgtaacggttgaccgaagggtaacgaaacccttccgtagggaacgttcgggggtccttaccggtttaatttcgtaccgttaacgtggggttacggtcggtacccaacgtaacggtaaccttaagtcggacctaacggggtccgttacccgggtaggggaccgggggtacccgtaacgttaccgaacccgtacttacccgtaccgtaacggaaacgtaaaacggtcgggaaccaaacggtaaccttacctttaggtaacttaccgtttactaaaagttacaaaccgtacggtaccgtagggaacggaacggggacccgggtaacggtacccggggtggttacgttacgttaacggttacggttaagggtaacggtagggtaacgtaccgttaacggttacggttagggtaaacccgggtaggggttaaactttacggtgttttaacgg

SEQ ID NO: 116168 - DNA, 791 bp, Homo sapiens
  misc_feature: GYAE6OF02HCWIB.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcaccatggagttgggctgagctgggttttcctgttgctatattagaaggtgtccagtgtgaggtgcagcgtggtggaggtcggggggagccgtagggtacaggccgtggggggtccctggacgactctccgtgtgcagcctctggattcattcttcagtgactacgacagtgcacgtcgggtccgaccgtaaggttcgacgaggtaacgtaacccgtcgtaggtaacgttcggggttaccttaccggtttagttcggtaccgttacggttgggttcggtacgtaccctaacgtaacgtaaccgttaagttcgaaccgtaagggtcccgtaccgggttaggggtaccggggtcccgtaacgttaccgaacccgtaacttacccgtaacgaaggtaaacggtaaaagtcggaacgtaaacggtaaccgttccgtttagttaaccgttactttaaccgaaacgttacgaaaacgtacggtaccgtaagggtaacggaccggggtaacccggggtaaccgtacgggggtacgggttaccgttaacggtttacggttacgggttaaaggttaacgggtaacggtacggttaaccgtaacggtaacggttaaccggggttaaaggtaacccgggggtttaaacgtttaaggttacggttttaaccggg

SEQ ID NO: 116169 - DNA, 749 bp, Homo sapiens
  misc_feature: GYAE6OF02GB50Q.47.81.H04.1.454.CMB.1.raw
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
tcagagctcacgtacacgaccggtgctcgatttagtagtgtagattcgcgggggctctggagaagagctgctcagttaggacccaggaggggaaccatggaaaccccagcgcagcttctcttcctctgctactctggctcccagatatcgccggagaaattggtgttgacgcagtctccaggccaccctgtcttgtctcaggggaanagccacctctcctgcagggccagtcagaatatcactcctacgttacnccgtagtaccaacagtaaaccctggtacgagcctcccaggacctcctacntcctatcgactgctactacccgtaacgacgggaccacgtggacctactaccccgaggacctaacggtcgaggtcgggactagggtgggtagtaccggggacaccgttaccgttactaccgtacctaccgtaacctcgttaccgacgtaccgtaacggtaccttaacggacgtacccgtaagggtaaacccgttacggttttaacggttaaaccttttaaccggttttccgttacgttaccgtaacggtaccgtacgggttaccggttaggttaccggttccggggttaccggtccccggtacccgttaccgttacccgtacgggttttacccggggaccgggggtacgggtacccgggtaagggtaccgggtaacggttaaccgtaaccggtaaacgtaccggtagggttacggtaccgtacggaccctacccggtgttacccgg

SEQ ID NO: 116170 - DNA, 810 bp, Homo sapiens
  misc_feature: GYAE6OF02I238O.47.81.H04.1.454.CMB.1.raw
  modified_base (750)..(750): a, c, t, g, unknown or other
  misc_feature (750)..(750): n is a, c, g, or t
tcagagctcacgtacacgaccggtgctcgatttagtagtgtagattcgcggggagctctgggagtggacgcccccagccttgggattcccgaagagtttgtattcagtgatcaggactgaacacacaggactcaccatggagttggggctgagctgggttttcctgttgctatttagaggtgtccagtgtgacggtgctaagttggtgacaagtcggtggggaggtcgttggtccaggtccggtcgggggtccctcgacgactcctcgtgtcgcacgcctcgtggtacttccgtaccttttacgttcccgttcgttcggtaagttacgttaagttcgggttaccccgtacccgaacggtacccgttacccgggaacgggggtaacggggtcgttacggggtaacgggtttcggggtttacggacccgtaaaacgtaagttaaaaccgtcccgggtaaaaggtaacggttacgggtaaacgttaccgaaaaacggttaaaaccttaacggttacgggtaacggttacctcgttacgggttaacgggtaaaccggggtaccgtttaccgtacccgaccgttaacccggtttacccaccggtaaacggtaaccgaaacccggtaacgaacccgtaaacggttaaccttcgttacctttcggttaccgtacgtaactaaggtccgaactccgtagtacgacgtacgtacggaactaccggcgtcgtagtacgttagtccgtttagacccgtttnccgttgaccacggtccccgtggtcccgttacgttgtccgtcgggtacggaccgttaccgg

SEQ ID NO: 116171 - DNA, 613 bp, Homo sapiens
  misc_feature: GYAE6OF02FV2CZ.47.81.H04.1.454.CMB.1.raw
  modified_base (422)..(422): a, c, t, g, unknown or other
  misc_feature (422)..(422): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagcttgggttttccttgttgctatattagaaggtgtccagtgtgaggtgcagcgtgggtggaggtcgggggggaggccgtgggtacaggccgtgggggggtcccctgacgactcctctggtgctacgcctctggattcatccttcagtgactacgacatgcacgtcgggtcccgaccgaacgttcgacgaggacgaaccgtcgtaggaagttggtaccgtcgtttattcgtctacgtggtaggcgtcacgtagactatcgcgaggtccgtcggngggacgggcgtacgttccacctactccctaccgagaaagaacgtcggaactaacgtacttccttagtactacctacaactacgaataccgtacgtagtacggtacgggacgggacgtacggtaccgtattagtacgtaggtgtaaggtagacgtgtagacggtggaacggtaggttacgtagttcgttacg

SEQ ID NO: 116172 - DNA, 835 bp, Homo sapiens
  misc_feature: GYAE6OF02IHU1V.47.81.H04.1.454.CMB.1.raw
  modified_base (311)..(311): a, c, t, g, unknown or other
  misc_feature (311)..(311): n is a, c, g, or t
tcagagctcacgtacacgaccggtgctcgatttagtagtgtagattcgcggggagctctgggagtggagcccagccttgggattcccaagagtttgtattcagtgatcaggactgaacacacaggactcacatggacgttgggctgagcgtgggttttccttgttgctatattagaaggtgtccgtagtgtgaggtcgcgtagcgttggtggaggtcggggggagtccgtaggtaccgacggtccggtcgggggtccctagacgtactctccgtggtgacgacgtcctcgtgtacttacgtacttccgtanacgtacgtaaccgtacgaacctacgttgacctaacggtaccggggtccaaccggtaaagtttcggaaccggtacggaaccgtaacgttaccgtggttaaacggttacgggttccgtttaccggtttaacgttcggtaacgttaacggttttgggtaccggtacgtaacccgaacgtaacgttaactaaccgttggaccgtaccggtccgtaccgggtaggaccggggtaccgttaacgtccgtaaacccgttagtacccgtaaccgtaacggtaaaaacgtaaaggtaccgtaaacgtaaacggttacccgttaacgtttacgtaatttacccgttaaacgttaaacgtaccgtaaagtaccgacgtaaggtaaccggaccgggtaaccgggaacgtacccggggtagtttacggtaacgttaccggttaaggtaacgggtaacgacgggttaaccggtccgttaaacgggtaacggttaaggaaaccggttaacgggtaaacgtttaggttccggtttaacgg

SEQ ID NO: 116173 - DNA, 748 bp, Homo sapiens
  misc_feature: GYAE6OF02HLBD3.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcaccatggagttgggctgagctggtttcttgtgctatattagaaggtgtccagtgtgaggtgcgagctgggtggagggtcgggggaggccgtggtacgacggccggtgggggtccctggacgacctcgtccgtgtcgccgagtcctcgtggtcttacacgttcttaccgagtcgtaactaacgtaccagtcgccgtacgttcgggtcccgtactaacggttcgacgaacggtacgtaacccgtcggtaggtaacgttcgggttaccgttccgttagtcgtacgttacgtgggttcgtccgtaacctacgtaacgtacgtagtcggtaccgtacggtccgtttaccgggaggggtacggggtaccctacgtttaaccccgaccgtaccttaccgtaccgaaagggtaaaccgtaaacggtccggaacgtaaaacgttaacccgtttcgtaacggttacttaaccgtaaccgtaaagtaccgtaaacctcgtacgtacggaaccggtacggcccgggtaagtaccggtgttatacccgtagttcgggaaggtaaggacgtaccggtccgaaaggtcggtaaccgggtaacggaacgggtttaacttacgttggtttaacgg

SEQ ID NO: 116174 - DNA, 816 bp, Homo sapiens
  misc_feature: GYAE6OF02IVVN0.47.81.H04.1.454.CMB.1.raw
tcagagctcacgtacacgaccggtgctcgatttagtagtgtagattcgcggggagctctgggagtggagccccagccttgggattcccaagagtttgtattcagtgatcaggactgaacacacaggactcacatggagttgggctgagcgtggttttcctgttgctatattagaaggtgtccagtgtgaggtgcagcgtggtggaggtcgggggagcctggtacaggccgtgggggtaccctggacgtacgtcctccgtggtacgcgtaacgtcccgttgttacgggtactttcgtaacctttaccgtttaccgtagttacggtaacccttaaccggaacgtaacgttggaccctaaccggggttccggggtaccccggtaacccggtaaagggtttcgaccgaacgggttaaccgtaacccgttcgtacgggtaacgttccgggggttaccttaccggtttaagttcgtaccgtttaacgggtgggttcggtacgtaccgtaaacgaaccggtaatacgtcgaccggtaacgggtccggtttccggtaggggtaccgggtacccgtaacgttaccaaccggtacttcccgtaaacgaggtaaacgtaaagtacggtaaacctaaacggtacttaaccgttgtaaccttacttaacaaacgtacggaaacctaggtaaccgtacggaaggaaccggtcggggtacgtacgggttacgtacgttacgttacggttacggtaagtaacgggtaacgacgttccgtaagttaaccggtaagggttaaccggtagggtaaacttacggttagttaaccgg

SEQ ID NO: 116175 - DNA, 837 bp, Homo sapiens
  misc_feature: GYAE6OF02I4ANX.47.81.H04.1.454.CMB.1.raw
  modified_base (167)..(167): a, c, t, g, unknown or other
  misc_feature (167)..(167): n is a, c, g, or t
tcagagctcacgtacacgaccggtgctcgatttagtagtgtagattcgcgggggctctggagaagagctgctcagttaggacccagacggaaccatggaagccccagcgcagcttctcttcctctgctactctggctcccagataccatggaagaaatgtgatgacncagtcctcgacgacctccgtgtcgtgtctacctacgggaagggaacgtccaccctaccgttcctaccgtcgacggtacggccgtagtcgaagttaacgtatacgcgaacgtaacttaacgtccgtacggttacggaaccagacgaaaccgtaacggtcgggacgtaccggtacccgaccggtacgtccctttccaactacgttccgttaggtcgccgtacacccgacccggaaggtacccggtacgtaacggttccgaaacccgccccgtaaggtaccggttacggttacgacggggtcggtacgggttagggggttacggtaccgggtaacggtaaccggtaaggttttacccctttaacgacccgtaccggtaccctaaccgtacggttaacgaccgactacccggtacgtccgtacgtacggttaacgttaacgtttacgtttacgttaacgttacgttttaacgttaaccgtttacgttaccggtaacgtacggttaaaccgtttaagttaaaccgttaccgtaaccgggttaccgtaccgtttaccgttacccggttaccggaacggttaaccgggaacttacgggaaacggttaaccggttaaagttaacccggtaacggttacggttaccggggtaccgtaccggttacctacccgttaacgg

SEQ ID NO: 116176 - DNA, 767 bp, Homo sapiens
  misc_feature: GYAE6OF02GBYHJ.47.81.H04.1.454.CMB.1.raw
  modified_base (211)..(211): a, c, t, g, unknown or other
  misc_feature (211)..(211): n is a, c, g, or t
  modified_base (737)..(737): a, c, t, g, unknown or other
  misc_feature (737)..(737): n is a, c, g, or t
tcagagctcacgtacacgaccggtgctcgatttagtagtgtagattcgcgggggctctggagaagagctgctcagttaggacccagagggaaccatggaaaccccagcgcagcttctcttcctcctgctactctggctcccagatatcgccggaagaaattgtgttgacgcagtctccgaggccaccctgtctttgtctccgaaggggaancgccaccgtctccgtgcgagggccagtcgagtagtgttcggacagactaacttacgtacgcctcggtaccagacaagtaaactcgtcggaccgtacggcccttacccgacggtcccttacccgtacgtacgttccggttagggtactcggtacctaaccgttaacccgaaaccgggtaccggggtccctaccggttacgggacccttacccgtaccccgaacgggtcccggttaacgggttaccgtacgggttcggtacggttacgggtacggggttaccgtaacggggaaccgttaccggttacctttccgaaccgtttacctaacccgtaaaccgtacgtaaccaaaccggtctccgtacgtacgtacggtactacggttaattacgtttacgaactttaacgttttacttacgtacgttacgaacgtcgtacggttacgtacgtaaccgtaccgttcgtacccgttacgttcgttaccggtttcgggaacccggttagggaccggtaggggtaactacggtanacgtacggtaactggtacgtcgtactacgg

SEQ ID NO: 116177 - DNA, 714 bp, Homo sapiens
  misc_feature: GYAE6OF02G0Y11.47.81.H04.1.454.CMB.1.raw
  modified_base (261)..(261): a, c, t, g, unknown or other
  misc_feature (261)..(261): n is a, c, g, or t
tcagagctcacgtacacgaccggtgctcgatttagtagtgtagattcgcggggagctctgggagtggagccccagccttgggattcccaagagtttgtattcagtgatcaggactgaacacacaggactcaccatggagttggggctgagctgggttttccttgttgctatattagaaggtgtccagtgtgaggtgcagcgtggtggaggtcggggggagccgtggtacagccgtgggggtccctgacgctctcctgtgcngcctctgacttcatcttcagtgactacgacatcgcctacgtcgggtcccgaccgtaaggttcgcgaaggacgaaccttcgtaggaagttcgggtaccttaccggttattcgtacgttacgttgggttcggtcgacccaactacgtaactagtagccgtagggtcccttccgggtagggacgggggaccctaagttacccgaacccgtactccctacgaacgtaaaggaaacgtggaaccaaagtacccttcgtttacgttattaccttaactaaacgttacgaaactacggtacctaacgggacgggaacccggggtccggggaaaccggtacgggtaccgggttaggttaccgttaggtacggttaacgggttaaggacggtaacggttacggtacgtaacgggttaccggggttaaacggtacgggggttaacgtttacggttaggttacg

SEQ ID NO: 116178 - DNA, 352 bp, Homo sapiens
  misc_feature: GYAE6OF01EEZFX.14.28.C06.1.454.CMB.1.raw
  modified_base (349)..(352): a, c, t, g, unknown or other
  misc_feature (349)..(352): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttcccctggcgccctgctccaggagcacctccgagagcacagcggccctgggctgcctggtcaaggactacttccgtactagacgctgagcgggctggcaaggcgcatagnnnn

SEQ ID NO: 116179 - DNA, 353 bp, Homo sapiens
  misc_feature: GYAE6OF01A2PWP.14.28.C06.1.454.CMB.1.raw
  modified_base (350)..(353): a, c, t, g, unknown or other
  misc_feature (350)..(353): n is a, c, g, or t
tcagcgtctagtaccacgaccggtgctcgatttagagctcacgtattgggtttgggtgccgaagttgctggaggtcacggtcatcacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacgctgagcgggctggcaaggcgcatagnnnn

SEQ ID NO: 116180 - DNA, 472 bp, Homo sapiens
  misc_feature: GYAE6OF01DBPV6.14.28.C06.1.454.CMB.1.raw
  modified_base (461)..(472): a, c, t, g, unknown or other
  misc_feature (461)..(472): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttatactgtgcctggccgcctgagtgatactgagcctcgccgttcctatcctcgggcggacggaaccggtaccgtcgtaccgtaccgtcctcctacgaccgtcccacccaacgggacccggaccctacggttcccgtttccccccttccccggcggcccccgtcccgtcgtccctaccggaaggcaccctacccgtacggaaggcgaccaacgcgggcccccgtccgggtcggtcgtccgtccggttcgaacggaaccggtacctttacccgtttaccgtaagtacggaccgttggaggaccggggccggtcggtcgaacggacgggccaataagtgnnnnnnnnnnnn

SEQ ID NO: 116181 - DNA, 353 bp, Homo sapiens
  misc_feature: GYAE6OF01C15M1.14.28.C06.1.454.CMB.1.raw
  modified_base (350)..(353): a, c, t, g, unknown or other
  misc_feature (350)..(353): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccaggggaaccctggtcaccgtctcctcagcctccaccaagggcccatcggtcttccacctggcgccctgctccaggagcacctccgagagcacagcggccctgggctgcctggtcaaggactacttccgactagacgctgagcgggctggcaaggcgcatagnnnn

SEQ ID NO: 116182 - DNA, 353 bp, Homo sapiens
  misc_feature: GYAE6OF01A1D78.14.28.C06.1.454.CMB.1.raw
  modified_base (350)..(353): a, c, t, g, unknown or other
  misc_feature (350)..(353): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacgctgagcgggctggcaaggcgcatagnnnn

SEQ ID NO: 116183 - DNA, 355 bp, Homo sapiens
  misc_feature: GYAE6OF01CZNOA.14.28.C06.1.454.CMB.1.raw
  modified_base (348)..(355): a, c, t, g, unknown or other
  misc_feature (348)..(355): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttcccctggcgcctgctccaggagcacctccgagagcacagcggccctgggctgcctggtcaaggactacttccgtactagacgctgagcgggctggcaaggcgcatagnnnnnnnn

SEQ ID NO: 116184 - DNA, 350 bp, Homo sapiens
  misc_feature: GYAE6OF01A6E9V.14.28.C06.1.454.CMB.1.raw
  modified_base (346)..(350): a, c, t, g, unknown or other
  misc_feature (346)..(350): n is a, c, g, or t
tcagcgtctagtaccacgaccggtgctcgatttagagctcacgtattggtttgggtgccgaagttgctggaggtcacggtcaccacgctgctgaggtctgtgaccgctgcggacacgaccctttattactgtgcgcgagggcccctatcgagtgactatgatcccaggccctttgactcctggggccagggaaccctggtcaccgtctcctcagcctccacaaggcccatcggtccttcccctgcgccctgctccaggagcacctccgagagcacagccggcctgggctgcctggccaaggctacgttccgtactgacgctgagcgggctggcaaggcgcattagnnnnn

SEQ ID NO: 116185 - DNA, 353 bp, Homo sapiens
  misc_feature: GYAE6OF01B3N7R.14.28.C06.1.454.CMB.1.raw
  modified_base (349)..(353): a, c, t, g, unknown or other
  misc_feature (349)..(353): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggctacttccgtactagacgctgagcgggctggcaaggcgcatagnnnnn

SEQ ID NO: 116186 - DNA, 352 bp, Homo sapiens
  misc_feature: GYAE6OF01BH3S6.14.28.C06.1.454.CMB.1.raw
  modified_base (348)..(352): a, c, t, g, unknown or other
  misc_feature (348)..(352): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactattatcccaggccctttgactcctggggccagggaaccctggtcaccgtctcctcagcctccaccaagggcccatcggtcttcccctggcgccctgctccaggagcacctccgagagcacagcggcctgggctgcctggtcaaggactacttccgtactagacgctgagcgggctggcaaggcgcatagnnnnn

SEQ ID NO: 116187 - DNA, 362 bp, Homo sapiens
  misc_feature: GYAE6OF01C30NG.14.28.C06.1.454.CMB.1.raw
  modified_base (362)..(362): a, c, t, g, unknown or other
  misc_feature (362)..(362): n is a, c, g, or t
tcagcgtctagtaccacgaccggtgctcgatttagagctcacgtattgggtttgggtgccgaagttgctggaggtcacggtcaccacgctgctgagggagtagagtcctgaggtctgtgaccgctgcggacacggccctttattactgtgcgcgagggcccctatcgagtgactatgatcccaggccctttgactcctggggccagggaaccctggtcaccgtctcctcagcctccaccaaggcccatcggtctcccctggcgccctgctccaggagcacctccgagagcacagcggccctgggctgcctggtcaaggactacttccgtatagacgctgagcgggctggcaaggcgcatagn

SEQ ID NO: 116188 - DNA, 361 bp, Homo sapiens
  misc_feature: GYAE6OF01AGLIA.14.28.C06.1.454.CMB.1.raw
  modified_base (354)..(361): a, c, t, g, unknown or other
  misc_feature (354)..(361): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggccccatccggtccttccccctggccgccctgctccaggagcacctccgagagcacagcggccctgggctgcctggtcaaggctacttccgtactagacgctgagcgggctggccaaggcgcatagnnnnnnnn

SEQ ID NO: 116189 - DNA, 355 bp, Homo sapiens
  misc_feature: GYAE6OF01DUUV9.14.28.C06.1.454.CMB.1.raw
  modified_base (350)..(355): a, c, t, g, unknown or other
  misc_feature (350)..(355): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaacccctggtcaccgtctcctcagcctccaccaagggcccatcggtcttcccctggcgccctgctccaggagcacctccgagagcacagcggccctgggctgcctggtcaaggactacttccgtactagacgctgagcgggctggcaaggcgcatagnnnnnn

SEQ ID NO: 116190 - DNA, 381 bp, Homo sapiens
  misc_feature: GYAE6OF01A2OZI.14.28.C06.1.454.CMB.1.raw
  modified_base (361)..(381): a, c, t, g, unknown or other
  misc_feature (361)..(381): n is a, c, g, or t
tcagcgtctagtaccacgaccggtgctcgatttagagctcacgtattgggtttgggtgccgaagttgctggaggtcacggtcaccacgatgctgaggtctgtgaccgctgcggacacggccctttattactgtgcgcgagggcccctatcgagtgactatgatcccaggccctttgactcctgggccagggaaccctggtcaccgtctcctcacgcctccaccaaggccccatccggtccttccccctggccgccctgcctcccaggacgccaccctccgagagcacagccggcccgtgggctgacctggtcaaggctacgttccgtactagcgctgagcgggctggcaacggcgcatagnnnnnnnnnnnnnnnnnnnnn

SEQ ID NO: 116191 - DNA, 357 bp, Homo sapiens
  misc_feature: GYAE6OF01BI7EQ.14.28.C06.1.454.CMB.1.raw
  modified_base (351)..(357): a, c, t, g, unknown or other
  misc_feature (351)..(357): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtccttccccctggccgccctgctccaggagcacctccgagagcacagccggccctgggctgcctggtcaaggctactccgtactagacgctgagcgggctggcaaggcgcatagnnnnnnn

SEQ ID NO: 116192 - DNA, 375 bp, Homo sapiens
  misc_feature: GYAE6OF01CT1IE.14.28.C06.1.454.CMB.1.raw
  modified_base (368)..(375): a, c, t, g, unknown or other
  misc_feature (368)..(375): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactccgtggggccagggaaccctggtcaccgtctcctcagcctccaccgaacgggcccatccggtcttccccctggccgccctgcctccgaggacgcaccgccgagacgcacgagtcggcccgtgggcctgcctggtacaaggtctacttccgtactagacgctggacgcgggctggcaaggcgtacaatgnnnnnnnn

SEQ ID NO: 116193 - DNA, 373 bp, Homo sapiens
  misc_feature: GYAE6OF01DPYUK.14.28.C06.1.454.CMB.1.raw
  modified_base (363)..(373): a, c, t, g, unknown or other
  misc_feature (363)..(373): n is a, c, g, or t
tcagcgtctagtaccacgaccggtgctcgatttagagctcacgtattgggtttgggtgccgaagttgctggaggtcacggtcaccacgatgctgaggtctgtgaccgctgcggacacggccctttattactgtgcgcgagggcccctatcgagtgactatgatcccaggccctttgactccgtggggccagggaccctggtcaccgtctcctcagccctccaccaagggccccatccggtccttccccccgtggccgcccctgcctcccgaggacgccacctcgagagccacagccggccctgggctgcctggtcaaggactacttccgatagacgctgacggcggctggcaaggcgcatagnnnnnnnnnnn

SEQ ID NO: 116194 - DNA, 353 bp, Homo sapiens
  misc_feature: GYAE6OF01EM5M5.14.28.C06.1.454.CMB.1.raw
  modified_base (263)..(263): a, c, t, g, unknown or other
  misc_feature (263)..(263): n is a, c, g, or t
  modified_base (349)..(353): a, c, t, g, unknown or other
  misc_feature (349)..(353): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttcccctggcgccctgctccaggancacctccgagagcacagcggccctgggctgcctggtcaaggtctacttccgtactagacgctgagcgggctggcaaggcgcatagnnnnn

SEQ ID NO: 116195 - DNA, 441 bp, Homo sapiens
  misc_feature: GYAE6OF01BRUGW.14.28.C06.1.454.CMB.1.raw
  modified_base (281)..(281): a, c, t, g, unknown or other
  misc_feature (281)..(281): n is a, c, g, or t
  modified_base (384)..(384): a, c, t, g, unknown or other
  misc_feature (384)..(384): n is a, c, g, or t
  modified_base (424)..(441): a, c, t, g, unknown or other
  misc_feature (424)..(441): n is a, c, g, or t
tcagcgtctagtaccacgaccggtgctcgatttagagctcacgtattgggtttgggtgccgaagttgctggaggtcacggtcaccacgctgctgagggagtagagtcctgaggtctgtgaccgctgcggacacggtcctttatactgtgcgcggacgggcccctatcgagtgactatgactcccaggtccctttgactccgtggggccaacgggaaccctggtccaccgtctcctcacgccctaccaaccgaacgggccctagtccggtcccttcccccgngcccgccctgcctccgaagggactccaacctcgagacgaccacgacggccggccctggggccttcggccgtaggtaccgaaacggtaccttacttaccggtanacggacgctggacgtcgggctggaccgaaggcacagacgnnnnnnnnnnnnnnnnnn

SEQ ID NO: 116196 - DNA, 442 bp, Homo sapiens
  misc_feature: GYAE6OF01CS4HT.14.28.C06.1.454.CMB.1.raw
  modified_base (279)..(279): a, c, t, g, unknown or other
  misc_feature (279)..(279): n is a, c, g, or t
  modified_base (406)..(406): a, c, t, g, unknown or other
  misc_feature (406)..(406): n is a, c, g, or t
  modified_base (408)..(442): a, c, t, g, unknown or other
  misc_feature (408)..(442): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggtccctttgactccgtggggccaagggacccctggtcaccgtctcctcacgccctccaccaagggccccagttccggtccttcccccgtggccgccctgcctcccaggacncacctcgagacgcacgagccggcccgtggggctcgccgtggtacgaaacggtaccttacgttcccgtaactacggaccgccgtaggacgggccgggtcgtgggaccgaaacgggcgacaagtagcancnnnnnnnnnnnnnnnnnnnnnnnnnnnnnnnnnnn

SEQ ID NO: 116197 - DNA, 410 bp, Homo sapiens
  misc_feature: GYAE6OF01CO3KD.14.28.C06.1.454.CMB.1.raw
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
  modified_base (377)..(410): a, c, t, g, unknown or other
  misc_feature (377)..(410): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggtccctttattactgtgcgcgagggcccctatcgagtgactatgatcccaggccctttgactccgtggggccagggaccctggtcaccgtctccctcacgcctccaaccgaagggccccagttccgggtcctttccccccgtggccgccctgcctccgaggacgcacctcgagagcacgngccgccgtggctgcctggtcaaggtactacgttccgtatagcgccgtggaggcgggctaggcctaagggcncagtacgnnnnnnnnnnnnnnnnnnnnnnnnnnnnnnnnnn

SEQ ID NO: 116198 - DNA, 371 bp, Homo sapiens
  misc_feature: GYAE6OF01C9IVJ.14.28.C06.1.454.CMB.1.raw
  modified_base (355)..(355): a, c, t, g, unknown or other
  misc_feature (355)..(355): n is a, c, g, or t
  modified_base (361)..(371): a, c, t, g, unknown or other
  misc_feature (361)..(371): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggtcccttttattactgtgcgcgagggcccctatcgagtgactatgatcccaggccctttgactccgtggggccagggaaccctggtcaccgtctcctcagcctccaccgaacgggcccatccggtccttcccccgtggccgccctgcctccaggacgcacctcgagacgcacagcgcctgggctcgcctggcaacggactacgttccgtactgacgctgacggcggctggcaaggcncatagnnnnnnnnnnn

SEQ ID NO: 116199 - DNA, 510 bp, Homo sapiens
  misc_feature: GYAE6OF01A1MDL.14.28.C06.1.454.CMB.1.raw
  modified_base (300)..(300): a, c, t, g, unknown or other
  misc_feature (300)..(300): n is a, c, g, or t
  modified_base (455)..(510): a, c, t, g, unknown or other
  misc_feature (455)..(510): n is a, c, g, or t
tcagcgtctagtaccacgaccggtgctcgatttagagctcacgtattgggtttgggtgccgaagttgctggaggtcacggtcaccacgctgctgaggtctgtgaccgctgcggaccacggtcccttttatactgtgcgcgagggcccctatcgagtgactatgactcccgaggtcccttttgacctccgtggggaccagggaaccctggtccaccgtcctcctcacgccctccaccgaacgggcccctagtccggttcccttcccccgtgggacccgcccttcggcctaccgaagggacncccctaaccgtccggaagacgaccaaccggaccggcccgggtcccgttcggggccttcggtcccctagggtaaccaaggtacccttaaccgtttaccgtaacgtacgaccgtcgaagggcggcggggtccagggaacgaacgggctaacagtacnnnnnnnnnnnnnnnnnnnnnnnnnnnnnnnnnnnnnnnnnnnnnnnnnnnnnnnn

SEQ ID NO: 116200 - DNA, 418 bp, Homo sapiens
  misc_feature: GYAE6OF01CD027.14.28.C06.1.454.CMB.1.raw
  modified_base (410)..(418): a, c, t, g, unknown or other
  misc_feature (410)..(418): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactccgtggggccagggaaccctggtcaccgtctcctcacgcctccaccaacgggcccatccggtccttcccccgtggccgcccctgcctccgaggacgccaccctccggagacggcaacgacggccgggccccgttggggcctcggcccgtagggtaccgaaacgggaccttacctttcccggtaactacggaccgtcgtggagggtccgggctgggacaagggcgcaatagnnnnnnnnn

SEQ ID NO: 116201 - DNA, 421 bp, Homo sapiens
  misc_feature: GYAE6OF01CI9S1.14.28.C06.1.454.CMB.1.raw
  modified_base (217)..(217): a, c, t, g, unknown or other
  misc_feature (217)..(217): n is a, c, g, or t
  modified_base (397)..(421): a, c, t, g, unknown or other
  misc_feature (397)..(421): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggtccctttattactgtgcgcgagggcccctatcgagtgactatgactcccaggtccctttgactccgtggggccagggaccctggtcaccgtctcctcncgcctccaccgaacgggccccattccggttccttcccccctggcccgtcccctgcctccgagggacgccaccgtccgagacgcaacgagccggcccgtgggctcgccgtggtacaaggaccttacgttccgtaactacgaccgtctggacggcgggtctgggacgaagggcgacaagtgnnnnnnnnnnnnnnnnnnnnnnnnn

SEQ ID NO: 116202 - DNA, 350 bp, Homo sapiens
  misc_feature: GYAE6OF02H03AW.14.28.C06.1.454.CMB.1.raw
  modified_base (348)..(350): a, c, t, g, unknown or other
  misc_feature (348)..(350): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttcccctggcgccctgctccaggagcacctccgagagcacagcggccctgggctgcctggtcaaggctacttccgtactagacgctgagcgggctggcaaggcgcatagnnn

SEQ ID NO: 116203 - DNA, 353 bp, Homo sapiens
  misc_feature: GYAE6OF02G1BHN.14.28.C06.1.454.CMB.1.raw
  modified_base (350)..(353): a, c, t, g, unknown or other
  misc_feature (350)..(353): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctgacgccctgctccaggagcacctccgagagcacagcggccctgggctgcctggtcaaggactacttccgtactagacgctgagcgggctggcaaggcgcatagnnnn

SEQ ID NO: 116204 - DNA, 350 bp, Homo sapiens
  misc_feature: GYAE6OF02I4LZT.14.28.C06.1.454.CMB.1.raw
  modified_base (347)..(350): a, c, t, g, unknown or other
  misc_feature (347)..(350): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttcccctggcgccctgctccaggagcacctccgagagcacagcggcctgggctgcctggtcaaggactactccgtactagacgctgagcgggctggcaaggcgcatagnnnn

SEQ ID NO: 116205 - DNA, 351 bp, Homo sapiens
  misc_feature: GYAE6OF02IUHY2.14.28.C06.1.454.CMB.1.raw
  modified_base (349)..(351): a, c, t, g, unknown or other
  misc_feature (349)..(351): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttcccctggcgccctgctccaggagcacctccgagagcacagcggccctgggctgcctggtcaaggactacttccgtactagacgctgagcgggctggcaaggcgcatagnnn

SEQ ID NO: 116206 - DNA, 376 bp, Homo sapiens
  misc_feature: GYAE6OF02H6NYB.14.28.C06.1.454.CMB.1.raw
  modified_base (359)..(376): a, c, t, g, unknown or other
  misc_feature (359)..(376): n is a, c, g, or t
tcagcgtctagtaccacgaccggtgctcgatttagagctcacgtattgggtttgggtgccgaagttgctggaggtcacggtcaccacgctgctgaggtctgtgacccgctgcggacacggccctttattactgtgcgcgagggcccctatcgagtgactatgatcccaggccctttgactcctggggccagggaaccctggtcaccgtctcctcagcctccaccaagggccccatccggtccttcccccgtgggccgccctgcctccaggagccacctccgagacgcacagcggccctgggctgcctggtcaaggctaccttccgactagacgctgagcgggctggcaaggcgcatagnnnnnnnnnnnnnnnnnn

SEQ ID NO: 116207 - DNA, 352 bp, Homo sapiens
  misc_feature: GYAE6OF02HR6ZI.14.28.C06.1.454.CMB.1.raw
  modified_base (349)..(352): a, c, t, g, unknown or other
  misc_feature (349)..(352): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggcccctgggctgcctggtcaaggaccttccgtactagacgctgagcgggctggcaaggcgcatagnnnn

SEQ ID NO: 116208 - DNA, 354 bp, Homo sapiens
  misc_feature: GYAE6OF02G4H9B.14.28.C06.1.454.CMB.1.raw
  modified_base (350)..(354): a, c, t, g, unknown or other
  misc_feature (350)..(354): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacgctgagcgggctggcaaggcgcatagnnnnn

SEQ ID NO: 116209 - DNA, 363 bp, Homo sapiens
  misc_feature: GYAE6OF02JKKCW.14.28.C06.1.454.CMB.1.raw
  modified_base (350)..(350): a, c, t, g, unknown or other
  misc_feature (350)..(350): n is a, c, g, or t
  modified_base (356)..(363): a, c, t, g, unknown or other
  misc_feature (356)..(363): n is a, c, g, or t
tcagcgtctagtaccacgaccggtgctcgatttagagctcacgtattggtttgggtgtccgaagttgctggaggtcacggtcaccacgctgctgaggtctgtgaccgctgcggacacggccctttattactgtgcgcgagggcccctatccgagtgactatgatcccaggccctttgactcctgggccagggaccctggtcaccgtctcctcagcctccaccaagggcccatcggtcttcccctggcacccctcctccaagagcacctctgggggccacagcggccctgggcctgccctggtcaagggctaacttccgtactagacgctgagcgggcctggcaaggcgtnactagnnnnnnnn

SEQ ID NO: 116210 - DNA, 355 bp, Homo sapiens
  misc_feature: GYAE6OF02IKVR2.14.28.C06.1.454.CMB.1.raw
  modified_base (350)..(355): a, c, t, g, unknown or other
  misc_feature (350)..(355): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacgctgagcgggctggcaaggcgcatagnnnnnn

SEQ ID NO: 116211 - DNA, 437 bp, Homo sapiens
  misc_feature: GYAE6OF02H3ECS.14.28.C06.1.454.CMB.1.raw
  modified_base (317)..(317): a, c, t, g, unknown or other
  misc_feature (317)..(317): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (415)..(416): a, c, t, g, unknown or other
  misc_feature (415)..(416): n is a, c, g, or t
  modified_base (418)..(437): a, c, t, g, unknown or other
  misc_feature (418)..(437): n is a, c, g, or t
tcagcgtctagtaccacgaccggtgctcgatttagagctcacgtattggttgggtgccgaagttgctggaggtcacggtcaccacgctgctgaggtctgtgaccgctgcggacacggccctttattactgtgcgcgaggcccctatccgagtgactatgatcccaggccttgactcctgggccagggaaccctggtcacccggtctccctcacgcctccaccaagggccccaatcgggtcctttccccccgtggcccgcccgtcggccttacccgacgggagccgaacccttcccgagacggccacagccggtcccncgggactgcccctggtacaaggacctacgttcccggaacttacggaacgcccgtgaacgcggggctcggacaaggggttccacgtaatacgncgncgnntnnnnnnnnnnnnnnnnnnnn

SEQ ID NO: 116212 - DNA, 362 bp, Homo sapiens
  misc_feature: GYAE6OF02JJJL1.14.28.C06.1.454.CMB.1.raw
  modified_base (351)..(362): a, c, t, g, unknown or other
  misc_feature (351)..(362): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtccttcccctggccgccctgctccaggacgcacctccgagagcacagcggccctggctgcctggtcaaggctacttccgactagacgctgacgcgggctgggcaaggcacatagnnnnnnnnnnnn

SEQ ID NO: 116213 - DNA, 362 bp, Homo sapiens
  misc_feature: GYAE6OF02IY7SD.14.28.C06.1.454.CMB.1.raw
  modified_base (356)..(362): a, c, t, g, unknown or other
  misc_feature (356)..(362): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatccggtccttccccctggccgccctgcctccaggagccacctccgagagcacagcggcccctgggctgcctggtcaaggctacttccgtactagacgctgaggcgggctggcaaggcgcatagnnnnnnn

SEQ ID NO: 116214 - DNA, 370 bp, Homo sapiens
  misc_feature: GYAE6OF02J0YCD.14.28.C06.1.454.CMB.1.raw
  modified_base (353)..(353): a, c, t, g, unknown or other
  misc_feature (353)..(353): n is a, c, g, or t
  modified_base (359)..(370): a, c, t, g, unknown or other
  misc_feature (359)..(370): n is a, c, g, or t
tcagcgtctagtaccacgaccggtgctcgatttagagctcacgtattggtttgggtgccgaagttgctggaggtcacggtcaccacgctgctgaggtctgtgaccgctgcggacacggccctttattactgtgcgcgagggcccctatcgagtgactatgatcccaggccctttgactcctgggccagggaaccctggtcaccgtctcctcagcctccaccaagggccccatccggtccttccccctggccgccctgcctacccaggacgccacctccgagacgccacagcggccctgggctgcctggtcaaggacctactccgtactagacgctgagcgggctggcaaggcncatagnnnnnnnnnnnn

SEQ ID NO: 116215 - DNA, 352 bp, Homo sapiens
  misc_feature: GYAE6OF02GU4UY.14.28.C06.1.454.CMB.1.raw
  modified_base (350)..(352): a, c, t, g, unknown or other
  misc_feature (350)..(352): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacttccgtactagacgctgagcgggctggcaaggcgcatagnnn

SEQ ID NO: 116216 - DNA, 359 bp, Homo sapiens
  misc_feature: GYAE6OF02IU44Q.14.28.C06.1.454.CMB.1.raw
  modified_base (351)..(359): a, c, t, g, unknown or other
  misc_feature (351)..(359): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatccggtccttccccctggccgccctgcctccaggagccacctccgagagcacagcggcctgggctgcctggtcaaggctactccgtactagacgctgagcggctggcaaggcgcatagnnnnnnnnn

SEQ ID NO: 116217 - DNA, 353 bp, Homo sapiens; identical to SEQ ID NO: 116182
  misc_feature: GYAE6OF02FTRSN.14.28.C06.1.454.CMB.1.raw
  modified_base (350)..(353): a, c, t, g, unknown or other
  misc_feature (350)..(353): n is a, c, g, or t

SEQ ID NO: 116218 - DNA, 358 bp, Homo sapiens
  misc_feature: GYAE6OF02G5AMK.14.28.C06.1.454.CMB.1.raw
  modified_base (352)..(358): a, c, t, g, unknown or other
  misc_feature (352)..(358): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggcgccctgctccaggagcacctccgagagcacagcggccctgggctgcctggtcaaggactacgtccgtactagacgctgacgcgggctgggcaaggcgcatagnnnnnnn

SEQ ID NO: 116219 - DNA, 358 bp, Homo sapiens
  misc_feature: GYAE6OF02GGQWH.14.28.C06.1.454.CMB.1.raw
  modified_base (346)..(346): a, c, t, g, unknown or other
  misc_feature (346)..(346): n is a, c, g, or t
  modified_base (352)..(358): a, c, t, g, unknown or other
  misc_feature (352)..(358): n is a, c, g, or t
tcagcgtctagtaccacgaccggtgctcgatttagagctcacgtattgggtttgggtgccgaagttgctggaggtcacggtcaccacgatgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggccgccctgctccaggagcacctccgagagcacagcggccctgggctgcctggtcaaggactacttccgtactagacgctgaggcgggctggcaaggcncatagnnnnnnn

SEQ ID NO: 116220 - DNA, 369 bp, Homo sapiens
  misc_feature: GYAE6OF02H4KM5.14.28.C06.1.454.CMB.1.raw
  modified_base (273)..(273): a, c, t, g, unknown or other
  misc_feature (273)..(273): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (365)..(369): a, c, t, g, unknown or other
  misc_feature (365)..(369): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggcccttttattactgtgcgcgagggcccctatcgagtgactatgatcccaggccctttgactccgtggggccagggaaccctggtccaccgtctcctcacgcctccaccaagggcccatcggtcttccacctggccgcccctgctcccgaggacnccaccctccgagacgcacaggccggcccctgggcctgccttggtacaaggctacttccgtactagacgctgaggcggctggnaggcnatagnnnnn

SEQ ID NO: 116221 - DNA, 367 bp, Homo sapiens
  misc_feature: GYAE6OF02JFDZ4.14.28.C06.1.454.CMB.1.raw
  modified_base (354)..(367): a, c, t, g, unknown or other
  misc_feature (354)..(367): n is a, c, g, or t
tcagcgtctagtaccacgaccggtgctcgatttagagctcacgtattgggtttgggtgccgaagttgctggaggtcacggtcaccacgctgctgaggtctgtgaccgctgcggacacggccctttattactgtgcgcgagggcccctatcgagtgactatgatcccaggccctttgactcctggggccagggaaccctggtcaccgtctcctcagcctccaccaagggcccatcggtcttccccctggccgccctgcctccaggagcaccctccgagagcacagcggcccctgggctgcctggtcaaggactacttccgtactagacgctgagcgggctggcaaggcgcatagnnnnnnnnnnnnnn

SEQ ID NO: 116222 - DNA, 450 bp, Homo sapiens
  misc_feature: GYAE6OF02JD7H2.14.28.C06.1.454.CMB.1.raw
  modified_base (283)..(283): a, c, t, g, unknown or other
  misc_feature (283)..(283): n is a, c, g, or t
  modified_base (419)..(450): a, c, t, g, unknown or other
  misc_feature (419)..(450): n is a, c, g, or t
tcagcgtctagtaccacgaccggtgctcgatttagagctcacgtattgggtttgggtgccgaagttgctggaggtcacggtcaccacgctgctgagggagtagagtcctgaggtctgtgaccgctgcggacacggccctttattactgtgcgcgagggcccctatcgagtgactatgactcccaggtccctttgactccgtggggccacgggaaccctggtacaccgtcctcctcacgccctccgaaccgaacgggccctagttcccggtcctttccccccgnggcccgcccctcgcctccgaggacgcaccctccgagacgcacgagcccgggccctggggacctgcccgtggtacaaggtcctacgtttccgactagcgccgtgacggccggtcgtggacgaaggccgacagtacgnnnnnnnnnnnnnnnnnnnnnnnnnnnnnnnn

SEQ ID NO: 116223 - DNA, 482 bp, Homo sapiens
  misc_feature: GYAE6OF02FU6UD.14.28.C06.1.454.CMB.1.raw
  modified_base (430)..(432): a, c, t, g, unknown or other
  misc_feature (430)..(432): n is a, c, g, or t
  modified_base (434)..(482): a, c, t, g, unknown or other
  misc_feature (434)..(482): n is a, c, g, or t
tcagcgtctagtaccacgaccggtgctcgatttagagctcacgtattggggtttgggtgccgaagttgctggaggtcacggtcaccacgctgctgaggtctgtgaccgctgcggacacggccctttattactgtgcgcgacgggcccctatcggagtgactatgactcccaggccctttgactccgtggggccgagggaaccctggtccaccgtctccctcacgccctcccaccgacgggcccagtccggttccttccccgtggcccgccccttgcctccgagggacgccacccgtaccgacgacgccacgacggccggccccgtgggtcctcgtcctcggggtacaacgggtaccttacccgttacccggttacgtacggacgtcctggggacgggcggggcctgggacaacggggccacgtagtacgnnngnnnnnnnnnnnnnnnnnnnnnnnnnnnnnnnnnnnnnnnnnnnnnnnnn

SEQ ID NO: 116224 - DNA, 165 bp, Homo sapiens
  misc_feature: GYAE6OF01APXWE.45.37.D04.1.454.CMB.1.raw
  modified_base (116)..(116): a, c, t, g, unknown or other
  misc_feature (116)..(116): n is a, c, g, or t
  modified_base (137)..(165): a, c, t, g, unknown or other
  misc_feature (137)..(165): n is a, c, g, or t
tcagacgcgatcgacacgaccggtgctcgatttagtagcatactgttgggtttgggtgctgggcacagcggccctgggctgcctggtcaaggactacttcctcgatcgcgtctgancgggctggcaaggcgcatagnnnnnnnnnnnnnnnnnnnnnnnnnnnnn

SEQ ID NO: 116225 - DNA, 213 bp, Homo sapiens
  misc_feature: GYAE6OF01A1BMJ.45.37.D04.1.454.CMB.1.raw
  modified_base (172)..(213): a, c, t, g, unknown or other
  misc_feature (172)..(213): n is a, c, g, or t
tcagacgcgatcgacacgaccggtgctcgatttagtagcatactgttgggtttggggaagaggaagactgacggtccccaggagttcaggtgctgggcacagcggccctgggctgcctggtcaaggactacttcctcgatcgacgtctgagcgggctggcaaggcgcatagnnnnnnnnnnnnnnnnnnnnnnnnnnnnnnnnnnnnnnnnnn

SEQ ID NO: 116226 - DNA, 137 bp, Homo sapiens
  misc_feature: GYAE6OF01AQLMM.45.37.D04.1.454.CMB.1.raw
  modified_base (137)..(137): a, c, t, g, unknown or other
  misc_feature (137)..(137): n is a, c, g, or t
tcagacgcgatcgacacgaccggtgctcgatttagtagcatactgttgggtttgggtgctgggcacagcggccctgggctgcctggtcaaggactacttcctcgatcgcgtctgagcgggctggcaaggcgcatagn

SEQ ID NO: 116227 - DNA, 494 bp, Homo sapiens
  misc_feature: GYAE6OF01BQPSC.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttactgggcatctacccgggaatccggggtccctgaccgattcagtggcagcgggtctgggacagatttcactctcaccatcagcagcctgcaggctgaagatgtggcagtttatgctgtcagctaatattattatattcctccgactttcggccctggaccaagtggatatacaacgatgtgctcg

SEQ ID NO: 116228 - DNA, 501 bp, Homo sapiens
  misc_feature: GYAE6OF01AX1IP.45.37.D04.1.454.CMB.1.raw
  modified_base (312)..(312): a, c, t, g, unknown or other
  misc_feature (312)..(312): n is a, c, g, or t
  modified_base (407)..(407): a, c, t, g, unknown or other
  misc_feature (407)..(407): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttacngggcatctacccgggaatccggggtccctgaccgattcagtggcagcgggtctgggacagatttcactctcaccatcagcagcctgcagctgaangtgtggctagtttatgctgtcagctaatattattatacttcctcgtactttcggccctagggacctaagtgatactacaacgaactgtgctacg

SEQ ID NO: 116229 - DNA, 503 bp, Homo sapiens
  misc_feature: GYAE6OF01AWSKE.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtcctgaccgattcagtggcagcgggtctgggacagatttcactctcaccatcagcagcctgcaggctgaagatgtggctagtttatgctgtcagactaatattattatacttcctccgtactttccggccctagggaccaaagtgatatacaaacgatgtgctacg

SEQ ID NO: 116230 - DNA, 501 bp, Homo sapiens
  misc_feature: GYAE6OF01BM6TO.45.37.D04.1.454.CMB.1.raw
  modified_base (311)..(311): a, c, t, g, unknown or other
  misc_feature (311)..(311): n is a, c, g, or t
  modified_base (497)..(497): a, c, t, g, unknown or other
  misc_feature (497)..(497): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctctaagctgctcatttacngggcatctaccggaatccgggtcctgaccgattcagtgcagcggtctgggacagatttcactctcaccatcagcagcctgcagctagagatgtggctagtttatgctgtcagtctaagttattattatacttctccgtactttccggcctggaacctaagtcgtatacgtacaaacgtatcgtggntacg

SEQ ID NO: 116231 - DNA, 504 bp, Homo sapiens
  misc_feature: GYAE6OF01AYBCX.45.37.D04.1.454.CMB.1.raw
  modified_base (312)..(312): a, c, t, g, unknown or other
  misc_feature (312)..(312): n is a, c, g, or t
  modified_base (408)..(408): a, c, t, g, unknown or other
  misc_feature (408)..(408): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttacngggcatctacccgggaatccggggtcctgaccgattcagtggcagcgggtctgggacagatttcactctcaccatcagcagcctgcaggctgaagntgtggctagtttatgctgtcagcaatattattatattcctccgacctttcggcccttgggacctaaaggtgaatactacaaacgaatgtggctcgg

SEQ ID NO: 116232 - DNA, 511 bp, Homo sapiens
  misc_feature: GYAE6OF01CZVZG.45.37.D04.1.454.CMB.1.raw
  modified_base (413)..(413): a, c, t, g, unknown or other
  misc_feature (413)..(413): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactacttagcttaggtaccagacagaaaccaggtcagcctcctaagctgctcatttactgggcatctacccgggaatccggggtccctgaccgattcagtggcaggcgggtctgggacagtatttcactctcaccatcagcagcctgcagctgaagntgtgactagtttatgctgtcagactaattattattatacttcctaccgtacttccggccgtggaacctaagtgaatatacaaacgtactgtggctacg

SEQ ID NO: 116233 - DNA, 509 bp, Homo sapiens
  misc_feature: GYAE6OF01CW5OY.45.37.D04.1.454.CMB.1.raw
  modified_base (408)..(408): a, c, t, g, unknown or other
  misc_feature (408)..(408): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttactgggcatctacccgggaatccggggtcctgaccgattcagtggcagcgggtctgggacagtattcactctcaccatcagcagcctgcaggctgaagntgtggctagtttatgctgcagctaattattattatacttcctaccgtctttccggccctgggaaccctaaagtcggaatacgtacaaacgtatgtgctacg

SEQ ID NO: 116234 - DNA, 500 bp, Homo sapiens
  misc_feature: GYAE6OF01EGAHO.45.37.D04.1.454.CMB.1.raw
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaacctaacaatggtggcacaaactatgcacagaagtttcgagggcagggtcaccatgaccagggacacgtccatcagcacacgcctacatggagctgagcagactgacatctagacgacacggcctatttatatgtgcgaggattggttaccggtggtcgttggttccgtttagg

SEQ ID NO: 116235 - DNA, 583 bp, Homo sapiens
  misc_feature: GYAE6OF01B4D68.45.37.D04.1.454.CMB.1.raw
tcagacgcgatcgacacgaccggtgctcgatttagtagcatactgttgggtttgggggagcatcacccagcaaccacatctgtcctctagagaatcccctgagagcgtccgttcctcaccatggactggacctggaggatcctcttcttggtggcagcagccacaagagcccactcccaggtgcagctggtgcagtctggggctgaggtgaggaagcctggggcctcgagtgaaggtctcctgcaaggcttctggctacaccttcaccggcgactatctccactgggtgcgacaggcccctggacgaagggcttgagtggatgggatggatcaaaccctaacaagtggtggacaacaaactatagacaacagtaagtttcgaagggcacggggtcaacccgagtacgaccgaggggacctaccgtccaataccagccaacgacgcctaacgagttcgggacgtcgtagacgacgaagacctaggaacctatccgtagaccgacaccggtacctatttattaccgtgtacggaccggtaaggtacttaggtttacccgggtggttcgtttcgggtttttacccg

SEQ ID NO: 116236 - DNA, 169 bp, Homo sapiens
  misc_feature: GYAE6OF01C18OT.45.37.D04.1.454.CMB.1.raw
  modified_base (110)..(110): a, c, t, g, unknown or other
  misc_feature (110)..(110): n is a, c, g, or t
  modified_base (131)..(169): a, c, t, g, unknown or other
  misc_feature (131)..(169): n is a, c, g, or t
tcagacgcgatcgacacgaccggtgctcgatttagtagcatactgttggggtttgggcacagcggccctgggctgcctggtcaaggctatttcctcgatcgcgtctggancgggctggcaaggcggcatgnnnnnnnnnnnnnnnnnnnnnnnnnnnnnnnnnnnnnnn

SEQ ID NO: 116237 - DNA, 131 bp, Homo sapiens
  misc_feature: GYAE6OF01D09H6.45.37.D04.1.454.CMB.1.raw
  modified_base (130)..(131): a, c, t, g, unknown or other
  misc_feature (130)..(131): n is a, c, g, or t
tcagacgcgatcgacacgaccggtgctcgatttagtagcatactgttgggtttgggcacagcggccctgggctgcctggtcaaggactacttcctcgatcgcgtctgagcgggctggcaaggcgcatagnn

SEQ ID NO: 116238 - DNA, 489 bp, Homo sapiens
  misc_feature: GYAE6OF01BQQ7E.45.37.D04.1.454.CMB.1.raw
  modified_base (485)..(485): a, c, t, g, unknown or other
  misc_feature (485)..(485): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctctaagctgctcatttactgggcatctacccgggaatccggggtcctgaccgattcagtggcagcggtctgggacagatttcactctcaccatcagcagcctgcaggctgaagatgtgctagtttatgctgtcagcaatattattatattctcgactttcgccctggaccaagtgatatacaaacgatgtgntacg

SEQ ID NO: 116239 - DNA, 541 bp, Homo sapiens
  misc_feature: GYAE6OF01CYCST.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccacgtgggtgcgacacggccctggacaagggcttgagtggagtgggatggatacgaaccctaacaagtggtggacaacaaactatgcaacagtaagtttcgagggcagggtcacatcgacgaggacacgtcatcagcacagcctacgatggagcgtagacgcagactgacatacgtgaccgacacggtacctaagtttattacgtgttacgacggtagggtacgttacgggtttaccgggttcggtcgtttcggtttttacccg

SEQ ID NO: 116240 - DNA, 529 bp, Homo sapiens
  misc_feature: GYAE6OF01AXVHR.45.37.D04.1.454.CMB.1.raw
  modified_base (314)..(314): a, c, t, g, unknown or other
  misc_feature (314)..(314): n is a, c, g, or t
  modified_base (413)..(413): a, c, t, g, unknown or other
  misc_feature (413)..(413): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataaagaactacttagcttggtaccagcagaaaccaggtcagcctcctaagctgctcatttacngggcatcctacccgggaatccggggtccctgaccgattcagtggcagcgggtctgggacagactttcactctcaccatcagcagcctgcaggctgaagntgtggctagtttatgactgtcagactaatattattatattcccttccgtacctttccgggcccttagggaaccctaaaggtcggaattaacgtacaaacgtaactgtcggtctacg

SEQ ID NO: 116241 - DNA, 551 bp, Homo sapiens
  misc_feature: GYAE6OF01DWV94.45.37.D04.1.454.CMB.1.raw
  modified_base (417)..(417): a, c, t, g, unknown or other
  misc_feature (417)..(417): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcaagaaaccaggtcagcctcctaagctgctcatttactgggcatccgtacccgggaatccggggtccctgaccgattccagtggcagcggggtctgggacaggatttcactctcaccatcagcagcctgccaggctgaagntgtgctagtttatgtctgtcagtacaattattattattactttccctcccgttactttccggccccgttaggggaaccctaaaaggttcgggtaattaacgtaccctaaaacggtaccttacggtggtctacgg

SEQ ID NO: 116242 - DNA, 540 bp, Homo sapiens
  misc_feature: GYAE6OF01DQ0NG.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactacttagcttggtaccagcagaaccaggtcagcctcctaagctgctcatttactgggcactccgtacccgggaatccggggtcctgaccgattcgagtggcagcgggtctgggacagtatttcactctcaccatcagcagcctgcaggctagaagtgtgtgtctagtttatgctgtcagactaattattattatacttcctaccgttacgttcccggccgtacgggaacctaaaggtacggtaattaacgtaccgtaaaacgtagttcgggtggtctaccgg

SEQ ID NO: 116243 - DNA, 736 bp, Homo sapiens
  misc_feature: GYAE6OF01CN9SN.45.37.D04.1.454.CMB.1.raw
tcagacgcgatcgacacgaccggtgctcgatttagtagcatactgttgggtttgggggagctacaacaggcaggcgaggggcagcaagatggtgttgtagacccaggtcttctatttctctgttgctctggatctctggtgccgtacggggacatcgtgatgacccagtctccagacctccctggctgtgtctcgtgggcgagagggccaccatcaactgcaagtccagccagtagttagttttagacagctaccaaacaaataaagaacctaacttagctttacggtaaccagacaacgaaacccgaggtacacgccctacctaagctgctactatttacgtgggacatccgtaaccgggaacgtccggggtcctgaccgattcgagtcggcgaggcggtcgtgggacagtactttcactcctacaacctactacgagaccacggtcctcggacgacggtactagggaaacgtagttcggtacggtaccgtttaaggttttaacgttcggtacccgtttaggtaccgtaacgggtaaccttaaattttaattttaaacttttacttaaccgttttacccccttacccgggttaacccgtttttcccggggaacccccggtttaacgggggtaaaacccccgttaaaaaggggttccgggtaaaacgtttaaacgttaaacccggtaaaaacccggttaacgttacgggttaaccggggtcttaccgggtaacccc

SEQ ID NO: 116244 - DNA, 600 bp, Homo sapiens
  misc_feature: GYAE6OF01CL2OW.45.37.D04.1.454.CMB.1.raw
  modified_base (320)..(320): a, c, t, g, unknown or other
  misc_feature (320)..(320): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctctgggcgagaggccaccatcaactgcaagtccagccagagttgtttagacagctccaacaataagaactacttagcttaggtaccagacaagaaaccaggtacacgcctacctaagctgctcatttacgngggacatccgacccgggaatccggggtccctgaccgattcagtgcaggcgggtctgggacagtactttcactctacacatcagtcagcctagcaggctaggaagacgttggtcggtctaagttttagttcggtcttgtaccgtagtactaaatttaatttattaacttaacctttcccgtacccggttaaccgttttcccgggacccgttacgggaacccgtaaaggtacgggtaacttaacgttaaccgtaaaacgttacgtacggttggtaccgtacg

SEQ ID NO: 116245 - DNA, 565 bp, Homo sapiens
  misc_feature: GYAE6OF01ECUN9.45.37.D04.1.454.CMB.1.raw
  modified_base (426)..(426): a, c, t, g, unknown or other
  misc_feature (426)..(426): n is a, c, g, or t
  modified_base (560)..(560): a, c, t, g, unknown or other
  misc_feature (560)..(560): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttttacggccccaatagtaagaactacttagcttggtaccagcagaacgccagggcacgcctcctagcctgcttcttttacgcgggtcctcgtacccgggacgtcccggggtccctgaccgtattcgagtcggcgaggcgggtcgtgggacagtacttcactctcaccatcagcagcctgcaggctagaagntggtgactagtttatgtctgtcagtactaattattatttactacttcccgtaccgtacgtttccggccctagggaacctaaaggtcgtaatacgtaccgaaaacgtacgttcggtcggactacggacctacgtnttccg

SEQ ID NO: 116246 - DNA, 516 bp, Homo sapiens
  misc_feature: GYAE6OF01EOQCC.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatgggatcaaccctaacaatggtggcaacaaactatgactacagtaagtttcgagggcagggtcaccatacgacagggacacggtccatcagcacagcctacagtggagctagagcaagactgactatcgtagacgacacggccctatttatactgtgcgaaggtattggttaaccggtggtcgttggtttccg

SEQ ID NO: 116247 - DNA, 547 bp, Homo sapiens
  misc_feature: GYAE6OF01DOQYY.45.37.D04.1.454.CMB.1.raw
  modified_base (310)..(310): a, c, t, g, unknown or other
  misc_feature (310)..(310): n is a, c, g, or t
  modified_base (411)..(411): a, c, t, g, unknown or other
  misc_feature (411)..(411): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactactagcttggtaccagcaagaaaccaggtcagcctcctaagctgctcatttacnggcatccgtacccgggaatcccggggtcctgaccgattcagtgcaggcgggtctgggacagtatttcactctacacactcagcagcctgcaggctagaagntgtggctagtttatgctgtacagtactaattactttattacttacttcccttaccgtaccgtttccggacccgttagggtaaccctaaaggttcggaaattacgtaaccgaaacgtaacttggtcggtctggaccc

SEQ ID NO: 116248 - DNA, 511 bp, Homo sapiens
  misc_feature: GYAE6OF01D4PBK.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtcctgaccgattcagtggcagcgggtctgggacagatttcactctcaccatcagcagcctgcaggctgaagatcgtgctagtttatgctgtacagctaattattattatattcctccgtactttcggcccttgggacctaaaggtcggataactcaaaacgaacgtgtgctacg

SEQ ID NO: 116249 - DNA, 585 bp, Homo sapiens
  misc_feature: GYAE6OF01C93JR.45.37.D04.1.454.CMB.1.raw
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
  modified_base (568)..(569): a, c, t, g, unknown or other
  misc_feature (568)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (578)..(578): a, c, t, g, unknown or other
  misc_feature (578)..(578): n is a, c, g, or t
  modified_base (580)..(581): a, c, t, g, unknown or other
  misc_feature (580)..(581): n is a, c, g, or t
  modified_base (583)..(584): a, c, t, g, unknown or other
  misc_feature (583)..(584): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggctcagtgaaggtctcctgcaaggcttctggctacaccttcacccggcgactatctccactgggtgcgacacggcccctggacaagggcttagagtggatgggaaatggactcaaaccctaagaatgggtaggacaacgaaactatagacaacaagtaagtttacgagggaccagggtcaaccagtacgaaccgagggaacctaaccggtcccaagttaccgaacggaccaaccgaacgtaccccgttaacacggttacgggaacggtacccgttagggaacgggcccggggtaccgtaggggaccgaaacggggccgtaaccggaataaggccgagacgngangnngngngngananngnng

SEQ ID NO: 116250 - DNA, 497 bp, Homo sapiens
  misc_feature: GYAE6OF01CHVF3.45.37.D04.1.454.CMB.1.raw
  modified_base (448)..(448): a, c, t, g, unknown or other
  misc_feature (448)..(448): n is a, c, g, or t
  modified_base (493)..(493): a, c, t, g, unknown or other
  misc_feature (493)..(493): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtccctgaccgattcagtggcagcgggtctgggacagatttcactctcaccatcaagcagcctgcaggctagaacgatgtggcagtttatgactgtcagcaatattataatnttcctcgactttcgccctggaccaaagtggatatcaaagatgtgntacg

SEQ ID NO: 116251 - DNA, 578 bp, Homo sapiens
  misc_feature: GYAE6OF01A26W3.45.37.D04.1.454.CMB.1.raw
  modified_base (314)..(314): a, c, t, g, unknown or other
  misc_feature (314)..(314): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttagacagctccaacaataagaactacttagcttggtaccagcaagaaaccaggtcagcctacctaagctgctcatttacngggcactctacccgggaatccggggtccctgaccgattcagtggcaggcgggtctgggacagatttcactctcaccatcagtcagcctgcaggctagaagatggtcggtctaagttttatgacttgtacagtctaaattattattaacttactttccccgttaccgttaaccgttttccgggcccgttaggggtaaccctaaaaggttacggtacttaaacggttaaccaaaaccggttaacgtcggttacgggtccttaccgg

SEQ ID NO: 116252 - DNA, 558 bp, Homo sapiens
  misc_feature: GYAE6OF01EICRS.45.37.D04.1.454.CMB.1.raw
  modified_base (316)..(316): a, c, t, g, unknown or other
  misc_feature (316)..(316): n is a, c, g, or t
tcagacgcgatcgacacgaccggtgctcgatttagtagcatactgttgggtttgggggaggctacaacaggcaggcaggggcagcaagatggtgttgcagacccaggtcttcatttctctgttgctctggatctctggtgcctacggggacatcgtgatgacccagtctccagactcccctggctgtgtctctgggcgagagggccaccatcaactgcaagtccagccagagtgttttagacagctccaacaataagaactacttagcttggtaccagacagaaaccaggtcagcctactaagctgctcatttacnggcatcgacccggaagtccgggtcctgaccgattcgagtgcagcgggtctgggacagtatttcactctacaccatcagcacgcctgccaggctagaagtatggtggtactagtttagtcgcttgtctaagactaaagtttacttaattatactttcccttacccgtaccgttttcccggtcccgtagggtaacctaaagggtacgtattaacgtaccgaaacgtaacgttgtggcttaccgg

SEQ ID NO: 116253 - DNA, 542 bp, Homo sapiens
  misc_feature: GYAE6OF01CF5IZ.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttactgggcatccgtacccgggaatcccggggtcctgaccgtattcaggtcggcgaggcgggtctgggacagtatttcgactctcaccatcagcacgcctgcaggctagaagagtcgtcgctagtttactacgtgtacagtactaattattatagaagtcttcctctacctacgtttccgggacggtaacgggcctaaggtcgacggtactaaccgaaacgtacgtggtcgtacg

SEQ ID NO: 116254 - DNA, 524 bp, Homo sapiens
  misc_feature: GYAE6OF01ECH8V.45.37.D04.1.454.CMB.1.raw
  modified_base (504)..(504): a, c, t, g, unknown or other
  misc_feature (504)..(504): n is a, c, g, or t
  modified_base (520)..(520): a, c, t, g, unknown or other
  misc_feature (520)..(520): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagcctccaacaataagaactacttagcttggtaccagcagaaaccaggtcagcctcctaaagctgctctattttacgtgggcatccgtaacccgggaacgtcccgggggtcccctcggacccgtattcaggtcggcaggcgggtcgtgggacagtatttcactcgtcaccatcagcagcctgcaggctagaagatgtgctagtttatacgtgtcagtctaatattatagtactcgtactactttgccgtagggacacgctgganatacaaacgaatgtgntacg

SEQ ID NO: 116255 - DNA, 498 bp, Homo sapiens
  misc_feature: GYAE6OF01EQJA3.45.37.D04.1.454.CMB.1.raw
  modified_base (414)..(414): a, c, t, g, unknown or other
  misc_feature (414)..(414): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaacctaacaatggtggcacaaactatgcacagaagtttcagggcagggtcacatgacagggacacgtccatcagcacagcctanatggagctgagcagactgactatctagacgacacggcctatttactctgtgcgtaggtattggtttaccggtggtcgtttcggg

SEQ ID NO: 116256 - DNA, 546 bp, Homo sapiens
  misc_feature: GYAE6OF01A7JAV.45.37.D04.1.454.CMB.1.raw
  modified_base (422)..(422): a, c, t, g, unknown or other
  misc_feature (422)..(422): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggatacaccttcaccggctactatatacactgggtgcgacaggcccctggacaagggcttgagtggagtgggatggatcaacctaacaagtgggtggacaacaaactatgacacagaagtttcgagggcaggtcacagtgaccgaggacacgtcatcagacacagcctacntaggagctagagcgagctagagactcgtaggaccgacgacgggtccgttaggtaacttacggtggttacggcggaacggtacgggacgtaagggttaacgtttaccggttaggtttttacgggg

SEQ ID NO: 116257 - DNA, 525 bp, Homo sapiens
  misc_feature: GYAE6OF01A8OCL.45.37.D04.1.454.CMB.1.raw
  modified_base (310)..(310): a, c, t, g, unknown or other
  misc_feature (310)..(310): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcaagctgctcatttacngggcatcgtacccgggaatccggggtccctgaccgtattcgagtggaagcgggtctaggggacagtactttcactctcaccatcagcagcctgcaggctagaagtatgtggctagtttattgctgtcagtactaattattattatacttcctccgtacgtttccggcccgtaggtaccaaggtggataactacgtaaacgactaggtcgctgacc

SEQ ID NO: 116258 - DNA, 518 bp, Homo sapiens
  misc_feature: GYAE6OF01CR9WD.45.37.D04.1.454.CMB.1.raw
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaaactgcaagtccagccagagtgttttagacagctccaaacaataaagaactacttaagcttggtaccagcaagaaaccaggtcaagcctcctaagcctgctcatttactgggcatctacccggaatccggggtcctgaccgattcgagtggcagcgggtctgggacagtattcactctcaccatcagcagcctgcagctgaanatgngcagtttatgctgtcagacaagttattattatattcccgtcgtactttccggccctagggaaccctaaaggtggataataccaaacgaagtgtggctacg

SEQ ID NO: 116259 - DNA, 617 bp, Homo sapiens
  misc_feature: GYAE6OF01ALVJA.45.37.D04.1.454.CMB.1.raw
tcagacgcgatcgacacgaccggtgctcgatttagtagcatactgttgggtttgggggtcgtacaacaggcaggcaggggcgagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgttttagacagctccaacaataagaactacttagcttaggtaccagcacgaaaccaggtacagcctcctaagctgctactatttacgtgggacataccgtacccgggaactcccggggtccctacgaccgtacttcgagtggcaggtcgggtcgtagggactaggtactttcacttcctacacccatcagctacgccctgcacgggtctaggaagtctaggttcggacttaggttttactggtccttcggtaccagtaccttaaattagtttattacggaattacctttcccgtaccttacggttaaccgtttcgggggacggtaacggggtaacccttagggttcgccggtaattacccgaaaaccggttcgtggtgggtccc

SEQ ID NO: 116260 - DNA, 525 bp, Homo sapiens
  misc_feature: GYAE6OF01ERIFA.45.37.D04.1.454.CMB.1.raw
  modified_base (313)..(313): a, c, t, g, unknown or other
  misc_feature (313)..(313): n is a, c, g, or t
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcaagaaaccaggtcagcctccaagctgctctatttacnggcatccgtacccgggatccggggtccngaccgattcagtgcagcgggtcngggacagtatttcactctcaccatcagcagcctgcaggctgaagtatgtggctagtttatgtctgtcagtctaattatattatacttcctaccgtactttccggcccgtaggaaccctaaaggtggtaactacgtacgaaaacgtacttcggtggtctacg

SEQ ID NO: 116261 - DNA, 531 bp, Homo sapiens
  misc_feature: GYAE6OF01AKGQL.45.37.D04.1.454.CMB.1.raw
  modified_base (314)..(314): a, c, t, g, unknown or other
  misc_feature (314)..(314): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
tcagacgcgatcgacacgaccggtgctcgatttagtagcatactgttgggtttgggggagctacaacaggcaggcaggggcagcaagatggtgttgcagactcaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttacgngggcatccgtacccgggtaactcccggggtccctgacccgtattcgaggtggcgaggcgggtcgtgggacaggtactttcactctcaccatcagcagcctgcaggctgagntgtgctagtttntgctgtcagtactaattattattatcttccctaccgtaccgttccggaccgtagggacctaaaggtgactacgtacaaacgtacgtgtggtccg

SEQ ID NO: 116262 - DNA, 517 bp, Homo sapiens
  misc_feature: GYAE6OF01EJGHL.45.37.D04.1.454.CMB.1.raw
  modified_base (312)..(312): a, c, t, g, unknown or other
  misc_feature (312)..(312): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttagacagctccaacaataagaactacttagcttggtaccagcagaaaccaggtcagcctcctaagctgctcatttacnggcatcgtaccgggaatccggggtccctgaccgattcagtggcaggcgggtcgtgggacagtactttcgactctcaccatcagcagcctgcaggctagaagatgtggctagtttatgctggtcagactaataattattattacttcctccgtacgtttccggccctgggacctaaaggtgaatactacaaacgtactgtgctacg

SEQ ID NO: 116263 - DNA, 508 bp, Homo sapiens
  misc_feature: GYAE6OF01A7J12.45.37.D04.1.454.CMB.1.raw
  modified_base (313)..(313): a, c, t, g, unknown or other
  misc_feature (313)..(313): n is a, c, g, or t
tcagacgcgatcgacacgaccggtgctcgatttagtagcatactgttgggtttgggggagctacaacaggcaggcaggggcagcaagatggtgttgtagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttacngggcatctacccgggaatcccggggtcctgaccgattcagtggcaggcgggtctgggacagatttcactctcaccatcagcagcctgcaggctgaagatgtggctagtttattgctgtcagtcaattattattatattccctcgtactttccggccctgggacccaaggtgatatacaaacgactgtggtctgac

SEQ ID NO: 116264 - DNA, 550 bp, Homo sapiens
  misc_feature: GYAE6OF01EMHPB.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactacttagcttggtacagcagaaaccaggtcagcctacctaagctgcctcatttactgggcatcgtacccgggaatcccgggtcctgaccgatcagtgcaggcggtctgggacagtatttcactctcaccatcagcagcctgcaggctgaagatggtgtctagtttatgtctgtcagtataaattatttaacttattacctttaccttacccgtacgtttacccggtcccgttaggggaaccctaaaggtcgtaataacgtactaaacggtaacttggtacggcgtcgtacccg

SEQ ID NO: 116265 - DNA, 503 bp, Homo sapiens
  misc_feature: GYAE6OF01CCLX5.45.37.D04.1.454.CMB.1.raw
  modified_base (397)..(397): a, c, t, g, unknown or other
  misc_feature (397)..(397): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatcgtacccgggaatccggggtcctgaccgattccagtgcaggcgggtctgggacagtatttcactctcaccatcagcancctgcagctgaagntgngctagttntgctgtcagactaatatattatattcctcgtacttcggtaccctggaaccctaagtagtatatacaaacgtactgtgctcg

SEQ ID NO: 116266 - DNA, 651 bp, Homo sapiens
  misc_feature: GYAE6OF01BPUAD.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccacgtgggtgcgacacggcccgtggaccaaggcttgagtggagtgggatggatcaacctaacaagtggtggacaacaaactagtgacacgaagtaacgtttcgaaggggtcaggggtccaaccgtagtacggtaacccgaagggaacctacggtacccaagtaccacggaccaaccgacgtcccgtaacacgttagggaacgtcgtacggaacgtaccgaacggtaactacggaactacgttaccgtacgggaaaccaacccggaccgggtaccctttaattttaaccgtttaaccgttggttaccgggacggttaacgggtaacttttaccgggggttttaacccggtcgggtttcggtttttacccgggg

SEQ ID NO: 116267 - DNA, 505 bp, Homo sapiens
  misc_feature: GYAE6OF01C9M5W.45.37.D04.1.454.CMB.1.raw
  modified_base (411)..(411): a, c, t, g, unknown or other
  misc_feature (411)..(411): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtccctgaccgattcagtggcagcgggtctgggacagtattcactctcaccatcagcagcctgcaggctagaagntgtggctagtttatgctgtcagctaatattattatacttcctccgtactttcggcccgtaggacctaaagtgatatacaaacgatgtgtctacg

SEQ ID NO: 116268 - DNA, 529 bp, Homo sapiens
  misc_feature: GYAE6OF01D67PY.45.37.D04.1.454.CMB.1.raw
  modified_base (314)..(314): a, c, t, g, unknown or other
  misc_feature (314)..(314): n is a, c, g, or t
  modified_base (422)..(422): a, c, t, g, unknown or other
  misc_feature (422)..(422): n is a, c, g, or t
  modified_base (524)..(524): a, c, t, g, unknown or other
  misc_feature (524)..(524): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgaccctgtctccagactccctggctgtgtctctgggcgagagggccaccatcaactgcaagtccagccagtagtgttttagacagctaccaacaataagaactacttagcttggtaccagcagaaaccaggtcagcctctaagctgctcatttacgnggcactccgtacccgggaacgtcccggggtccctgaccgtattcgagtcggcaggcgggtcgtgggacagtatttcactctcaccatcagcacgcctgcagctgagtntgtgctagtttatgctgcagactaatattatatactcctcgtactttccggaccgtagggtaacctaagtcgaattacgtacgaaacgtagttcggtcggtntaccg

SEQ ID NO: 116269 - DNA, 531 bp, Homo sapiens
  misc_feature: GYAE6OF01CA1BX.45.37.D04.1.454.CMB.1.raw
  modified_base (312)..(312): a, c, t, g, unknown or other
  misc_feature (312)..(312): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttacngggcatctacccgggaatccggggtccctgaccgattcagtggcagcgggtctgggacaggtatttcactctcaccatcagcagcctgcaggctgaagntgtggctagtttntgcttgtcagctaagttattattattacttcctccgtactttccggcccgttagggaaccctaaaggttcggaattactacgaaaacgtacgtgtacggtctaccgg

SEQ ID NO: 116270 - DNA, 514 bp, Homo sapiens
  misc_feature: GYAE6OF01DT5M0.45.37.D04.1.454.CMB.1.raw
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctctaagctgctcatttactgggcatctaccgggaatccggggtcctgaccgattcagtgcagcggtcngggacagacttcactctcacntcagcagcctgcaggctagaagatggtgtacagtttatgctgtcagtactaattattaattatactttccctcgtacgttcggacccgtgggtaaccaaggttgattatacgaaacgtacgtgtcggctgtacc

SEQ ID NO: 116271 - DNA, 673 bp, Homo sapiens
  misc_feature: GYAE6OF01CNB5B.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcgagtgaaggtctcctgcaaggtcttcgtggctactaccttccgaccggcgactatcctccacgtggggtcgcgacgaccggccccgtggaacgaagggtcttggaggtggagtgggagtggtactacaaaccctaaacaagtggtagaccgaaacaaactatcgacaacgtagtaacgtttcgagggacgacgggtaccaacgagtacgaaccgaacgggaccaaccggtaccacgtacgacgaccaacgaccgacctacacgttagggacgtacgtaggaaccgcgaagtaccgtagtacctaacttaccggtacgaaaccggaacccgtaacccgggtacctttaagtttttaaaccgtttaccgttacgggtacgggtacggtaaacgggttacgttttaccggggtttttaacccgggtgggtttccggtttttacccgggg

SEQ ID NO: 116272 - DNA, 538 bp, Homo sapiens
  misc_feature: GYAE6OF01EQW1S.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatcgtacccgggaatccggggtccctgaccgattcagtgcaggcgggtctgggacagatttcactctcaccatcagcacgcctgcaggctgaagtatgtggtctagtttattgcttgtcgagactaagttattattatacttcccgtccgtactttccggcccgttaggggtaacctaaaggtcgtataacgtacgtaaaacgtaagtggtcgcgttaacg

SEQ ID NO: 116273 - DNA, 614 bp, Homo sapiens
  misc_feature: GYAE6OF01D86UJ.45.37.D04.1.454.CMB.1.raw
  modified_base (341)..(341): a, c, t, g, unknown or other
  misc_feature (341)..(341): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacgaccttcaccggcgactatctccactgggtgcgacaggcccctggacaagggcttgagtggatgggatggatcaaccctaanaatggtggacaactaaactagtgacacaggtaaagtttcgagggcagggtcaccagtacgacgaggacacggtacccagtcacgacacacgacccttaacagttagggacgtcgttaggaacgtcgaacggtacgttacgacctactaccgttacggaaccgaaacccggtacccgggtacccttaagttttaccgtttaaccgtaggttccgggaccgttagggtaacgtttaccgggttttaaccggggtcggttccggtttttaccgggg

SEQ ID NO: 116274 - DNA, 612 bp, Homo sapiens
  misc_feature: GYAE6OF01EVFGT.45.37.D04.1.454.CMB.1.raw
  modified_base (320)..(320): a, c, t, g, unknown or other
  misc_feature (320)..(320): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataacgaactacttagcttaggtaccagacaagaaaccaggtcagcctacctaagctgctacatttacgnggctatccgtacccgggaactcccggggtccctagaccgtattcgagtcggcaggcgggtcgtggggactaggtactttcacttccgtaccaacctatcgacgcaacgtcctgccgtaggcgtacggaagtagtcggtaggtaccgttagttttactgtacctgtaccgtagtaacctaatttaagttattactactttccgtacccggttacgttttcccgggcccgttagggaaacccttaaaggtacggtaattaacgtaaccgtaaacgtaacgttgtacgtctaccg

SEQ ID NO: 116275 - DNA, 583 bp, Homo sapiens
  misc_feature: GYAE6OF01CFCMY.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataaagaactacttagcttggtaccagcagaaaccaggtcagcctacctaagctgctcatttacgtgggcacgtaccgtacccgggaagtcccggggtccctgaaccgtattcgagtcggcaggcgggtctgggacagtatttcactctcaccatcagcacgccgtgcgaggctagaagtagtggtggtctaggtttagttcgtcgttgtacgtagtactaagttaatttactttaattacttcccgttcccgtaccttttcccgggcccgttacgggaacctaaagggtacggtaattaacgtaacgaaacgtaacgtggttcggtctccg

SEQ ID NO: 116276 - DNA, 607 bp, Homo sapiens
  misc_feature: GYAE6OF01BT8ZZ.45.37.D04.1.454.CMB.1.raw
  modified_base (316)..(316): a, c, t, g, unknown or other
  misc_feature (316)..(316): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcaagaaaccaggtcacgcctacctaagctgctctatttacngggcagtacctaacccgggaatcccggggtccctggaccgtattcgaggtggcgaggcgggtcgtgggaacaggtactttcaccttctaccaccatcagcagcctgcgaggctagaacgagtgtggtactagtttagtcgtcttcgtactagtactaattacttattacttacttcccgttaccgttaaccgtttccgggtacccgttaagggtaaacccttaaagggtacggttaacttaaaccgttaaccgtaaaaccggtaacggtttcggtacgggtccgtaaccgg

SEQ ID NO: 116277 - DNA, 547 bp, Homo sapiens
  misc_feature: GYAE6OF01E0HQI.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcacgcctctaagctgctcatttactgggcatcctacccgggaatccggggtccctgaccgattcagtcggcaggcgggtctgggacagtatttcactctcaccatcagcagcctgcaggctagaagtagtgtaggtctaggttttactgtctgtcagactaattatttattaatacttcccgtccgtaaccgtttcggccccgtaggggtaaccctaaaggtcggaattaacgtacgtaaacgtaactcggtggcgtcg

SEQ ID NO: 116278 - DNA, 584 bp, Homo sapiens
  misc_feature: GYAE6OF01BXVKZ.45.37.D04.1.454.CMB.1.raw
  modified_base (313)..(313): a, c, t, g, unknown or other
  misc_feature (313)..(313): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactacttagcttggtaccagcaagaaaccaggtcagcctactaagctgctcatttacgngggctatccgtacccgggaacgtccggggtccctgaccgtattcgaggtggcgaggcggtcgtgggacagtatttcacttctccaccatcacgccagcctgcacggctagaagtatggtggtactaaggttttatcgtcgttagtcgtaagtactaacttagtttattactaccgtttcccgttacccggttacgtttcccgggcccgttaggaaccgtaaaggttcggaaattaacgtaaccgtaaacgtagtttcggtaggtcctaccg

SEQ ID NO: 116279 - DNA, 563 bp, Homo sapiens
  misc_feature: GYAE6OF01ACF3Q.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggccctggacaagggcttgagtggatgggatgggatcaaccctaacatggtggcacaaactatgcaacagtaagtttcagggcagggtcaccatgaccagggacacgtaccatcagcacacgacctacagttgggacgcgtagagacaagactaggacagtccgtggaaccgaccgaccgggtaccttaagttttaacgttaccgttggtacgtacgggtaagggttacgtttacgggttttaacccgggtgggttccgttttaccgggg

SEQ ID NO: 116280 - DNA, 491 bp, Homo sapiens
  misc_feature: GYAE6OF01BQ4LP.45.37.D04.1.454.CMB.1.raw
  modified_base (311)..(311): a, c, t, g, unknown or other
  misc_feature (311)..(311): n is a, c, g, or t
  modified_base (478)..(478): a, c, t, g, unknown or other
  misc_feature (478)..(478): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactactagcttggtaccagcagaaaccaggtcagcctctaagctgctcatttacngggcatctacccggaatccggggtcctgaccgattcagtggcaggcgggtctgggacagatttcactctcaccatcagcagcctgcaggctggaagtatgtggctagtttattgctgtcagactaatattattatacttcctcgtacttcgcctggacaagtgatanacaacatgtgctg

SEQ ID NO: 116281 - DNA, 528 bp, Homo sapiens
  misc_feature: GYAE6OF01EKM6U.45.37.D04.1.454.CMB.1.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaggtctcctgcaaggcttctggctacaccttcaccggcgactatctccactgggtgcgacacggcccctggacaagggcttgagtggatgggatggatcaaccctaacaagtggtggacacaaactatcgcacagaagtttcagggcaggtcacgatcgacaggacacgtccatcagcacngcctanatggancgtgagcgaagacgtagactactcgtagaccgacaccggtccttatttacttacgtgtacgacggtaggtacgttcggtttaaccggttggtcgttttaccggg

SEQ ID NO: 116282 - DNA, 519 bp, Homo sapiens
  misc_feature: GYAE6OF01ATTAG.45.37.D04.1.454.CMB.1.raw
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (451)..(451): a, c, t, g, unknown or other
  misc_feature (451)..(451): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccngtcagcctctaagctgctcatttacnggcatctacccgggaatcccggggtccctgaccgattcgagtcggcagcgggtctgggacaggtatttcactcgtcaccatcagcagcctgcaggctagaagtgtgtggctagtttatgctgtcagtactaattattattntacttcctccgtactttccggccctagggacctaaggtcgattaactacaaacgtactgtcggctacg

SEQ ID NO: 116283 - DNA, 870 bp, Homo sapiens
  misc_feature: GYAE6OF01B1OHL.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagagggccaccatcaactgcaagtccagccagagtgtttagacagctaccaacaataagaactactagcttggtaccagcaacgaaacaggtacagcctacaagctgctactaagtttacgtgggacctaacgtaccgtaaccccggggtaattccccgggggtaccctacggaacccgtattaccgaaggttcggaccgtaacgggtcggggttaccgtacgggggaacctaacggtacttttacccgaccgtttacccgaccgtaaccctaacgtccgaaacggcccgtaaacggtccccgttacggacgaacggggtaccgttaaggaaaacggttacgttagggttacgggtaaccgtttaagggttttaacgtttcggaccgtttaggtaccgtaaacggtaacccgtttaaaagtttaacgtttttaaactttaaacgttttaaccccggttttacccccgtttaaaccccgggtttaaaccccggttttttacccccgggggtaaccccccggtttaaaccggggggtaaaaacccccgtttaaaaagggggtttaccggggttaaaaaccttttaaaaccccgggttaaaacccggtaaaaaaccccgggtttaaaacccggttttcggggtaaaccggggtttaaccccggttaaacccggg

SEQ ID NO: 116284 - DNA, 562 bp, Homo sapiens
  misc_feature: GYAE6OF01ASB36.45.37.D04.1.454.CMB.1.raw
  modified_base (316)..(316): a, c, t, g, unknown or other
  misc_feature (316)..(316): n is a, c, g, or t
  modified_base (440)..(440): a, c, t, g, unknown or other
  misc_feature (440)..(440): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttaggtaccagcagaaaccaggtcagccctcctaagctagctctatttacngggctatccgtaacccgggaacttcccggggtccctgacccgtattccgagtacggccaggtcggggtactggggaactaggtactttcgactctaccaccatcagcagcctgccaggctaganagtgnggtatagtttatgtctgtcgagtactaattattattaactacgtttccctccgttacgtttccggtcccgtagggaacctaacggtgtatacgtaacaacgtactggtcgtcgtacg

SEQ ID NO: 116285 - DNA, 573 bp, Homo sapiens
  misc_feature: GYAE6OF01EE9E1.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctctgcaaggcttctggctacaccttcaccggcgactatctccactgggtgcgacaggcccctggacaagggcttgagtggagtggagtggactacaacctaacgaagtaggtcggacaactaaactaactagacgaacgtaagtaacgttacgtagggacggacgggtaccgacgacgtacgaaccgacgggacgaaccgtaccactacgacgacgacacgaccgtacgagtaggacgcgtagagacgacgacgtacgactagtcgtacgacgacgacgtactactttacttacgtaggtacgtacggtacggtagttcggtttaccgggttggtcg

SEQ ID NO: 116286 - DNA, 862 bp, Homo sapiens
  misc_feature: GYAE6OF01BKBJS.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatcgacccagtctccagactccctggctgtgtctctggcgagacggccaccatcaactgacaacgtccagaccagtagttgtttagacacgctaccaaacaataagaacttacttagtcttacggtaccaagaccaacgaaaaccgaggtaccacggtccctaccgtaagcctgaccttactaatttacgagggtacctacgtacccgtaacccggggtaacgtccccggggtaccctacggaaccgtagttacgaggtcggaccgacgggtccgggtacgtaggggaactaaggttactttaccgaacctttcctacccgtaaacctacgttaccgaacgccgtaacggtcccgttaggaccgtaacgggtccgtaagggtaaacggtacggttagggttaccgggtaccgttttaaagggtttttcttaacgggtcccgttttaagggtaacccgttaaacggttaaccttttaaaaggttttaaccttttaaagttttaacccgttttaaccccggttttaacccccgttaccccgggtttaaccccggttttttaacccccgggggacccccgttaaaagggggttaaacccccgttaaaaggggtttaacgggttaaaaccctttaaaccggttaaaacccggttaaaaaccgggtttaacccgggttgggttaaacccgggttacccgttaaaccccggg

SEQ ID NO: 116287 - DNA, 608 bp, Homo sapiens
  misc_feature: GYAE6OF01CC8CO.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccacatcaactgcaagtccagccagagtgtttagacagctccaacaataagaactacttagcttgtaccagcagaaaccaggtacagcctcctaagctcgctcatttactgggcatccgtacccgggtaacgtccggggtccctacgaccgattcgagtggcaggcgggtcgtgggacagtattcacttctcaccatcagccagccctgccaggctagaagagtgtcggtctagttttatgtacttgacagtactaagttaactttattaaacgttctttaccccgttaccgtaacccgttttcccgggtaccccgttaggggttaaaccccgttaaaagggttcggtaaacttaaccgttaaaccgaaaaaccggttaagttcgttaaccgggggcttaacccggg

SEQ ID NO: 116288 - DNA, 628 bp, Homo sapiens
  misc_feature: GYAE6OF01BP92D.45.37.D04.1.454.CMB.1.raw
  modified_base (258)..(258): a, c, t, g, unknown or other
  misc_feature (258)..(258): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaacgccgtggggcctcgagtgaaggtctccgtgacaggtcttcnggtctacaccttcgaccggcgactactctccgacgtgggtcgcgacgacggcccctaggacgaaggtctagaggtggagtgggatggataccaaacccgtaagtaacgtgggtacgacaacaaacttagtacgacaacgtaaggtaacggtttaccgacgggacgtaacgggtaccaaccgtaacgtacggaaccgacgggaaccaccggtaccagtacgacgaccgacacgacctactaggtacggaacgtcgtaggacgacgaacgacgtacgaacatcgtaacgacccgacgacggtaccttaagtttactagttgcgtacggtagtagtttacggttaccgggtggtccgtttgggttttacccgg

SEQ ID NO: 116289 - DNA, 505 bp, Homo sapiens
  misc_feature: GYAE6OF01BZ2CA.45.37.D04.1.454.CMB.1.raw
  modified_base (501)..(501): a, c, t, g, unknown or other
  misc_feature (501)..(501): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttgtaccagcagaaaccaggtcagcctcctaagctgctcatttactgggcatctacccgggaatccggggtccctgaccgattcagtggcaggcgggtctgggacagtatttcactctcaccatcagcagcctgcaggctagaagatgtggctagtttatgctgtcagtacaattattattatacttcctccgtactttcggcctaggaccaagtgatactacaaacgtactgtgntacg

SEQ ID NO: 116290 - DNA, 666 bp, Homo sapiens
  misc_feature: GYAE6OF01COXV5.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggagatcctcttcttggtggcagcagccacaagacgcccactcccaggtgcagctggtgcagtcgtggggctggaggtgaggaagccgtggggcctcgagtgaaggtctcctgcaaggtcttcgtggctaccaccttcgaccggcgactatcctccacgtgggtcgcgaccacggccccgtggaacgaagggtcttggaggtgggagtgggatagggtactaaccaaacccgtaaagtaaggtaggtcggaacaaacgtaaacttagtacgactaacgaagtaacgtttcgaagggcgagggtacaccgatacggaaccgacgggaacaccggtacacgtacgaacgaccaacgtacgaccctaagacgtagggacgtacgtacggaacgtaccgaacggaccgtacgaacgtaacgtacccggaacggaaaccgtaaccgtaaccggtaaccctttaagtttaacgttaccgttaggtcggaaccggtaaggttacgttacccgggtttacggttggttccgttttaccggg

SEQ ID NO: 116291 - DNA, 825 bp, Homo sapiens
  misc_feature: GYAE6OF01DE1TD.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactacttagcttaggtaccagcaagaaaccaggtcagcctacctaagctgctctatttacgtgggactacgtccgtacccgggaactcccgggggtcccctagacccggtattaccgaggttcggcgacgggtccggggtactggggaactacggttacttttccgaacgtttcctacccaacccgtaattacccgaagtacccgtaacggccccgttaggacccggtaacgggacccgtttaggaaaacggtacgtttcggggttacggggtaaccttaagggttttttaacgtttcggaccggttttacgggttaaccccgtaaagggtacccttaaaaatttttaagtttttaaggttttaaacctttaaaccccgtttttcccccggttaaacccccgggttacccgtttttttacccccggggggtaaccccccgtttaacgggggggtaaaacccccttaaaaagggggttttcccggtaaaagtttaaacccggttaaacccggtaaaaaacccggtttaaccccggtttcggggttaaaccgggttcccgttaaacccggg

SEQ ID NO: 116292 - DNA, 553 bp, Homo sapiens
  misc_feature: GYAE6OF01B32CW.45.37.D04.1.454.CMB.1.raw
  modified_base (249)..(249): a, c, t, g, unknown or other
  misc_feature (249)..(249): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatccaactgacaagtccagccagatgtttagacagctccaanaataagaactacttagtcttaggtaccagacacgaaaccaggtacacgcctacctaagctgactctatttactggcagtaccgtaccggaacgtccgggtcctacgaccgtatcacggtcgcgacggcgggtctagggacagtagttccactcgtcaccatcgacgcacggcctagcacggctaagacgtagtgtcggacttagtttactgtctgtacagtctaattcttatacttacttcctcgtaccgttcggcccgtagggactaaacgtggtaattacacgaaacgtactgtcgtctacg

SEQ ID NO: 116293 - DNA, 647 bp, Homo sapiens
  misc_feature: GYAE6OF01BZIDG.45.37.D04.1.454.CMB.1.raw
  modified_base (252)..(252): a, c, t, g, unknown or other
  misc_feature (252)..(252): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcgagtgaaggtctcctgcaaggcttcnggctacaccttcaccggcgactactcctccacgtgggtgcgacgcggccccgtggacaagggcttggagtggagtgggatggactaccaaccctaagaagtgggtaggacaacgtaaaactagtgacaacgtaagtaacgtttcgagggacgacgggtacacgatcgaacgagggacacgtcatacgagcacacgcctaacgagtaggacgcgtaggacgccgaaggtacctaggaactacgtaccgtacggaaccgaaccggtaaccgggtaccttaaagtttttaacttaccggttacgggtacggttaaccggggttaacgggttacggttttacggggttttaacccggggttacgggtttcccgggtttttcggggttttttaccccggg

SEQ ID NO: 116294 - DNA, 708 bp, Homo sapiens
  misc_feature: GYAE6OF01B55I2.45.37.D04.1.454.CMB.1.raw
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtcgccgtacggggacatcgtgatcgacccagtctccagacctcccgtggctgtgtctcgtgggcgaggacgggccacatcaactgacaagtccagccagtagtgtttagacagctaccaaanaatagaactactagcttagacagcaagaaccngtacacgcctactaagctcgctactattacgnggactacgtaccggaacccgggacgttcccggggtaccctggaacccgtattcggacgtacggcgtacgggtcgggtacgacggactagtacttaccgaccttctaccgacctacgtccgaacgcccgtacggtccgacggtacgacgggtacgtaaggtaacgtaggtcggtacgggtttataacgttttagccgtacgttaggtaccgtaaagttaccttaaattttaactttaagtttaaacccgttcgtttaacccccggttacccgggtttaccggtttacccccggggtacggttaaccggggtaaaccctaagggttacggtaaactttaacccgtaaacggtaaacccgttagggttcggtacggttaactaacccg

SEQ ID NO: 116295 - DNA, 541 bp, Homo sapiens
  misc_feature: GYAE6OF01AJDLV.45.37.D04.1.454.CMB.1.raw
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttggagtggatgggatgggatcaaccctaacaatgggtggacacaaactatgcacagaagtttcagggcagggtcaccatgaccgagggacacgtccatacagcaacacgacctacagtggacgcgtgacgcgaagacctagacacgtcaggaccgacgaccgggcctagttttacttactggtcgcggtaggacgttcggtttacgggtggtcgtttggtttccgttttacggg

SEQ ID NO: 116296 - DNA, 593 bp, Homo sapiens
  misc_feature: GYAE6OF01AJJY6.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgtttagacagcctaccaacaataaagaactactagcttaggtaccagacaagaaaccaggtcacgccctaccgtaagctgctctatttacgtgggctacgtccgtaacccgggtaacgtcccggggtaccctggaccgtattccgaggtcggcgaggtcggggtctagggactaggtactttcacctctaccacctatccgagcctacgcctagcgacggcgtacgaagtagtggtggtactagtttagtcgtcgtgtacagtactaattacttattatacttcctaccgttaccgttccggtcccgtacgggtaacctaaggtacgtatacgtaaccgaaacgtagtagtcgtcgtacg

SEQ ID NO: 116297 - DNA, 641 bp, Homo sapiens
  misc_feature: GYAE6OF01CI3IZ.45.37.D04.1.454.CMB.1.raw
  modified_base (279)..(279): a, c, t, g, unknown or other
  misc_feature (279)..(279): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaactggtgcagtctggggctgaggtgaggagcgtgggcctgagtagagtctctgacgaggcttcgtggctactaccttccgaccggcgactatccncctacgtggtcgacgacgacggccccgtaggaacgaggtcttaggaggtggaggtggtagtaggactaccgaaaccctaagtaagtggtacggacaaactaaacgtatcgacacgtaagtaacgtttcgacgggtacgtacgggtaccaaccgtacgtacggaaccgaacgggacctaccgtaccaagtcgacgactacgacgacctaacaggtacgacgcgtagaacgacgaacgtactagactacgtcgtacggaccgtaccgaccggtaccttaagttttaaccgtacgttaggtcgtacggtaggttaacgtttcgggtttaaccggtggttccttcgggtttttccgtttaacgggg

SEQ ID NO: 116298 - DNA, 716 bp, Homo sapiens
  misc_feature: GYAE6OF01BH9GZ.45.37.D04.1.454.CMB.1.raw
  modified_base (319)..(319): a, c, t, g, unknown or other
  misc_feature (319)..(319): n is a, c, g, or t
  modified_base (387)..(387): a, c, t, g, unknown or other
  misc_feature (387)..(387): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttagacagctccaaacaataagaactacttagcttggtaccagcagaaaccaggtcacgcctacctaagctgctctatttacngggcatccgtacccgggagtcccggggtcctacggaccgtattcgaggtggcgtacggcggggttacncggggactaggtactttccgaacttccgtaccacccatccgaacgccaacgtccctaggaccgagggtctacggaaagtacgtgggttacggtaccgttaaggtttttacgttcggtaccgttacggtacccgtaagtaccttaaaattttcgttttaaactttacttaccgtttccccgtttacccggttaacccggtttttaccccggggtccccgttaacgggggaaaccccgttaaaagggttaccgggttaaactttaaacccggttaacccgtaaaaacccgggttaaccgtttcgggttaaccgggttccccgttaaccggg

SEQ ID NO: 116299 - DNA, 832 bp, Homo sapiens
  misc_feature: GYAE6OF01AG8DJ.45.37.D04.1.454.CMB.1.raw
  modified_base (203)..(203): a, c, t, g, unknown or other
  misc_feature (203)..(203): n is a, c, g, or t
  modified_base (671)..(671): a, c, t, g, unknown or other
  misc_feature (671)..(671): n is a, c, g, or t
  modified_base (680)..(680): a, c, t, g, unknown or other
  misc_feature (680)..(680): n is a, c, g, or t
tcagacgcgatcgacacgaccggtgctcgatttagtagcatactgttgggtttgggggtaggtcgagtcacccagcaaccacatctgtcctctacgagaatccctgacgagctccgttcctcaccactggactcggactgaggatcctcttcttggtggcacgcacgccacaagacgcccactcccaggtcgcaacgtcggtnccgacggtcgtgggcgttgaggtggaggaacgccgtgggggcctacgacggttaggaacggtcgtcctcgggacaaaggtccgttcgtcggtacttaccgaccgttcgaaccggttccgacgttacgtacctccgtacggtcgggttcggaccggtaaccgacgggtcccccgtcgggaaccggtaacgggtaccgttcgggtaaacggtcggggtaactagggggttaacggtacgggtaacgtacccgttaaaccccgtaaaccgtaaagggttccgggttacgggaacccggtaaacctaaaaaacgtttcggtacggtaaccgaaccggttaaaggtaaacgggttttaccggaaccggggggttacaaaccgggggttactaacccggtaagttaccggaaccggtaggggtaaacccgccgttaacaaccgtacgtacgggactaaccgacgactaacccgngtaaccggngtacgtcgggaacgtcgaacgtaccgtacggactacgttacgacggtaccgacgtaccgtaccgtatttaaaccgtgttaacggcgtaggggtaaacttacggggtttacttaccgggggtgttcccggttgggttttccccttaaaggggg

SEQ ID NO: 116300 - DNA, 698 bp, Homo sapiens
  misc_feature: GYAE6OF01DBV45.45.37.D04.1.454.CMB.1.raw
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagacgggccaccatcaactgcagtccagccagtagttgttttacggcccaatagtaagactacttagcttaggtaccagcagaacgccgaggcacgcctcctagcctgtccttcttttacgtgggctacgttccgtaccccgggaagtccccggggtccctgaacccgtnttcgaggtcggcgagggtcgggttcgtcggggctaggtacttcgacttcctacgaccagttccgacgtcacgccctgaccgtacgccgtaggaacgtacgttcggtaccgtacgtttaacggttttaacctacgttgtaccaaggttaaccttaaagtttaagtttaagtacgggtactttaacctttcccgttacctttaacccggttaccggtttacccgggggaccggggtaaaccggggttaaacccgtaaggggtttccgaaccggtaacgttaaaccggaaaaccgtacggttacgggtacggtacccttaggcccttaaacccgg

SEQ ID NO: 116301 - DNA, 812 bp, Homo sapiens
  misc_feature: GYAE6OF01DGBVM.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgagtcgacccagtcctccagtacctcccgtggctgtcgtctcgtgggcgaggacggccaacatacaactgacaagtccagccgagtagttagtttacgacacgacctaccaaacaaataaacgtaacttacttacgtccgtttacggtaccaaggaccaaacggaaaccgtacgggtaccaaccgtaccccttaaccgtaaacgccttacggtaccttaccttaacgtttaccgtcgggaccttaacgtaccccggtaaccccgggtaacgttccccgggggtaccctacggaaccgttacgttcgaacggtcggacgtacgggtcgggtacgtacgggaaccgtagttaccgtttaccaccgttcctaacccgtacctacgtaccgaacgtcccgaacgtcccgttacggaccggacggtaccggtaagtaaaccggtgttacgggtaccggtagtttaaacgggtttcgtcggttcgttcgtaaaccggtagttaacctttaaattttacctttaaagtttacccgtttacgttacccccggttaccgttaccccggttttacccgggaacccggtttaaccgggaaaccgttaaacgggttagttaaactaaaccgaaaccggttaaacggtagtcgggtagtcccgtaaccg

SEQ ID NO: 116302 - DNA, 747 bp, Homo sapiens
  misc_feature: GYAE6OF01BK267.45.37.D04.1.454.CMB.1.raw
  modified_base (282)..(282): a, c, t, g, unknown or other
  misc_feature (282)..(282): n is a, c, g, or t
  modified_base (312)..(312): a, c, t, g, unknown or other
  misc_feature (312)..(312): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagagttgtttagacagctaccaacaataagaactactagcttggtaccagcagaaacnggtcagcctactaagctgctctatttacgngggtctacgtccgtaaccgggtaacgtcccggggtacctacggtaccgtacgtttacgaaggttcggacgtaacggtccggggtcttaggggaactaggtactttccgacttacctaccacctagtccgaagaccgtaacgtccgtagacgtacgggtcctaaggaacgtacgttacggttacggtacgtttaaggtttttacgtaacgggttcgttacggtttaaccgaacgggttaaccttaaaacgttttaacttttaacggtttaactttaacccggttttacccgttacccggttttaacccgtttaccccggggtaccccggtttaaacggggaacccgttaaaaggggttccgttaaacgttaaaccgttaacccggtaaaaacggttacccggttagggttaacccggtacgttcgttaaaccccgg

SEQ ID NO: 116303 - DNA, 646 bp, Homo sapiens
  misc_feature: GYAE6OF01BQC73.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttagacagctaccaaacaataagaactacttagcttggtaccagcagaaccaggtcacgcctacctaagctcgctctatttacgtggcacgtcctaacccgggacgttcccggggtccctcggtaaccgtagttccaggtcggcgaggccgggtcgtgggactacgtactttcacctcctccaccgtataccagcacgccctggaccaggcgtagaagtagtggtggtacgtagtttaattcgtacgttcggtacgtacggtactaaagtttaactttaagtttacttaaccgtttccccgttaccgttacccggttttcccgggtaaccccggttaccgggtaaccggtaaacggttcggtaacttaacctaacggaaaaccgttaacgtacggttggtaccgttaccgg

SEQ ID NO: 116304 - DNA, 679 bp, Homo sapiens
  misc_feature: GYAE6OF01CSAMF.45.37.D04.1.454.CMB.1.raw
  modified_base (392)..(392): a, c, t, g, unknown or other
  misc_feature (392)..(392): n is a, c, g, or t
  modified_base (522)..(522): a, c, t, g, unknown or other
  misc_feature (522)..(522): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgagcgggccacatcaactgacaacgtccagccagtagttgtttagacagcctaccaaacaataacgaacttacttagtccttacggtaccagaccaagaaaccgtaggtacactcctactaacgctgaccttctactttacgcgggactacgtaccgtaacccgggtagtccccggggtcctacgacccgttntcgaggtcggcgacggtcggtccgtgggaacctaggttacttcaccgtctacccgactacgtacgacgtacgtacgacctaggaccgttaagggttacgaaggttcgtagggttacgtcgtttaagtttnttacggtctacggttacgaagtaccttaaagtttaacttttaattacgttaccctttcccgttacccgttaccgttcccgggtaccgtaacgggttaaccaaggttacggtaacttaacgtaacgtaaacgggtactggtacggcctaacgtacccg

SEQ ID NO: 116305 - DNA, 557 bp, Homo sapiens
  misc_feature: GYAE6OF01BOM3O.45.37.D04.1.454.CMB.1.raw
  modified_base (442)..(442): a, c, t, g, unknown or other
  misc_feature (442)..(442): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaaggcttgagtggatgggatggatacaaccctaacaagtggtgacacgaaactatgacaacaggtaagtttcgagggctagggtacaccgtatcgaaccgagggacctacgtaccatccagcacagccctacagtgganctagagcaagactgacatcgtgaacgacgaaccggtcctaagttttacttacgttggtacgacggtaaggtacgttacggttttaacccgggtcgttcgtttcgggttttacccg

SEQ ID NO: 116306 - DNA, 578 bp, Homo sapiens
  misc_feature: GYAE6OF01BV4OP.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactacttagcttggtaccagcagaaaccaggtcagcctctaagctgctcatttactgggcatccgtacccgggaatcccgggggtccctgaccgattcagtggcaggcgggtctgggacagtatttcactctcaccatcagcgagcctgcaggcctaggaagtattggtggactaggttttatgtctgtccaagtctaaattactttaattacttactttcccgtaccgttacccgttttccgggaccccgttagggtaaaccctaaagggtacggtaattaacgtaaccgtaaaccggtaacgttgggtcggtgtaccgg

SEQ ID NO: 116307 - DNA, 567 bp, Homo sapiens
  misc_feature: GYAE6OF01CV65X.45.37.D04.1.454.CMB.1.raw
  modified_base (465)..(465): a, c, t, g, unknown or other
  misc_feature (465)..(465): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactacttagcttaggtaccagacagaaaccaggtcacgcctcctaagctgctctatttacgtgggacataccgtacccgggaatcccggggtccctggaccgtattcgaggtcggcgaggtcgggtctagggactagtactttcgactctcaccatcgaagcagcctagcaggctagaagctggtgctagtttatcgcttagtcaagtntaagttattattaactctttccctaccggttactttccggacccgttagggaacctaaacggttcggaattacgtaactaaaccggtatggtcggcgttacg

SEQ ID NO: 116308 - DNA, 585 bp, Homo sapiens
  misc_feature: GYAE6OF01A4YZC.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactacttagcttggtaccagcagaaaccaggtcagcctcctaagctgctcattactgggcatcgtacccgggatccggggtccctgaccgtatcagtgcgagcgggtctgggacagtattcactctacacctatcagcacgcctgacgaggctaggaagtagtggtcggtcttaagttttactgtcgttgtctaagacttaaattacttagtagtacgtactttaccctcgttaccgttaccggtttcggggaaccgggtacgggtacccgttaaagggttcggtacggtaacttaacccgtaaacggtaaccgttgggttaaccggg

SEQ ID NO: 116309 - DNA, 623 bp, Homo sapiens
  misc_feature: GYAE6OF01C0E3P.45.37.D04.1.454.CMB.1.raw
  modified_base (331)..(331): a, c, t, g, unknown or other
  misc_feature (331)..(331): n is a, c, g, or t
  modified_base (427)..(427): a, c, t, g, unknown or other
  misc_feature (427)..(427): n is a, c, g, or t
  modified_base (483)..(483): a, c, t, g, unknown or other
  misc_feature (483)..(483): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctcagactccctggctgtgtctcgtgggcgagacgggccaccatacaactgacaagtccagccagacgttgttttagacagcctacaacaataagtaactacttagcctttaggtaaccagacgaagaaccaggtcacgcctactaacgctcgctactaatttacgnggactagtccgtaaccgggtacgtcccgggtcctagaccgtattcgagtggcacggtcgggtactgggaactagtactttcacgtctaccacctanacgagcacgtcctgacgagcgtaagaagtagtcggtagtacgttagtttacgtcgngttaccgtacaacggtactaaatttacgtttatttacttaccgttcccgtacgttaacccgtttcccgggtacccgtaagggtaaccaaaggttcggtaacttaacgtaaccgaaagttacgtggtacggcttacgtacc

SEQ ID NO: 116310 - DNA, 576 bp, Homo sapiens
  misc_feature: GYAE6OF01B1YG9.45.37.D04.1.454.CMB.1.raw
  modified_base (384)..(384): a, c, t, g, unknown or other
  misc_feature (384)..(384): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgaccccagtctccagactccctggctgtgtctcgtgggcgagaggccaccatcaactgcaagtccagccagagtgttttagacagctaccaacaataagaactacttagcttggtaccagacagaaaccaggtcacgcctacctaagctgctctatttacgtgggcatcccgtaaccgggaacgtcccgggtccctgaccgattcagtcggcaggcggtcgagggacngtattcactctcaccatcagtcagcctgacagtcagtaagngtgnggacttaagtttgtgctgtacgagtacgtaattatttaatacttacttacccgtacgttacccgtttaccggccccggtagggtaacccaaaggtcgtaacgttactaaccgtaaaaccggtacttgggtactccggtcgtaacccg

SEQ ID NO: 116311 - DNA, 559 bp, Homo sapiens
  misc_feature: GYAE6OF01BOBB9.45.37.D04.1.454.CMB.1.raw
  modified_base (284)..(284): a, c, t, g, unknown or other
  misc_feature (284)..(284): n is a, c, g, or t
  modified_base (431)..(431): a, c, t, g, unknown or other
  misc_feature (431)..(431): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttgtaccagcagaaaccngtcagcctctaagctgctcatttacgtgggctatccgtacccgggaactcccggggtccctacggaccgtattcgaggtcggacgacggcggggtctgggacgtagtatttcactctcaccatcagcagtcctgcgaggctagaagngtgtggctagtttatcgctgtcgagtactaattacttagtacgttacctccgttaactacgtttacggccgtaaggggaaccacggtcgtaggaacgtacgtaacgaaaccgtacgtggtcggtaccg

SEQ ID NO: 116312 - DNA, 595 bp, Homo sapiens
  misc_feature: GYAE6OF01DL236.45.37.D04.1.454.CMB.1.raw
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (478)..(478): a, c, t, g, unknown or other
  misc_feature (478)..(478): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagctccctggctgtgtctctgggcgagacggccaccatcaactgacaagtccagccagtagttgtttacgacagcctaccaacaaaataacgaaacttacttagccttaggaccagacaagaaaccnggtcacgcctcaagctagctcatttcgnggacactacgtaccggatccgggtcctggaccgtattcgagtggcaggtcgggtctgggaactgtactttcacttcacaccatcagctagacctgacctgactagaacgatgcggtactagtttntcngttacgtagtagacttaaagtttnttacgttagttaccctttacccgtacccggtcgtttcccggaacccgttaggggtaaaccctaagggttcgtaacttaaccgttaaaccgaaaacgtaccgtttggccggtcctacg

SEQ ID NO: 116313 - DNA, 642 bp, Homo sapiens
  misc_feature: GYAE6OF01CIB5W.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggactcctcttcttggtggcagcagccgacgaggacgcccactccccgaggtgcagctggtgcagtctggggctgaggtgaagagccgtggggcctcagtgaaggtctcctgcgaaggcttcgtggtactacctacctttccgacccggtcttaacctaatactacacgtgggtgccgacgcggcccctggacagggtcttggagtggagtgggagtggataccgaaccctaacgaagtggtaggacaacgtaaactagtcgacaacgaggttaacgtttcggagggcgtagggtacccaccgtatacggaaccgaaggaccacgtaccatcgacacgacacgtacctacgagtcggagtcgtaggacgacgtacggctaggacgtactcggtacggaccggaacgtccgggaccgtttcggttaacgtttacggtcggttcgggacggaacggtaacgggtacgtaagggtttaaaccgtttcgggtttaaggttttttaaggggg

SEQ ID NO: 116314 - DNA, 568 bp, Homo sapiens
  misc_feature: GYAE6OF01EF1LI.45.37.D04.1.454.CMB.1.raw
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
tcagacgcgatcgacacgaccggtgctcgatttagtagcatactgttgggtttggggagagcatcacccagcaaccacatctgtcctctagagaatccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttcgtcggctacaccttcaccggcgactatctccacgtgggtcgcgacgacggcccgtaggacgaagggcttggagtggagtgggactggactacaaccctaacaagttggtggacaacaaactatgacacgaagtaagtttcgagggacgagggtccaacgagtacgaccgtagggaacacgtccatcacgcacagcctacgatggagctagagcgaagactnaactntactacgacgtaccgacggaccttaatttacgttacgtagtggacggtacggtacgtttgggtttaacccgggttggtccggttttaccggg

SEQ ID NO: 116315 - DNA, 670 bp, Homo sapiens
  misc_feature: GYAE6OF01EIWUU.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtacttcatttctctgttgctctggatctctggtgcctacggggacatcgtgatgacccagtctccagactcctggctgtgtctcgtgggcgaggacgggccaccatcaactgcaagtccacgccagagtcgttttacgaccacgtcctaccaaacaactaagtaacctacttagcttacggtaccagacaacgaaaccgaggtcacgccctacgtaacgctgcctactatttaccgtgggcctacgtacccgtaacccgggtaacgttccccgggggttccctacggacccggtagttcgaacggtcgggcgaacggtcggggtacgtcggggaactagtactttccaccgttctaccaccgatcgacgcacgtcctggaccgagggtcctaggaagtcgtggttcggactttaagtttacgttgtacgttcgtacgtacgtacttaaattagttagtcggtaacgttctttaccctacgttaccgttaccgggtttacgggacggggttaacgggacccgttaagggttcgacgtaacgtaaaccgaaacgtacgtggtacgg

SEQ ID NO: 116316 - DNA, 567 bp, Homo sapiens
  misc_feature: GYAE6OF01EK4KR.45.37.D04.1.454.CMB.1.raw
  modified_base (317)..(317): a, c, t, g, unknown or other
  misc_feature (317)..(317): n is a, c, g, or t
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagtgttttagacagctaccaacaataagaactacttagcttaggtaccagcaagaaaccaggtcagcctactaagctgctcatttacnggcactcgtacccggacgtccgggtccctgaccgtatcgagtgcaggcggtcgngggacagtattcactctacaccatacagcacgtcctgcgagctagaagtatggtagtactagtttatcgtcttgtacgatacgtaaattattattacttacttcccgttaccgtacgtttcccggacccgtagggtaaaccctaaggtacggtaattaaactaaccgtaaaccgtaatttcgggtcgtcttaccgg

SEQ ID NO: 116317 - DNA, 627 bp, Homo sapiens
  misc_feature: GYAE6OF01B77OD.45.37.D04.1.454.CMB.1.raw
  modified_base (287)..(287): a, c, t, g, unknown or other
  misc_feature (287)..(287): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaaataagaactactagcttaggtaccagacagaaaaccnggtacacgcctcctaagctgctctatttacgtgggcactccgtacccggaagtccgggtcctgaccgtatcagtggcagcgggtctggacagattcactctcacatcagcacgcctgcaggtctaggaagatggtcggtacttagtttaagttcgtacgttcgtacgtaagaccttaaaagtttattttaactttaaattaccgtttaccccgttaccggtaacccgttttttccggggaaccccgttaacggggtaaacccgtaaaaggttaccgggtaattaaaaccgttaccgtaaaaacgtaaaccgtttacgggttcggggtaaccttacccggg

SEQ ID NO: 116318 - DNA, 578 bp, Homo sapiens
  misc_feature: GYAE6OF01B8MMB.45.37.D04.1.454.CMB.1.raw
  modified_base (230)..(230): a, c, t, g, unknown or other
  misc_feature (230)..(230): n is a, c, g, or t
  modified_base (290)..(290): a, c, t, g, unknown or other
  misc_feature (290)..(290): n is a, c, g, or t
  modified_base (330)..(330): a, c, t, g, unknown or other
  misc_feature (330)..(330): n is a, c, g, or t
  modified_base (488)..(488): a, c, t, g, unknown or other
  misc_feature (488)..(488): n is a, c, g, or t
  modified_base (566)..(566): a, c, t, g, unknown or other
  misc_feature (566)..(566): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctnagtgaaggtctctgcaagcttctggctacaccttcaccggcgactatcctcacgtgggtncgacacgcccgtggacaagggctgagtggatgggatgganacaaacctaactaagtggtaggcaacaaaacgtagtagacaactagtaaacgtttcgacggggtacgtacgggtaccaaccgtaagtacgaaacccgaacggggtaacctaaccggttaccaacgttacgaacgacaacgacgaccttacgagtcganacgtgaagcaagacgtagacatctagaccgaacgacggtcctatttactacgtgtggacgtaggatttagttaccggngttcgtttacgg

SEQ ID NO: 116319 - DNA, 685 bp, Homo sapiens
  misc_feature: GYAE6OF01D2T77.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttagacagctaccaaacaataagaacttacttagtcttacggtaccagacaacgaaaccaggtacacgccctacctaagctcgactctatttacgtgggactacgtaccgtaacccggggtaacgttcccgggggtaccctacggaaccgtacgttaccgagggttcggaccgagggtaccggggtcgtacggggaactaggtaacttttacccgacttcctaccctaacctacttacgaacggaccgacgtcccgtagccggaacgggtctaggaaacgtagttcggtacggtacttaaggttttacgttcgtcgttgtaccgtaagtacctaaatttagttagtacgtaacgttaccttcccgttactaccgttaccggtttcggggaccgggtaacgggtaaccgttaagggttccgacgtaactaacgaaacgtacgtggtacgg

SEQ ID NO: 116320 - DNA, 721 bp, Homo sapiens
  misc_feature: GYAE6OF01CKIA0.45.37.D04.1.454.CMB.1.raw
tcagacgcgatcgacacgaccggtgctcgatttagtagcatactgttgggtttgggggagtctacaacaggcaggcagggcagcaagatggtagttagcagacccaggtcttctatttcctctgttgctcgtggatctcgtggtgcctacgggaccatcgtgatgacccgagtctccgacgacgtccgtggctacgtcgtctcgtcggcgagaggcctaccatcaacgtcgtacaacgtccgaagccagtagttcgtttaacgacgacggtcctaccaaactaacgtaaacgtaacctaccgttaaggtacgttacgtaacccaagtcgaaacgtaaaccgaggtcgaacgtacccttacttaagccgtcggaccttacgtacgtttacgtcgggactacgtaccggtaacccggtaacgttccccggggtacctacgtaacccgtacttaccgaacgttcggactacgggtacggtaccgtacgggaaccgtaacgttaacttttccgtaccgtccgtaacctaccgagttcgaacgtcaaccgtccgtagaccgtagctaggagtattcgtacgtacttagtttactcgacgttacgacgtagtacttaaagttagtttacgttaaccttcgttacccgtaccggttctttacccggccgtacggtaaacctagggttagtaacttacgtaccgaaacggtacgttcggccgtctaccg

SEQ ID NO: 116321 - DNA, 587 bp, Homo sapiens
  misc_feature: GYAE6OF01A1NWI.45.37.D04.1.454.CMB.1.raw
  modified_base (313)..(313): a, c, t, g, unknown or other
  misc_feature (313)..(313): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaaacaataagaactacttagcttggtaccagcagaaaccaggtcagcctcaagctgctcatttacgnggcatccgtacccgggaactcccggggtccctgaccgtattcgagtcggcaggcgggtctgggacagtactttcactcctcaccatcagcagtcctgcaggctagaagatggngctagtttntcgcttgtacagtactaattatttaattacttactttcccgtaccgttaccgttttcccgggaccccggttaggggaaaccccttaaagggttcggaaactttaaccgtaaaccgtaaaacggtaacccttagggttccggtccgttaccgg

SEQ ID NO: 116322 - DNA, 578 bp, Homo sapiens
  misc_feature: GYAE6OF01A82T8.45.37.D04.1.454.CMB.1.raw
  modified_base (374)..(374): a, c, t, g, unknown or other
  misc_feature (374)..(374): n is a, c, g, or t
  modified_base (405)..(405): a, c, t, g, unknown or other
  misc_feature (405)..(405): n is a, c, g, or t
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctccgtgacgaggtcttcgtggtctaccaccttccgaccggccgactatcctccacgtgggtcgcgacgacggcccgtggacgaggtctgagtggagtggagtggactacaacctacgagtggtagacaacaatncgagacagtacgttcgagggacaggtcacgngtacgacgaggaccacgtcagtcgacgacacgacgacctacgaggtacgggacncgaggacgacgaacgacgttgaactacgtacgtacgacgacgtaccgtacttagtttactgtcgtacggtagtacggttacgttacggttaccgggtcgttcgtttcggttttacccgg

SEQ ID NO: 116323 - DNA, 815 bp, Homo sapiens
  misc_feature: GYAE6OF01EQ7MJ.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaacgtgacaacgtcagaccagtagtgttttagacagctaccaaacaataagaactacttagtcttagtaccagcaacgaaaccgaggtacacgcctacgtaacgctacgctactactttacgtcggactacgtaccgtaaccgggtaacgtcccggggtaccctacggacccgtacgtacgtacggtcggacgacggtcgggtacgtacggggactacggttactttacctaaccttccgtacctaaccctagtaccgaacggtacccgtaacggtacccgttacggacccgtaaacggggtcccgttaaacgggtaaaggttaaccggtttacgggttacgggttaacccggttttaaaggggtttttaacctttacgggttaaccggtttaccggtacgttaaaacgggttacctttaaaaaggtttttaaccttttaacgtttaacttttaaaccgtttcccccgggttttaacccgttaccccgggttttttacccggggaccccgtttaacgggggtaacccttaaaagggttacgtaaacgttaaaccgtaaaccggtaaaacggttaccgtttacgggtcggtaccgttaaccgg

SEQ ID NO: 116324 - DNA, 627 bp, Homo sapiens
  misc_feature: GYAE6OF01B5K3P.45.37.D04.1.454.CMB.1.raw
  modified_base (290)..(290): a, c, t, g, unknown or other
  misc_feature (290)..(290): n is a, c, g, or t
  modified_base (429)..(429): a, c, t, g, unknown or other
  misc_feature (429)..(429): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagactagcctaccaaacaataaagaactactagtcttgtaccagcaagaaaccngtacagcctctaagcctgactctaacttactgggctagtaccgtaccccgggaattcccgggggtaccctggtacctacgttcgagtcggcaggtcgggtcgtgggacagtacgtttcacttctcacatcaggcacgcngacgacgactagaacgtgtaggtgtacttagtttacgtgtacgtcgtacgaacgtacttaaagttatttaagttaattaccccgtttaccgtaccggttaccgttttccccgggtacccgttaagggggaaaccctagggtttaaggaaccttacggtaaaccgtaaaccgtaaacgttcggttacggtccgtaaccg

SEQ ID NO: 116325 - DNA, 607 bp, Homo sapiens
  misc_feature: GYAE6OF01CNKSU.45.37.D04.1.454.CMB.1.raw
  modified_base (198)..(198): a, c, t, g, unknown or other
  misc_feature (198)..(198): n is a, c, g, or t
  modified_base (239)..(239): a, c, t, g, unknown or other
  misc_feature (239)..(239): n is a, c, g, or t
  modified_base (520)..(520): a, c, t, g, unknown or other
  misc_feature (520)..(520): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgnggggctgaggtgaggagccgtggggcctcgagtgaaggtcnccgtgcaagcttctggctacaccttcaccggcgactatctccacgtgggtcgacgacacggcccgtggacaagggcttgaggtcggagtgggagtggactaccaacccgtaaagaacgtgggtacgggacaaactaaaacgtatagaccaacgaaggtaaacgtttacgaaggggtaccggagggtaccgacgaagtcggaacgaagggaccaaccgtacactacacgacaccgacgtaccgtaacagtaggagtccgtagaggactaggtactagactancgtagacgaaccgacgacttaacgtttattactgggtacgacggaggtacgtttacggttccgggtacggtcgtttggttttaccgg

SEQ ID NO: 116326 - DNA, 566 bp, Homo sapiens
  misc_feature: GYAE6OF01D29G4.45.37.D04.1.454.CMB.1.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (429)..(429): a, c, t, g, unknown or other
  misc_feature (429)..(429): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacgggacatcgtgatgacccagtctccagactccctggctgtgtctcgtgggcgaggagggccacatcaactgcaagtccagccagagttgttttagactagcctaccaaacaaataaagaactacttagacttggtaaccagacaagaaaccaggtcagcctctaagctgctnatttacnggctacgtcgtacccgggaatccggggtccctggacctattccagtcggacagcgggtctgggacagtatttcacgtctcacatcagcacgctgcagctagaagtntgtgtctagtttatgtctgtcagtactaattacttattattacgttccttaccgtacgttttccggacccgttacggggaaaccctaaaggtcggtaaatacgtaaccgtaaacgtaacttcggttaggcctaacgg

SEQ ID NO: 116327 - DNA, 593 bp, Homo sapiens
  misc_feature: GYAE6OF01AXR2X.45.37.D04.1.454.CMB.1.raw
  modified_base (315)..(315): a, c, t, g, unknown or other
  misc_feature (315)..(315): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgttttagacagctaccaacaataagaactacttagcttggtaccagacagaaaccaggtcagcctcctaagctgctctattacgngggctacgtccgtaacccgggactcccggggtcctcgaccgtatcgagtggcacggtcgggtcgtgggactagtacgtttccacttccgtacacccatcgacgccacgtcctgcgacggtgtagaaggtatggtcggtactaagttttatcgtcgtgtcctagtactaattagttattaacttcttccctaccgtacccgttttccgggcccgttaagggaaccctaaaggttcggtaaactaaccgtaacgaaaccggtacctggttacggctaccg

SEQ ID NO: 116328 - DNA, 621 bp, Homo sapiens
  misc_feature: GYAE6OF01DQGP6.45.37.D04.1.454.CMB.1.raw
  modified_base (489)..(489): a, c, t, g, unknown or other
  misc_feature (489)..(489): n is a, c, g, or t
  modified_base (502)..(502): a, c, t, g, unknown or other
  misc_feature (502)..(502): n is a, c, g, or t
  modified_base (508)..(508): a, c, t, g, unknown or other
  misc_feature (508)..(508): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtgcagcagccacaagagcccactcccaggtgcagctggtgcagtcgtggggctggaggtgaggaacgccgtggggtcctcgaggtggaaggtcctccgtgacgtaacggtctttcgtcggacctacctaccgtttccgaaccggtcgtaaccttactcctaccgtacggtgggggtcgaccgaccgaccgggtccccgtaggaacgaagggtcttagggacgtgggagtgggatggactacctaaactaacgagtgggtacgacaactaaatgtcgacacgtagtaacgttacgagggtcgtaacggtccaacgagtacgaccggaggaccacgtacntacgagacacacncctaanggtagagcgtagacgtacacgtactgactacgtctacggaccgacgtacgtccttaatttagtcgtaggtcggacgtacggttacgttcgggtttacggtcgttcggtttcgg

SEQ ID NO: 116329 - DNA, 541 bp, Homo sapiens
  misc_feature: GYAE6OF01E06S4.45.37.D04.1.454.CMB.1.raw
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaactggtgcagtctggggctgaggtgaggaagcctggggcctcagtgaaggtctcctgcaaggcttctggctacaccttcacccggcgactatctccactgggtgcgacaggcccctggacaagggcttgagtggatgggatggatccaaccctaaacaatgggtaggcaacaaactatgcacagtaagtttcagggcagggtcaccatgaccgagggacacgtccatcagcacagccctanatgganctgacgacagtactagacagtctagacgaccgacgcctagtttacttactggtcggacgtaggtacgttacggtttaccgggtggtcgtttcggtttccgtttttacggg

SEQ ID NO: 116330 - DNA, 691 bp, Homo sapiens
  misc_feature: GYAE6OF01B9ZLM.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagctccaacaataagaactacttagcttggtaccagcagaaaccgaggtcagccctctaagctgctctatttacgtgggctacgtccgtaacccgggaacgttcccgggggtccctaggacccgtattccgaaggtcgggacgacggtccggggtcgtacggggactaaggtacttttccacttacctaccgaaccctattacccgaacgtcctaaccggtcccttaggaccgtacgggtccgttaagggaaacggtaacgttgggttacggtacgttaacggttttagttcgtacgttggtaccaaggttactaaacgtttatttaacgtttacttaccgtttccccgttaccggtacccgttttcccgggtacccgttaggggaaacccttaagggtacggtaattaaccgtaccgtaaaacggtaacgttcggttcgtcgtaacccgg

SEQ ID NO: 116331 - DNA, 756 bp, Homo sapiens
  misc_feature: GYAE6OF01AED3S.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagagttgtttagacagctaccaaacaataagaactacttagcttagtaccagcaagaaaccaggtcagtccctacaagctgctactactttacgcgggactactccgtaacccgggaacgtccgggtaccctgaccgtattcgaggtcggacgacggtcgggtcgtacgggaactaggttactttacgaccttcccttaccgaacctacgttacaacggcccgaaacggtcccttaggacccgtaacgggtccttaagggaaaagtcgttacgggtacgggttacttaaagggtttttcttcggaccgttaggttacccgtaaggtaaaccctttaaattttaaaccgttttaagtttaaaccgtttacccgtttaccccgggtttaaaccccggttaaccggtttttaccccccgggggaccccggtttaaacgggggtaaacccgttaaaaggtttaccgggtaaactttaaaccgtaacccggtaaaaaccggtaccgtttaggggtccggtaaccgttaccgg

SEQ ID NO: 116332 - DNA, 739 bp, Homo sapiens
  misc_feature: GYAE6OF01C5XU8.45.37.D04.1.454.CMB.1.raw
  modified_base (324)..(324): a, c, t, g, unknown or other
  misc_feature (324)..(324): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagttgtttagacagctaccaacaaataagaacttacttagcttaggtaccagacaagaaaccaggtcacgcctcctaagctgctactatttacgngggactagtccgtaacccgggaatcccggggtccctaggaccgtaattccgaggtcgacgaggtccggggtctacgggaacctaggtaactttccaccgttctaccaacctacgttcaacggtccaacgtcccgttaggccgtaagggtccttaagggaaacgtagttcgggttacgggtaccttaagggtttttaagttcggtaccgtttaggttaccgtaaggttaaccttaaagttttaacttttacgtttaaacgtttaaccgttttacccccgtacccgggtttaacccgtttttacccggggaaccccggtttacggggtaaaaccccgttaaaagggttaccgggttaaacttaaccgtaaacccgtaaaaaccggttacgttacggggtcggttacccgtaaccggg

SEQ ID NO: 116333 - DNA, 713 bp, Homo sapiens
  misc_feature: GYAE6OF01DYBTJ.45.37.D04.1.454.CMB.1.raw
  modified_base (225)..(225): a, c, t, g, unknown or other
  misc_feature (225)..(225): n is a, c, g, or t
  modified_base (359)..(359): a, c, t, g, unknown or other
  misc_feature (359)..(359): n is a, c, g, or t
  modified_base (490)..(490): a, c, t, g, unknown or other
  misc_feature (490)..(490): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctcgtggtcgccgtacggggactagtcgtgatcgaaccagtctaccacgactccctggctgtgtctcgtgggcgaggacggccaccatacaacngacacggtccagaccgagtagttagtttaacgactagcctaccaaacaaataagtaaactaacgttagtcttacggaacacgacaagaaaccgagtacaacgccttactaacgctagactactaacgtttacgnggtactacgtccgtaaccgggtaaccgttccgggacctacgtaaccgtacgttaccgtaaggcggacgtacggtaccggtcgtacggaactagttacttacgacctactaccactacgtacgagactaacncgtacgagtaccggtataaggatacgtaggtcgtacgtaagtttacgtaacgtcgtacggtaaccagttaataaaacgtttcgttaaactttaccgttaagtttacccccgtttacgtacccgttttacggaaccccggttaggaaaaccggtaaaggttacggtaaaacgtttacgaaaccgggtaaaacctaaccggttacggtcgtaaccggttaacccg

SEQ ID NO: 116334 - DNA, 843 bp, Homo sapiens
  misc_feature: GYAE6OF01CCKPK.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctggtgtctcgtggcgagacgggccaccatcaactgcaagtccagccagtagtgtttagacacgctaccaaacaaataacgtaactacttagtacttacggtaaccaggtaccaacggaaaacctacgggtacacgtaccctaccgtaaacgtcctcgtaccttactaacgttttaccgtcggggtacctaacggtacccggttaaacccccggggtaacgttccccgggggttacccctacgggtaacccgtaagtttccggaacgggttcgggaccgtaacgggtcccgggggttaccgttagggggaaccttaaggttacttttacctaacccgtttcttaacccgaacctacgttaccacggtacaacggtcccgttacggaccggtaacgggcgttaaacggaaagggtacgttacgggtacgggtttacgttaagggtttttagtttccgggtaccgttacggtaaccgttaacggtaaccttaaaaggttttaacttttaacgtttaacccttacccgttttacccgttaccccggtttaaccggttttcccccggtacccgggtttaacccggtaaacgtaaaccgggtttacgtaaaccgttaaacgtaacccggaaaacggttaaccgttcgggtaccgtacgtaccgg

SEQ ID NO: 116335 - DNA, 614 bp, Homo sapiens
  misc_feature: GYAE6OF01DX7IO.45.37.D04.1.454.CMB.1.raw
  modified_base (595)..(595): a, c, t, g, unknown or other
  misc_feature (595)..(595): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaccatccaactgacaagtccagccagagttgtttagacagctaccaacaaataagaactacttagcttggtaccagacaagaaaccaggtcacgcctacctaagctgctctatttacgtgggctagtccgtaacccgggaacgttccccgggggtccctggacccgtattccgaggtggcgaggcggggtcgtggggacaggtactttcacgtcctaccaccatcaagcacgcctgcaggtctagaagtagtggtcggtacgttagttttgtacgtctggtacagtacttaaattatttaattattacctttaccctcccggttaacgtttcccgggacccgtaggggaaaccctaaagggtcgtaattaacgtaaccgtaaacgtntacggtcggtctaacccgg

SEQ ID NO: 116336 - DNA, 691 bp, Homo sapiens
  misc_feature: GYAE6OF01CDV0U.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctgtgcctacggggacatcgtgatcgacccagtctccagacctccctggctgtgtctcgtgggcgaggacgggccaaccgatacaaactgacaacgtccagccagtagttgtttagacacgctaccaaactaataaacgtaacttaacttacgtacgttacggtaaccagacaaacgaaacctaggtacacgtaccctacgtaaagtctcgtaccttactacgtttacgcggactacgtaccgtaacccgggacgttacccggggtcctacggaccgtataccgaggtcgacgacggtcgggtcgtacgggactagtacttcacgtcctacacgtactacgacgcgacgtccgtacgacgtacgggtacgttaagaagttcgtagggtcgtacgtttaacgtttagttcgacgttagtcgtacgtaactaacgtttattacgtttactacctttccgacccgtttacgttacccgggcccgttaagggtaaccgttaaacggttacgtaacgttacgtaaacccgtaaaacggtaccgttaggtaccggttcgtaacg

SEQ ID NO: 116337 - DNA, 637 bp, Homo sapiens
  misc_feature: GYAE6OF01A4OR7.45.37.D04.1.454.CMB.1.raw
  modified_base (323)..(323): a, c, t, g, unknown or other
  misc_feature (323)..(323): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccagccagagttgtttagacagctaccaacaataagaactacttagcttaggaccagcaagaaaccgagtacacgccctacctaagctgctctatttacgngggtacactccgtaacccgggtaacgtcccgggggtccctacggacccgtattcgaacggtggaccgaggcgggtcgtggggactaggtactttccacctctaccaacctatcacgcacgcccgtgaccgacggctaggaagtagttggtcggtacttagtttagtcgtactggtactacgtattaaattagttaacttacttaccgttacccttcccggttaccgttttcccgggaccccgttaggggtaacccttaaagggtcgtaaccttaagtaacccggtaaaccgtacggttgtcgggtacgtaccgg

SEQ ID NO: 116338 - DNA, 709 bp, Homo sapiens
  misc_feature: GYAE6OF01C9DH5.45.37.D04.1.454.CMB.1.raw
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtggaggaagccgtggggcctcagtgaaggtctcctgcaaggcttctggctacaccttcaccggcgactatcctccacgtgggtcgcgacgacggcccctggaccgaagggtcttgagtggagtgggatggactcaaaccctaanaagtggtacgacaacaaactancgacaacgaagtaacgtttcgaggggacgtaagggtaccaaccgtagtacgaaccggacgggaacctaaccggtcccaagtacgaacgacctaaccgacgtaccctaagtaacggttcgggaacgtaccgttaggaccgacgaaacggtaaccgtacggtacctaacgttaccgtaacgggtaaacccgaacggtaccccgggtaaaccctttaaagttttttaaacgtttaaccggttaccgggttaggtaacccggggttaagggtttaaaccggttttaccggggtttttaaccccggggttggggtttccgggtttttttaaccccggggg

SEQ ID NO: 116339 - DNA, 756 bp, Homo sapiens
  misc_feature: GYAE6OF01CC4WH.45.37.D04.1.454.CMB.1.raw
  modified_base (323)..(323): a, c, t, g, unknown or other
  misc_feature (323)..(323): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacgggacatcgtgatgacccagtctccagactccctggctgtgtctctgggcgaggacgggccaccatcaactgacaagtccagccagagtgtttagacagctaccaacaataaagaactacttagcttggtaccagcaagaaaccaggtcacgccctacctaagctgctctatttacgnggcataccgtaacccggaagtccccggggtccctacgaccgtagttaccgaggtcggccgtaggccgggttacgtcgggtaaccgagtacgtttcctaaccgttcctaccaaccctacgttaccgacgtacccgtaaccgcccgttacgacccggtagggtacgttaacgaaacgtacgtttagggtacggtaccgtttaagggtttttaacgttcggttaccgttacggttaccgtaaggttaaccttaaaattttaacggttttaattttaaacctttacccgtttacccgttacccccgggttaaaccgtttttcccggggtaaccccgtttaacgggggtaaaacccttaaacggggttaggttaaaacctttaacgtaaacccggttaaaaacgtaaccggtttaggttacgggtcccgttaaccggg

SEQ ID NO: 116340 - DNA, 702 bp, Homo sapiens
  misc_feature: GYAE6OF01DQ8ZD.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagcgtggtgcagtcgtggggctggaggtggaggaacgccgtggggcctcaggtgaaggtcctcctgcaaggcttcgtggctaccaccttccgaccggcgactactcctccacgtgggtcgcgacgaccggccccgtggacgaagggtctttaggaggtaggtagtcgggagtcggactaccgtaaacccctaagaagtcgggtacggacaaactaaactagtacgacaacgtaacggtaaagtttcgacgggacgtacgggtaccaaccgtagtacggaaccgtaacgggactaaccggtcccaagtaccgaacgaccctaacgaccgtaaccgtaacgacgttacgggacgtccgtacgggaacgtaccggaacggtaccgttaacggacctacgtaccggtaccggaaccggtaaccgaccgggtaaccttaagttttaaccggttacgttacggtcgtaacgggtacggttacggtttaccgggttttaccgggtcgggttccgtttttacgggg

SEQ ID NO: 116341 - DNA, 623 bp, Homo sapiens
  misc_feature: GYAE6OF01AIFPQ.45.37.D04.1.454.CMB.1.raw
  modified_base (352)..(352): a, c, t, g, unknown or other
  misc_feature (352)..(352): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagcctaccaaacaataagaactacttagcttggtaccagcagaaaccaggtcacgcctcctaagctgctacatttacgtgggcactccgtacccgggaacgtcccggggtcccngacccgtattaccgaggtcggcgacgtcgggtcgtacgggacagtactttacactcctaccacatcgagcacgcctcgactaggcgtagaaagtgtggtcgggacttagttttactagtcctaggtcaagtacgtaaatttacgtttaatttaacgttactttccccgtaaccgtttcccgttacccgggtaccccgttagggtaacccgttaaagggtcgtaaacgtaattaaccgtaaacggtaccttagggtcgtacgttcgaacccg

SEQ ID NO: 116342 - DNA, 528 bp, Homo sapiens
  misc_feature: GYAE6OF01E26YX.45.37.D04.1.454.CMB.1.raw
  modified_base (317)..(317): a, c, t, g, unknown or other
  misc_feature (317)..(317): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttagacagctaccaacaataagaactacttagcttggtaccagcagaaaccaggtcagcctcctaagctgctctatttacngggcatccgtacccgggaagtccggggtcctgaccattcgagtggcaggcgggtcgtgggacagtatttcactctccaccntacagcagcctgcagctagaagntggtgctagtttatgctgtcagtactaattattattactacttccctaccgtactttccgggcccttagggacctaaaggngtactacgtacaacgatggtgctacg

SEQ ID NO: 116343 - DNA, 762 bp, Homo sapiens
  misc_feature: GYAE6OF01B3F7G.45.37.D04.1.454.CMB.1.raw
  modified_base (240)..(240): a, c, t, g, unknown or other
  misc_feature (240)..(240): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagcggccacatcaactgacagtccagccagtagttggtttaanaccgtagcctaccaaactaaagtaaagaacttacttagtcctttaggtaacccagaccaagaaaacccgtagggtaccaacgtcccttaccgtaaagccttagccttacgttaacgtttaccggcgggtacctaacgttacccggttaaacccccggggtaagttcccccgggggtaccctacggtaaccgttagttaccggtaggtcggaccggacgggttccggggtaccggtaggggtaacctacggtttaccttttaccgaaccctttccgtaacccgtaacctacgttacccgagtacccgtaacggtcccgtacggaccgacgggttaccgtaagtaaggtacgttcggtacggttacgttacggttttacgtcgtcgttagtccgtaagtaacttaagttaactttattaacgtttccgttcccttacccgttaccggtttcccggacccggttagggaaaccgtaaggttacgtaactacgttaaacccgaagttacgttcgtacggtctaccg

SEQ ID NO: 116344 - DNA, 822 bp, Homo sapiens
  misc_feature: GYAE6OF01B67G0.45.37.D04.1.454.CMB.1.raw
tcagacgcgatcgacacgaccggtgctcgatttagtagcatactgttgggtttggggagagcatcacccagcaaccacatctgtcctctagagaactcccctgagagctccgtttccttaccatggactggacctgggaggactccttcttcgttgggtggcagcagccaacaagacgcccactcccgaggtgcagcgtggtcgcgtaggtcgtggggctggaggtggaagggacggccggtcggggcctacgtaggtagacggttcctcgtagacgaaggtcttcgtcggtcctaccgtaccttccggaccggtaccgtacttactcccgtaccgtacggtcggggtacgaccggaaccgaccgggtccccgtaagggaaccggtaaacggggtccgttacgggaagggttaggggtacggtaggggaacgttacggtaacgttaacccctaaacccgtaaacgaaagggttcgggtaacggaacctaaaaccgaaacttagaccgaaacctaacggtaaaggttaaacgggtttacggaacggggtaccggtaacgggtaacccaaccgtacggaaccggtaaccgggaacgggtaaccaccggtaacccaacgtaccgaacgactaaccgtacgtacccgaacgtaggtaccggaaggtcgaacggtacggacgttaacggacgtaagtaacggtacgtacggtacgggaacccgtaccgggtaaccggttaccgtagtttaaccgtcggtcggtacggagggtaaccggtaggtaccgggttaaaagtttcggtttaaacgggttggttttaacgggg

SEQ ID NO: 116345 - DNA, 782 bp, Homo sapiens
  misc_feature: GYAE6OF01A7X5V.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaccagtctccagactccctgctgtgtctcgtgggcgaggacgggccaccatacaactgacaacgtccagccagtagttgttttagacagcctaccaaactaaataaacgtaacttacgttaagtcttacggtaaccaacggtaccaaacgaaacccgaggtaccacgacccttaccgtaacgctcgcctactaatttacgtgggactacgtaccgtaacccgggtaaccgttcccggggtaccctacggaccgtacgttcgtaacgggtcggacggtacgggtcggggtaccggtagggaactacggttactttaccgacgttcctaccgacctacgtacaacggtccacgtcctacgggaccgacggtacgtaggaacgtcggttagggtacggttaccgttaagttttcgtacgtaccgttagtacgtaagttaaccttaaaggtttactttaacgttaacgttaccccgtttacccgttaaccccggttaccgggttttaccccgggtaccccggttaaggggtaaaccccgttaaagggttaaccggttaaacgttaaaccgtaaaccggttaaacccggtaacgggttttacggtaaccgggtacccgttaaacccgg

SEQ ID NO: 116346 - DNA, 607 bp, Homo sapiens
  misc_feature: GYAE6OF01E5KLK.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcgagtgaaggtctcctgcaaggcttctggctacaccttcaccggcgactactctccactgggtgcgacgacggcccctggacgaagggcttgagtggagtgggatggactacgaaaccctaacgaatgggtaggacaacaaactagtacgacaacgtaggtaacgtttacgagggtcgacggtacaccgagtcggaacccgagggacctacggtaccacgtacgacgaccacgaacgaccctaacgacgttagggacgtacgtaggacgacgtaacgacgtacgaacctacgtcgtacgaccggaaccacgggaccctttaatttaacgttacgtggtacggtcggagtacgttacggtttaccggtggtcgttttaccggg

SEQ ID NO: 116347 - DNA, 695 bp, Homo sapiens
  misc_feature: GYAE6OF01E02NR.45.37.D04.1.454.CMB.1.raw
  modified_base (319)..(319): a, c, t, g, unknown or other
  misc_feature (319)..(319): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcgttggtggcagcagccacaagagcccactcccaggtgcagctggtgcagtcgtggggctgaggtgaggaagccgtgggcctgagtgaggtctccgtgcaggcttctggctaccaccttcgaccggcactatctccacgtggtgcgacgacggcccgtggacgaaggtctagnggtggatggatggactaccgaacctaacgaagtggtagactaacaaactgtacactaacgtagtaacgtttcgagggtacacgggtacaccgtaagtcgaaccgacggtaacaccgtaccaagtccgaacgaccgaactaccggtacctaacgtacgttacggaacgtcggtacgacgaccggttaaggaccgtttaacgaacgtactacggttaaccgggtaaacccgaacccgggttaacccgggttaccgtttaaacgtttttaaaccggtttaaccggttacgggttaaccggttacggggttaaaccgggttacgggttttaaccccgggttttaccggggttacggtttacccggggtttttacccgggg

SEQ ID NO: 116348 - DNA, 797 bp, Homo sapiens
  misc_feature: GYAE6OF01C2ERK.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacggccaccatacaactgacaacgtccagccgagtagttgtttaacgactacgacctaccaaactaaataaacgaaaccttaaccgttaacgtacctttacggtacccaagacctaacggaaacccgtaggtaccgacgtccctaccgtaaggtcctacgtctactacgttttacggtcgggtacctaacgtaccccggtaaccccggggtaacggttcccccgggggttaccctacggaaacccgttagttaccgtacgggtcgggtacgcgggtcccgggggttacgtggggaaccgtacggttacttaccgtaccttactaccctaaccccgtatacccgtaacgcccgtaccgtacccgtcgggaccgtacgggtaccgtaaggaacggtaacgtttggggtacggtaccttaagggtttttacgtagttcccgtagttaacgtaacgttaacgttaaacttttaatttactttaacttacccgttttacccgtaaccccgtttcgtttaccccgggtccccgtaaggggtaaaccctaaggttacggtaaattacgtaaacgtaaaaccgtagttacggtggtccgtaccg

SEQ ID NO: 116349 - DNA, 766 bp, Homo sapiens
  misc_feature: GYAE6OF01C0YWZ.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgaggacgggccaccatacaactgacaacgtccagccagtagttggtttagacagtcctaccaaactaataacgaacttaacttagtcgttacggtaccagacaagaaaccgtagacacgcctactaagctgctactacgtttacgtggactacgtaccgtaacccgggaacgttcccggggtaccctagaaccgtattacgagggtcggcgtacggtcgggtacacgggactagttacttaccgtactcctaccgaacctacgtaccgacggtacccaacggtccgttaacggaccggaacgggtcgttaaaggaaacggtaggttacgggtacggttaacgtttaagtttacggttcgtaccgtggttaccgtaagtaacttaaagtttaactttaacgtttaaccttaaccgtttccccgttacccggtttaaccggttttaccccggggtaaccccgggtttacgggtaaaacccgtttaaacgggggttaaccgtaacgtttaaaccggttaaacccgtaaaaaccgggttacgttaacgggttcgggaacccttaacccggg

SEQ ID NO: 116350 - DNA, 663 bp, Homo sapiens
  misc_feature: GYAE6OF01A4EQ6.45.37.D04.1.454.CMB.1.raw
  modified_base (647)..(647): a, c, t, g, unknown or other
  misc_feature (647)..(647): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccacccgatccaactgacaacgtccagccagagtgtttagacagctcaacaataagaactatagcttgtaccagcaagaaaccaggtacagcctacctaagctgcctctatttactgggactacgtacctacccggggaattccccgggggtccctaggaacccgtacttaccgtacggtacgggaccgtaggccggggttcctaggggacctaggtactttccactcttaccgacctatcagtccaacgtcctgaccgaggcctaggaacgtctggtcggactacgttttaagtcgaccgttgtacgtacgtaactaaagttattttaacgtaactttacgttccgttacccggttaaccgttttcccgggaccccgtttaggggaacccttaaagggttcggtaaacctttaacaaacgttaaacccggaaagttttccggngggttacccgtaacgg

SEQ ID NO: 116351 - DNA, 703 bp, Homo sapiens
  misc_feature: GYAE6OF01BGRXO.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagtccactcccaggtgcagctggtgcagtcgtggggctgaggtgaggaagccgtggggcctcgagtgaaggtcctcgtgcaaggcttcgtggctacaccttcaccggcgactatctccacgtgggtcgcgacgacggccccgtggaacgaagggtcttaggaggtggagtggggatcgggatacccgaaacccgtaaacaagtcgggtaggaccaaacgtaaacgtacgtacgacaacgtaaggtaaacgtttcgaacggggtacgaacggggttaccaaccgtacgtacgggaacccgaacggggaaccgtaaccggtacccgaacgttccgaacgacccgaaccgtaaccgtacccgtaacgacgtacgggaacgtaccgttaggacgtaccgtaacgaccgtacgacgtacgtccggtacggaaccgaccgtaaccggtacccgttaagttttacgttaccgttacggtacggtacggtaacgggttaacggttaccgggttttaccgggtgggttccggtttttacccgggg

SEQ ID NO: 116352 - DNA, 716 bp, Homo sapiens
  misc_feature: GYAE6OF01CIAJK.45.37.D04.1.454.CMB.1.raw
  modified_base (315)..(315): a, c, t, g, unknown or other
  misc_feature (315)..(315): n is a, c, g, or t
tcagacgcgatcgacacgaccggtgctcgatttagtagcatactgttggggtttgggggagctacaacaggcaggcaggggcagcaagatggtgttgcagacccaggtcttcatttctctgttgctctggatctctggtcgccgtacggggacatcgtgatcgacccagtcctaccagtacctcccgtggtctggtcgtctcgtgggcgagacggccacatacaactgacaacgtcacgccagtagttgtttagacacgcctaccaaataaataacgaacttactagtcgttacgtaaccagacgaacgaaacgngtacacgtacctaccgtaagctacgtctacgtacttacggtcggactacgtaccggtaacccgggacggttccccggggtacctacgaccgtattacggaggtcggacgtacggtcgggtacgtaggactagttacttcaccgtctaccgaactactacgacgacgtccgacgtacggacgtacggtacgtaggaaacgttgtcgggtacggtatttaaaggtttctcgggtcttaggtaacctagtaacttaaattttacgttaacttacgtttacccttaccgttacccggttaccgttcccgggtaacccgttaaaggggtaaaccttaaagggttaccgtaaaacttacggtaaaacctaaaacggttccggtttaaggtcccgggtaactaccccg

SEQ ID NO: 116353 - DNA, 606 bp, Homo sapiens
  misc_feature: GYAE6OF01CWHFK.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagccgtggggcctcagtgaaggtctcctgcaaggcttctggctacaccttcaccggcgactatctccacgttgggtgcgacgacggcccctggacgaagggtcttggacggtggagtgggagtggactaccaaccctaacaagtgggtgacaacaaactgtagcacgaagtagtttcgagggcgagggtcaccgatgaccgaggaccacgtcatacgagaccacgacgcctaacagtagggactcgtagacgacgagggactggaacgtacgtacgtacggaccggaccgtaccgggtaccgtttacggttaagtttaccggttggtcgggtaccgggaagggtacgggtacggaaagggtttaaactttaagggtttggttttttaacggggg

SEQ ID NO: 116354 - DNA, 647 bp, Homo sapiens
  misc_feature: GYAE6OF01ARJWD.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttagacagctaccaaacaataagaactacttagcttacggtaccagacaagaaaccaggtcacgcctcctaagctcgctactatttacgtgggactacgtccgtaacccgggaacgttcccggggtccctagaccgtattcgagtcggcacggtcgggtcgtagggacagtactttcacctctaccacctatccagccacgcctgacgagggtctagaacgtagtggtcgtacttaagttttacttggccttggtacccgtaagtaccttaaagttatttaacttacttacctttccccgttaccgttacccggtttacccgggtccccgttaaggggaaacccgtaaacggtcgggtaaacttaaccgtaacggtaaaacccgtagttcgggttaaccggcttaacccgg

SEQ ID NO: 116355 - DNA, 539 bp, Homo sapiens
  misc_feature: GYAE6OF01EEYNQ.45.37.D04.1.454.CMB.1.raw
  modified_base (433)..(433): a, c, t, g, unknown or other
  misc_feature (433)..(433): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacgacggcccctggacaagggcttggaggtggatgggatggatccaaccctaacaagttgggacggcaacaaactatgcacagtaagtttcagggctagggtcacatacgacgagggacacgtcatcagccacacgacctacatggancgtgagcgagactagacatcgtgaccgacgacgtaccgtagtttacgttactggtcgacggtaggtacttcggtttaccggtggtcgttcggtttcgttttacggg

SEQ ID NO: 116356 - DNA, 738 bp, Homo sapiens
  misc_feature: GYAE6OF01C6PJI.45.37.D04.1.454.CMB.1.raw
  modified_base (167)..(167): a, c, t, g, unknown or other
  misc_feature (167)..(167): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagngcccactcccaggtgcagctggtgcagtcgtggggctgaggtgaggaacgccgtggggcctcgagtgaaggtctccgtgcgaaggcttcgtggctacaccttcaccggcgactactcctccacgtgggtgcgacgacggcccctggacgaagggtcttggagtggagtgggatggactaccgaacctaacaagttgggtggacaaactaaactagtacgcaacgtaaggtaacgtttacgacgggtacgaggggtaccaaccgtaagtaccggaacccggaagggtaacccgtaccggtaccctaacgtaccgaacgtaccaaccgacgtacccttaacgacggtagggacgtcggttaggaaccggacgtaacggtacgtacgtaaccgtacgttaccgtaacggaaaccggaacccgtaacccggggtaccctttaaacgttttaaccgttttaacccggttgggttaccgggtaacggggtaacgggtttaacgggtttttacccggggttttaaacccgggggtttcgggttacccggtttttccggggttttttttaacccccggg

SEQ ID NO: 116357 - DNA, 546 bp, Homo sapiens
  misc_feature: GYAE6OF01B03QY.45.37.D04.1.454.CMB.1.raw
  modified_base (319)..(319): a, c, t, g, unknown or other
  misc_feature (319)..(319): n is a, c, g, or t
  modified_base (540)..(540): a, c, t, g, unknown or other
  misc_feature (540)..(540): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaaacaataaagaactacttagcttaggtaccagacaagaaaccaggtcagcctacctaagctgctctatttacnggcagtacgtaccggaacgtccgggtcctcgaccgtattcgagtggcgaggcggtcgtgggacagtattcactctacaccatcagcacgcctgacaggctaggaacgtagtcgtggtactagtttatgctgtacagtactaattattattactacttcctaccgtacgttccggccgtagggtacctaaggtgaactactacgtaaacgtacttaggcgtntcgacc

SEQ ID NO: 116358 - DNA, 680 bp, Homo sapiens
  misc_feature: GYAE6OF01AWV8R.45.37.D04.1.454.CMB.1.raw
  modified_base (428)..(428): a, c, t, g, unknown or other
  misc_feature (428)..(428): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagtgttttagacagctaccaacaataagaactacttagcttggtaccagcaagaaaccaggtcagcctactaagctgctactatttacgtggctactccgtaacccgggaacgttcccggggtaccctcggaccgtattaccgaggtcggcgacggtcgggtcgtacgggactaggtactttcgactctaccgaacctntacacgcaacgtcctaggccgtacgggtacttacggaaagtacgttcgggtaggtacgtttaaggttttacgttcggtaccgttacggtacgtaacggttacttaaagtttacttttaagtttaaccttacccgtttccccgttaccggtttacccggtttacccgggtacccgttaaccgggtaaaccgtaaagggttcgtaacttaaaccgtaacgtaaaccggtaacgttcggtacggtaccgtaccgg

SEQ ID NO: 116359 - DNA, 729 bp, Homo sapiens
  misc_feature: GYAE6OF01BF15U.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggacgggccaccatcaactgcaagtccagccagtagttgttttagacagctaccaaacaataagaactacttagcttaggaccagcaacgaaaccaggtacacggcctacctaagctgtcctactattttacgtggactagtccgtaacccggggaacgttccccggggtcctcggaaccgtattcgaggtggcgtacgggtccgggttcggtaggggactaacggtacttttaccacccgtttctacccgaaccctacttaccgaacggtccaacggtcccgttacggacccgtaagggtccctaagggaacgttacggttagggtagggtaccgtttaaggttttaacgttggtccgtttacgtacgacggttaaaccttaatttaaacttttagttaactttaccgtttacccgtcccggttacccgtttcccgggtaacccggtaccggggtaaacttaacgggttaacgtacgttaaaccgtaaacgtaaaccggtaacgttgggtaccgtcgttaacggtaacccc

SEQ ID NO: 116360 - DNA, 747 bp, Homo sapiens
  misc_feature: GYAE6OF01EBENS.45.37.D04.1.454.CMB.1.raw
  modified_base (169)..(169): a, c, t, g, unknown or other
  misc_feature (169)..(169): n is a, c, g, or t
  modified_base (278)..(278): a, c, t, g, unknown or other
  misc_feature (278)..(278): n is a, c, g, or t
tcagacgcgatcgacacgaccggtgctcgatttagtagcatactgttgggtttgggggagcatcacccagcaaccacatctgtcctctagagaactcccctgagagctccgttcctcaccatggactcggaccgtggaggactcctcttcgtggtggcagcacgccaanaacgacgcccaccgtcccgaggtcgcacgcgtggtgctacggtcggtcggggtctgggaggtaggaacgggtacgtcggtcggggcctacgaggtagtacggtcctcgngacgtacggtctcgtcggacctaccgtacttccgaccgactactacttcctccgtacggttcgggcgaccgaccgacccggtcccgtaacggaacggtaacgggttcgttaggtagggtacggtaggttacgggacgtacggaacgtaacccgtaaacccgtaaaggtaaggtccgggttaacggaaccaaacgtaaactagtacgacgaacgtaaggtacggttacggacgggtacgtacggtaccacgtagtaccggaacggtacgacaccgtcaacgtcgaaccgtagaccgacttaccggaactacggacgtacgccgtaacggacggtaccgtaacttacgaacaccgtacgtaccgacggaaccgtacccggtactacggtttaactttacctaggtccgtacgggtaagttaacggtttacgttacggttacggttcgggtaccggtttggttttacccggg

SEQ ID NO: 116361 - DNA, 645 bp, Homo sapiens
  misc_feature: GYAE6OF01EQ22C.45.37.D04.1.454.CMB.1.raw
tcagacgcgatcgacacgaccggtgctcgatttagtagcatactgttggggtttgggggagctacaacaggcaggcaggggcagcaagatggtgttgcagacccaggtcttcatttctctgttgctctggatctctggtgccgtacggggacatcgtgatgacccagtctccagactccctgactgtgtctcgtgggcgagagggccaccatcaactgcaggtccagccagagttgttttacgcccaatagtaagaactacttagcttagaccagacagaagccgagggcacgcctccgtacgcctgctttcgtttacgtcggggtcctccggtacccgggtacggtcccggggtcctacggaccgtattacgaggtcgacgaggccggggtcgtggggctaggtactttcactcaccacatacgacgaccacgcctggccgacgcccgtagaacgtagtcgtcgtacttacgtttaaccgtacgttacgtcgtaagtacttaaacgttattaacggtagtaacgttacgtttccctacgttcctaacggtttaccgggccgggtaaacgggtaaccgtagggttacgaaccgtacgtaaccgtaaaccggtacgtacggttcggactaccgtccaaccgttacg

SEQ ID NO: 116362 - DNA, 766 bp, Homo sapiens
  misc_feature: GYAE6OF01BNZK7.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtcctccagacctccctggctgtgtctcgtgggcgagagggccaccatcaactgacaagtccagccagagttgtttagacagacctaccaaactaataaacgtaactacgttagtcgttacggtaccagaccaacggtaaaccaggttaccacgtccctaccgtaagcctgacctctaagtttaccgtgggacctacgtaccggtaaccccgggaacgttccccgggggtaccctacggaacccgtacttccgacggttcggaccgtacggtccggggttacgtacgggtactaggttactttaccgaccttacctaccctaacgtcttacgacgtacgacgccgtacggcgtaacgggtcctaggtaacggagttcggtcgttacgttacggtttaattccggacgttacgtacgagttaaccttaagtttaactttacctttaacgttacccgtttacccggtttaacccggttacccggttttaacccgggtacccggttaaacgggtaaacccggtttaaaacggttaccgggttaaacttaaaccggttaaacccgtaaacggttaacggtttacccggtacggttacccggtaacg

SEQ ID NO: 116363 - DNA, 565 bp, Homo sapiens
  misc_feature: GYAE6OF01DX3LQ.45.37.D04.1.454.CMB.1.raw
  modified_base (327)..(327): a, c, t, g, unknown or other
  misc_feature (327)..(327): n is a, c, g, or t
  modified_base (381)..(381): a, c, t, g, unknown or other
  misc_feature (381)..(381): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (555)..(555): a, c, t, g, unknown or other
  misc_feature (555)..(555): n is a, c, g, or t
tcagacgcgatcgacacgaccggtgctcgatttagtagcatactgttgggtttgggggagctacaacaggcaggcagggcagcaagatggtgttgcagacccaggtcttcatttctctgttgctctggatctctggtgcctacggggacatcgtgatcgacccagtctccagactcccgtggctgtgtctcgtggcgagaggccaccatcaactgacaagtccagccagtagttgtttagactagctacaaacaataacgaactacgttagtcttggaccagcaagaaccaggtcacgcctacctaagctcgcttacgactttacgnggctaacgtccgtaccgggaactcccggggtacctgaccgattcgagcggtacnggcggtcgtgggacagtacttcactctacgaactgcacgcgtacgcctgaccgtagcctaggaagtgtgtcggattgtttanccgngttgactagattaattctagttatccttccgacgttacgttccgaccggttaggaaacctagggtcaattaaccgacgaaacttcggngtcgcctacg

SEQ ID NO: 116364 - DNA, 664 bp, Homo sapiens
  misc_feature: GYAE6OF01A4LGE.45.37.D04.1.454.CMB.1.raw
  modified_base (293)..(293): a, c, t, g, unknown or other
  misc_feature (293)..(293): n is a, c, g, or t
  modified_base (328)..(328): a, c, t, g, unknown or other
  misc_feature (328)..(328): n is a, c, g, or t
  modified_base (513)..(513): a, c, t, g, unknown or other
  misc_feature (513)..(513): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctcagactccctggctgtgtctcgtgggcgagacgggccaccgatcaactgacaagtccagccagagttgtttagactagctaccaacaataagaactacttagcttagtaccagacaagaaaccgnggtccagccctaccaagctgacctactatttacgnggactacgtaccggtaacccgggaacggttcccggggtaccctacgtaccgtagtcgtaggtcggcgacggtccgggtcgtacggacgagttacttcgacgtctaccacctacgtacacgccaacgtccctaggaccgtacggactaacggtaagtacgtcggttacggtacctttaaggttttntcggtactccggttagacgttaactaagtttaactttattaacgttccttacccgtttaccgttaccgtttacccggtcccgttaacgggaaaccgttacgtaggtaactaaacgttaccggtaaaacgttatacgggttcgaccgtaccg

SEQ ID NO: 116365 - DNA, 601 bp, Homo sapiens
  misc_feature: GYAE6OF01A3WME.45.37.D04.1.454.CMB.1.raw
  modified_base (380)..(380): a, c, t, g, unknown or other
  misc_feature (380)..(380): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctgggtgcagtcgtggggctggaggtgaggagccgtggggcctcgagtgaaggtctcgtgacaggtcttcgtggctacaccttcgaccggcgtactatctccacgtgggtcgcgacgcggcccgtggacgacgggctggaggtggagtgggatggaactaccaaacccgtaacagtggtgacaacaaactatagacaanagtagttcgaggcagggcacgatacgacgaggacacgacatacgacgacacgactacctanagtacgacggtctaggaacgaccgtagaccgtagtaccctaagtccgtaacggaccggaaccgaccgttaacttacgttttacgtagttggacggtacggtaagtcggtttacgggttacccgggttggttccggttttggttttccggtttaaccgggg

SEQ ID NO: 116366 - DNA, 749 bp, Homo sapiens
  misc_feature: GYAE6OF01EPQNF.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagcctaccaaacaataagaactacttagcttaggtaccagacaagaaaaccgaggtaccagccctactaaacgctgcctactattttacgtgggactacttaccgtaacccgggtaacgttcccggggtccctacggacccgtacttcgaggtggcgaggtcgggttcgtagggaaccaggtacctttacaccttcctaccgaaccctagtccaacgggtcccacggtccccgttggaccctacgggtctaacggaaagtacggttacgggttacgggtaccgtttaaggtttttacgttccggttacgttacgtacccgtaaggtaacctttaaaagtttaacttttaacgttttaaactttaacccgtttccccgtttaccccggttaaacccgtttttcccgggacccccggtttaacgggggaaaccccttaaaagggttacgggtaacttaaaccgttaacgtaaaacccgggtaacgtttcggtaacgggtccgttaacccgg

SEQ ID NO: 116367 - DNA, 724 bp, Homo sapiens
  misc_feature: GYAE6OF01B959H.45.37.D04.1.454.CMB.1.raw
  modified_base (458)..(458): a, c, t, g, unknown or other
  misc_feature (458)..(458): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatcgacccagtctccagacctccctggctgtgtctcgtgggcgagagggaccaccatacaactgacaagtccagccagtaggttgttttacgacaggtactaccaaacaataacgaactacttagtcgttaggtaccagacaacgaaaccaggtacacgtccctacctaagctacgcctactagtttacgtcgggtacctacgtaccgtaacccgggaacgtcccggggtccctgaccgtattcgagtcggcgacggtcgggtcgtgggactacggtacttctacgtcctactaccactgacncacgtactcggacgacgggtacgtagtaacgtggttacggtacgggttactttaacggttttacggtccgtacgttcgtacgtaacgttaacgttaaactttaagttttaacttaacgtttacccttaaccggttccccggtttaaccgggttttacccggtaccccgggttaacgggttaaaacccgtaaacggggtttaacgttaacttaaaccgttaaaccccggaaaacggttacgtttcgggtaaccgggtccttaaccgg

SEQ ID NO: 116368 - DNA, 682 bp, Homo sapiens
  misc_feature: GYAE6OF01ALBGL.45.37.D04.1.454.CMB.1.raw
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtggggcgaggagggcccaccatcaactgcaacgtccagccaaggtagttggttttagacagcctaccaacaataagaactacttagcttggtaccagcaacgaaaccgaggtccagccctacctaagctgctntagtttacngggactactccgtaacccgggacgtcccgggggtccctggtacccgtattcgacggtcgggccgagggtccggggtcgtacggggtactacggtacgtttacccgactcctaccaacctaactaccgagtacccgaacgtccctagccgacgggtacctaggaaggtacgttggtacggtacgttaaggttttcttacgtccgttacgtacgtaacgtacttaaatttatttaacttacgttacctttcccgttcccgtaccggtttcccggtacccgttacgggtaaacccgtaaggttacggtaaccttaacgtaaccgaaccggttaactggtaccgtcctacg

SEQ ID NO: 116369 - DNA, 661 bp, Homo sapiens
  misc_feature: GYAE6OF01A50W9.45.37.D04.1.454.CMB.1.raw
  modified_base (325)..(325): a, c, t, g, unknown or other
  misc_feature (325)..(325): n is a, c, g, or t
  modified_base (378)..(378): a, c, t, g, unknown or other
  misc_feature (378)..(378): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccaacaagagcccactcccaggtgcagcgtggtgcagtcgtggggctgaggtgaggaacgccgtggggcctgagtgaacggtctccgtgacgaaggtcttcgtggtactacctaccgttccgaccggcgtactatcctccgacgtgggtcgcgacgacggcccgnggacgaagggtctgaggtggagtggagtggactaccaaacctaacgtagtggngacaacaaactagtacgacacgtaagtaacgtttacgacggggtacgagggtacaaccgagtacggaaccgaacggacctacgtaccactacgaacgaccacgaacgtacccgtaacacggtagggaccgtagtacggaagtaccgaaggtaccgtagtaccgtacgtaccgtaacgacccgtaaccggacccgttacgttaatttacgttaaccggttcgttacggacgggttacgggttacggtttaccgggtttccgggttacggttcggttttaccggg

SEQ ID NO: 116370 - DNA, 740 bp, Homo sapiens
  misc_feature: GYAE6OF01DAZ8J.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtcgccgtacgggacatcgtgatcgacccagtctccagacctcctggctgtgtctcgtgggcgaggacggccaaccatacaacgtgacaacgtccagccgagtagtttgtttacgacacgtcctaaccaaactaaataaacgaacttaacgttagtctttacggtaaccagaccgaaacgaaaccgtaggtaccaccggtccctaccgtaagccgttacgtaccttactaacgttttacggtcgggactaccgttacccgggtaacccgggtacggttccccggggtacctacggaaccgttattcgaggtcggacggacggtccggggtcgtacgggaactacggtactttaccgactccgtaccacctacgtacgaacgccgaccgtccgaggaccgtacggtacgtaaggacgtacggtcggttacgtacgtttaagtttcgtcgtacgttacgtaactacgtaacttaatttactttattaccgtttacccgtttcccgtacccgtttaccggttcccggtaacccgtaagggtaaccttaaggtacggttaaactaacggttaaaccgaaacggttacgttacggtccgtaccggtacg

SEQ ID NO: 116371 - DNA, 753 bp, Homo sapiens
  misc_feature: GYAE6OF01EC0AO.45.37.D04.1.454.CMB.1.raw
  modified_base (565)..(565): a, c, t, g, unknown or other
  misc_feature (565)..(565): n is a, c, g, or t
  modified_base (607)..(607): a, c, t, g, unknown or other
  misc_feature (607)..(607): n is a, c, g, or t
  modified_base (651)..(651): a, c, t, g, unknown or other
  misc_feature (651)..(651): n is a, c, g, or t
  modified_base (740)..(740): a, c, t, g, unknown or other
  misc_feature (740)..(740): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctcgtggactctcgtggtcgccgtacggggacagtcgtgactcgaccctagtcctaccacgtacctcccgtggcttgtcgtcgtcgtgggacggacggacggcccacctactactaacgtcgacgtacgtccacgaccgtagtacggtttagtttacgacctacgtacctaaccgaaaactaaaacgttaaacgtaaccgtttaaccgttacggtaccggtttaccggaaacccgtaacgaacccgaaaacggtaaaacccggtacggtacccgacggttaccccttaaccggtaaccgcggtaccgttaccttacgtttacgtttacgggtacggtactaccgttacccgggtaacccgggtaccggtacccgggtccctacgtacgtactacggcggtacggacgtcggtcggtacggacggtacttagttaccttaccnccgttactaccgactacgacgtaccgaccgtacgcgtaccgnggtacggtacgtaagacgtttggtcggtagttactttagttcgngtccgtgataacgtatatttacgttactcgttctacccgttccgtacggcggtacctaaggacgtagtcttaacacgtaaccggtaacnggttgtcgctacg

SEQ ID NO: 116372 - DNA, 561 bp, Homo sapiens
  misc_feature: GYAE6OF01EF07M.45.37.D04.1.454.CMB.1.raw
  modified_base (316)..(316): a, c, t, g, unknown or other
  misc_feature (316)..(316): n is a, c, g, or t
  modified_base (556)..(556): a, c, t, g, unknown or other
  misc_feature (556)..(556): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagtgttttagacagcctaccaacaataaagaactacttagcttggtaccagcaagaaaccaggtcagcctctaagctgctctatttacngggcatccgtacccgggtaacgtccggggtaccctcgaccgtattcgagtcggcgacggtcgggtctgggacagtactttcactctacaccatcagtcacgcctgcagacgtgaagtgtgtgtctagtttatcgacgtgtacagtactaattagttacttatacttcctccgtaccgtttccggacccgttaggaacctaagggttagattaacgtaaccgtaaacgtaagtcgtacgtntaccg

SEQ ID NO: 116373 - DNA, 882 bp, Homo sapiens
  misc_feature: GYAE6OF01COFM2.45.37.D04.1.454.CMB.1.raw
  modified_base (146)..(146): a, c, t, g, unknown or other
  misc_feature (146)..(146): n is a, c, g, or t
tcagacgcgatcgacacgaccggtgctcgatttagtagcatactggttgggtttggggagagcatccacccagcaaccacatctgtcctctagagaactccctgagacgcttccgttcctcaccatcggactggaccgtggaaggnttccttcttcgttggtggacagtcacgccaacgaagacgtcccactccgaggtgcgagcgttgggtcgcgtcgtcggtggggctaggagggtgacgggacgccggtcgggccttcgaggtagaccggtctcgtcgacgtacggtccttcgtcggtaccttaccgtacccgttaccgaccggtactaacttaccgtccgtaccggtaacggtcggggtaccgaccggaccggacccgggttaccccgtaagggaaccgtaacgggtcgttaagggtcggggttaagacggtaggggtaactagggtaaccttaaacccaaaccgtttaaagacgggttacgggttacggaaacctaaacgtaaaacgttcgtacccggataaacggttaacggttaaacgtttccgggaagtacccgggtaacggtccctaaacgacgggttacgaaaccgggttaacgaaccggtaaccttcgaaccgttgaaaccgccggaacttaaccgaacccggttagaaccgggtagggtaaccgacggttaagaacccggggtactacggtaaccgtacgaacgtacggtttaaccggaacggtaccccggtaaacgtacccggggtttttaacaacggttttttaacgtcggttaaccggtacggggttaaacgggttacggggtttaaccggtttttcccgggggttaaaccggtttgggttttaaccccggttttttaaacccgggg

SEQ ID NO: 116374 - DNA, 846 bp, Homo sapiens
  misc_feature: GYAE6OF01ETUGC.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacgggacatcgtgatgacccagtctccagactccctggctgtgtctcgtgggcgagacggccaccgatacaacgtcgacaacgtccacgaccgagagtttaggttttaacgaccgtacggtacctaccaaactaaagtaaacgaaacttaactagtacgtttacggtaaccaagacaaacggaaaccgtacggtaccaacggtacccttaccgtaaagccgtacggtaccttacttaacgttttacggacggtactaacgttaccggtaaaccccggggtaaacggttcccccgggggttaccctaccggtaacccggttacgttaccgtaacgggtcgggtaccgtacggggtccggggttaccgtacgggggaaactaccggtttaacgttttacccgaacccgttccctaccccgtaccgtaacgttaccggaaccggtaccgaaccgggtcccttacgggaccgaacggtcgtaaggtaaaaccggtgtccggggttacgtacgtttaagtttacttcgggtacttacggttaccgaagttaacttaaacgtttaacgttttaacgtttaacttaccgtttacccgttacccgggtaaccctttttcccgggggtaccctaacggggtaaccgtaaaacggttgtaaaccgttaacgtaaccggtaaaacgtacggttacggttacggtccgtaaacgg

SEQ ID NO: 116375 - DNA, 845 bp, Homo sapiens
  misc_feature: GYAE6OF01CM6JV.45.37.D04.1.454.CMB.1.raw
  modified_base (241)..(241): a, c, t, g, unknown or other
  misc_feature (241)..(241): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacgggacatcgtgatgacccagtctccagacctcccgtggctgtgtctcgtggggcaggcgggacccaccattcaaacttgcaagtccagccagagtntttagacagcctaccaaacaataagaaacttacttagacttcggtaaccagacaagaaaccaggtccaacgtccctaccgtaaagcgtcgacctttacaacgtttaacgtcgggacctacgttacccgtaaccccggggtaacgttccccgggggttaccccagggtaaaccccgtagtttaccgaacgggttacgggtcccgaagggtccccgggggtttattacccggggggaaacttaagggtaactttttacccgaacctttccgtacccgaaaccgtaacttcccggaaattccccgaaacggttccccggtaaggaccccgtaggggaccctttaaggggaaaacgtaacgtttgggttaacgggggtcctttaaagggtttttttaacgcggttacccgtttaggtacccaacggtaactttaaagtttaattttaacgttttaacgttaacctttcccccgtttaaacccgggttaccgttttacccggggttccccgttaaaccgggggaaaaccccttaaaagggtttccgggaaactttagttaaaaccccgtaaaacgttaaaccggtttcgggcggttaccttaaaccggg

SEQ ID NO: 116376 - DNA, 758 bp, Homo sapiens
  misc_feature: GYAE6OF01EJS21.45.37.D04.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (570)..(570): a, c, t, g, unknown or other
  misc_feature (570)..(570): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcgagtcgnggggctgaggtgaggaacgccgtggggcctcaggtgaaggtctctgcaaggcttcgnggctacnccttcgaccggcgactatcctaccacgtgggtcgcgaccgacgggccccgtaggacgaagggtcgttaggaggtgggagtagggtatacggactaccaaacccgtaaagaacgtagggtacggacaaaccgtaaaacgttagtacgtaccgtaaacgaaggtaaacggtttccgaaggggtacccgtaacggggtaccaacccggtaagtaacgggtaaacccgaacggggaaaccgtaaccggtaccgtaacgtaccgaacggtaccgtaaccgaaccgtacccgtaacgacggtacggggtaacnccggttaaggaaccgtacgaacggaccggttacgaacgtacgttaccggtaacggtaaccggtaccggtaaccgggtaccgtttaaacgttttaaccgttaacggttcggtaacggtacggttaacggggttacgtttaccggggtttaaccgggttacgggttccgttttaacgggtttttacccgg

SEQ ID NO: 116377 - DNA, 613 bp, Homo sapiens
  misc_feature: GYAE6OF01B6D1G.45.37.D04.1.454.CMB.1.raw
  modified_base (316)..(316): a, c, t, g, unknown or other
  misc_feature (316)..(316): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactacttagcttaggtaccagcaacgaaaccaggtcacgcctctaagctgctctatttacgnggcatccgtaccgggaactcccggggtccctagaccgtattcgagtcggcgacgcgggtacgtgggactagtactttccacgtctcacctatacgagccacgtccgtgacgaggcgtagaagtagtgtggtcttaagtttacgtgtcgtagtcgagtactaagtttatttaacttacttacttcccgttaccggttaccgtttacccggtacccggttaacggggtaaccctaaagggttcggtaaattaaccgtaaaccgtaaacggttaactgggttacggtcttaccgggtacc

SEQ ID NO: 116378 - DNA, 716 bp, Homo sapiens
  misc_feature: GYAE6OF01A4SM2.45.37.D04.1.454.CMB.1.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaggcttcnggctacnccttcaccggcgactactcctccacgtgggtcgcgacgacggccccgtaggacgaacgggtcttaggacggtggaggtagggagtagggaacttacccaaacccgtaagtaagttcgggtacgaccaaactaaactacgtacgactaacgaaggttaacgtttcggaaggggtacggtacgggtacccaaccgtacgtacggaacccgaacggggtaccgtaaccgttacccgacgtaccgaacgtacccgacgtaccgacccgttacacgggttacggaacgaccgtaggaaccgtacgaacggttaccgagtaacctacggtaccggtaacgaaccggtaacccgaccggtaacctttaattttaacggtttaccttagggtaccgtacggggtaacggggttttacgtttacccgggtttaccggggtcggtttccgggttttttaccccggg

SEQ ID NO: 116379 - DNA, 767 bp, Homo sapiens
  misc_feature: GYAE6OF01DKB6W.45.37.D04.1.454.CMB.1.raw
  modified_base (309)..(309): a, c, t, g, unknown or other
  misc_feature (309)..(309): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacggccaccataccaactgacaacgtccagccagtagttgttttaagacagactaccaacaataaacgaacttacttacgtcgttacggtaccagactaacgaaaccgnggtacacgtacctaccgtaaagtctcggtaccttactacgtttacgtcgggactacgtacccggtaaccgggtaacgtcccggggttccctagtaccgtattccgtagtcggccgaggtcgggtcgtacgggactagtacttacacctcgtaccaactactccgaaggccctacggccttacgggaccgtacgggtacgtaagaacggtacggtttcgggtcggttaactttagggtttttcgtcggtaccgtttacgggtaaccctaaggtaaccgtttaaattttaacttttacgttttaaacgttaccccgttttaccccggtacccggttttacccggtttcccccggggtaaacccggtttacggggttaaaaccccgttaaagggttagtaaacctttaaacggtaaacccgttaaaacggtacggtttcgggacggttaccgtaacccggg

SEQ ID NO: 116380 - DNA, 696 bp, Homo sapiens
  misc_feature: GYAE6OF01D39QI.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggccaccatccaactcgacaagtccacgccagtagttgttttagactacgcctaccaaacaaataaacgtaacttaacttacgtcttacggtaaccagacaacgaaaccgtacggtacacgcctaccgtaagctcgctactatttacgtggctacgtccgtaacccggtacgtccggggtccctacggaccgtacttcgaggtcggacgacggtcggggtcgtacgggactacggttactttaccgtaccttcctaaccgtaccctagtaccgacggtccacggtccgtacggaccggacggtacggtaaggaagtacggttcggtacggttacgtttaagttttcgtacgttacgttcggtacctaaggtaacctttaagtttaatttacttacgttaaccgtttcccgtaccgttaccgtttcccggaccggttacggaacgtaaggtacggtactaacgtaccgtaaacttaggtcggtgtcgtaccg

SEQ ID NO: 116381 - DNA, 534 bp, Homo sapiens
  misc_feature: GYAE6OF01BRJXA.45.37.D04.1.454.CMB.1.raw
  modified_base (337)..(337): a, c, t, g, unknown or other
  misc_feature (337)..(337): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaaccctanaatggtggcaacaactatgacacagaagtttcgagggcagggtcaccgatcgaacgagggacacgtccatcagcacagccacagtggagcgtagacgacagactaggacatcgtcgaacgaccaccggtacctagttttactacgttgtggcggaaggtagttcggtttaaccgggtggttcgttggttttacccgg

SEQ ID NO: 116382 - DNA, 821 bp, Homo sapiens
  misc_feature: GYAE6OF01D3RBH.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcattttctctgttgctctggatctctggtgccgtacggggacatcgtgatcgacccagtctccagactccctggctgtgtctcgtcgggcgaggacgggccaccatacaacctgacaacgtccacgccgaagtagttgttttagacagtacctaccaaactaaataaacgtaaacttacgttacgtcgtttacggtaaccacgaacgaacgaaaaccgaggttccaacgtaccctaccgtaacgctggtacctactacgttttacgtgggtacctaacgtccccggtaacccggggtaacgtccccgggggttaccctacggaaccgtacgtttacgacggtcgggcggtaacgggccgggttacggtacgggaacgtaggttaactttacctaccttcctaccgtacctaacgttaaccgacgtacgtaaccgtccgtcggacgaacggtcgtaggaaacggtcgtagggtggtacgtttaacggtttagttcggtacttacgggtactaacggtacctttaaagtttaagtttttaacgttaacgtttaacccgttttcccccggttaaaccggtttacccggtttaaccccggggttacccggtttaaacggggtaaacccgtttaacggggttacggttaaaccgtttacccgaaaaccgtttaaaccgggaacggtttacccgggaggttccccgttagaaacccccg

SEQ ID NO: 116383 - DNA, 636 bp, Homo sapiens
  misc_feature: GYAE6OF01D4K9Y.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaacgtccagccagtagttagttttagacagcctaccaaactaataagaaccttacttaagtcttacggtaaccagacaacgaaaccgaggtaccacgcccttacctaagcctcgactcttaagttttacgtgggactacgtaccgtaacccgggaacggttcccggggtccctacggaacctattacgaggtggaccgtaggtcggtacgtcggggacagtagtttccactctacacctatcgagcacgctgacgcggactagagtagtgtgtacttagttatcgctcggtacgagtactattaacgttatttacttaccttcccgttcccgtacgttttcccgggacccgttagggtaacccgtaagttcggtaactaacgttaacgaaaaccgttacgtcggtacgtccgtacgg

SEQ ID NO: 116384 - DNA, 752 bp, Homo sapiens
  misc_feature: GYAE6OF01DF7QS.45.37.D04.1.454.CMB.1.raw
tcagacgcgatcgacacgaccggtgctcgatttagtagcatactgttgggtttgggggaacatcacccagcaaccacatctgtcctctagagaatcccctgagagctccgttcctcaccatggactggacctggaggatcctcttcttggtggcagcagccacaagacgcccacctcccgaggtgcagtctggtgcagtcgtggggctgaggtgaggaagccgtggggcctgaggtgaggtcctcctgcgaggcttcgtggacctacgaccttccgaccggcgactactcctaccgacgtgggtgaccgaccgacggccccgtaggaacgaacggggtctttaggaggtgggacggtagggacgtagggtaactacccgaaaacccgttaacgaaggttcggtacgggacaactaaaacgtagtcgacgaacgtaaggtaaacggtttcgaacggggtacgtacggggtaacctacccgtaacggttaccggaacccggaacggggtaacccgtaaccggttacccgtaacgttacccgaacggacctaaaccggaaccgtacccgtaaccgtaggtacggacggtcgttacggacgaacgtacgtacgtacgacgtacgttacgtacgaacccggtaccgaaccggtaccgttaagttttaaccgttacttacggtcgtaccgggtaggttaccggtttcgggtttaacgggttccggttacggtttccgggtttttcgtttaacccgggg

SEQ ID NO: 116385 - DNA, 513 bp, Homo sapiens
  misc_feature: GYAE6OF01BKO2U.45.37.D04.1.454.CMB.1.raw
  modified_base (254)..(254): a, c, t, g, unknown or other
  misc_feature (254)..(254): n is a, c, g, or t
  modified_base (316)..(316): a, c, t, g, unknown or other
  misc_feature (316)..(316): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatacaactgcaacgtccagccagtagtgttttagacagctccgaaanaataagaactacttagcgttagaccagcagaaccaggtcagcctcaagctgctcatttacgnggcagtccgtaccgggaagtcccggggtcctacgaccgattcgagtggcgagtcgggtntgggcagtactttcactctacaccntacgnccacgtctgcgagctagaagatggtagcttagttatgtntgtcantaattattatatcttcgtccgtacgttcgccttaggacctaagcgatanacaacatgtgntcg

SEQ ID NO: 116386 - DNA, 753 bp, Homo sapiens
  misc_feature: GYAE6OF01D0SA9.45.37.D04.1.454.CMB.1.raw
  modified_base (208)..(208): a, c, t, g, unknown or other
  misc_feature (208)..(208): n is a, c, g, or t
  modified_base (262)..(262): a, c, t, g, unknown or other
  misc_feature (262)..(262): n is a, c, g, or t
  modified_base (486)..(486): a, c, t, g, unknown or other
  misc_feature (486)..(486): n is a, c, g, or t
  modified_base (517)..(517): a, c, t, g, unknown or other
  misc_feature (517)..(517): n is a, c, g, or t
  modified_base (700)..(700): a, c, t, g, unknown or other
  misc_feature (700)..(700): n is a, c, g, or t
tcagacgcgatcgacacgaccggtgctcgatttagtagcatactgttgggtttgggggagctacaacaggcaggcgaggggcagcaagatggtgttgcagacccaggtcttcatttctctgttgctctggatctcgtggtcgccgtaacggggactagtcgtagactcgaccctagtcctccacgcctcccgtggctgtcgtctcggngggcgaggacggcctacatacaagtcgacacgtcagaccgtagtagttagttanacgacgtacctaaccgaaactaaataaacgtaaccttacgttacgtaccggtacggaaaccagacgaaacaaacggtacggtcaacgtacccgttacaagcctcgtaccttattaacgttcgtcggacctacgtacccggtaaccgggtcggttacccgggtcccgtacgtaacgtacgtacggtacggtcgacgtttacgggtccggtaacgtccgggtaaanacggtttcttaccggtacctacctacctaanaccgtacgacacggtaccgtacgaaccgttcgacggtacggaagtagtacgggtgtacggtagtttactacgttgtaacggtcctaacgtagttaaacttaagtttaaccttaattacccgtaccgttttaccgtaccttcccgggtttacccgggccggttaacggaaaacggtacgttaanaacccggttaaacgaaaccggttaataaccggtccggttaacgccggtaaacg

SEQ ID NO: 116387 - DNA, 828 bp, Homo sapiens
  misc_feature: GYAE6OF01DRSKB.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggcccacgtactactacgtcgacgtacgtaccgacgacgtaaggtacgtttaggttaacgacgaccgtacctaaccaaacgtaaagtaaacgtaacttaacgtacgttacgttacgaactacgacgtaaacgaaccgtgacgaccgtaccgtacgagtcgtactacttacttacgttacggtacggacttaccgtaaccgggtaaccggtacccgggttcccggtccgtaaccgtacgttagtacggtacgtcggtacgcggggttacggacggtacggtaagtacgttacttacccgtacttcccgaacctaaccgtactacgaccggtagtaccgtaccgacgggacgtacgtaggttaaaccgaaggttcgggtttccggtacgtttaagttttacgtttggtaccgtaggttaccgtaagggtactaaaagttttacgtttaactttttacgtaaaccttccccccggttttacggtaccccgggtttttaacccggtacccccgggtaacgggttaaaacccggttaaaaggtaaccgggtttaaacgttaaaccgtaaacccgttaaaaacgggtaaacgtttaccggggtcgggttaacgttaccccggtaaacccg

SEQ ID NO: 116388 - DNA, 535 bp, Homo sapiens
  misc_feature: GYAE6OF01BZMLQ.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagcctccaaacaataagaactacttagcttggtaccagcagaaaccaggtcagcctcctaagctgctcattactggcatcgtacccgggaatcccggggtcctgaccgattcagtggcaggcgggtctgggacagtattcactctcaccatcagcagcctgccaggctagaagtgtgtggctagtttctgcttgtctagctaattattattatacttccctaccgtaccgtttccggacccgttgggaaccctaaaggtggtaactaatacgaaaccggtaatcggtggtctacg

SEQ ID NO: 116389 - DNA, 615 bp, Homo sapiens
  misc_feature: GYAE6OF01B0B7B.45.37.D04.1.454.CMB.1.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactcctggctgtgtctcgtgggcgagacgggccaccatcaactgacaagtccagccagagttgttttaggacagctaccaacaataacgaactacttagtcttggtaaccagcaagaaccnggtcacgcctctaagctgactntattactggcactccgaccgggacgtccgggtcctgacgtatcagtgcgaggtcggtcgtggacagtacttcactctacaccatcagcagcctgcgtacggctagaagtcgtggtcgtacgtagttttacgtcggtacttacggtacgtaacgtacttaaagttactttaacgtttaactccctttcccgttaccgttacccggttttcccccgggaccgtttaacggggaaacccgttaacgggtagttaactaaacgttaccggaaacccggttaattcgggttacggccgttacccg

SEQ ID NO: 116390 - DNA, 683 bp, Homo sapiens
  misc_feature: GYAE6OF01AMNL8.45.37.D04.1.454.CMB.1.raw
  modified_base (363)..(363): a, c, t, g, unknown or other
  misc_feature (363)..(363): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctgggtcgcagtcgtggggctgagggtgaggagccgtggggcctcgagtgaaggtctcctgcgaaggtcttctggctacctaccttcgaccggcgactactcctccacgtgggtcgcgacgacggcccgtggacgaagggcttgagtgggagtgggatggactaccgaaaccctaanaagtgggtacgaccaacgtaaactagtacgaccaacgtaaggtaacggtttacgacggggtacgaacggggtaccaaccgtaacgtacggaacccggaacggggtaacctaaccggtaccacgttaccgaacggtaccaaccgaccgtaccctaagaacgtcggacggccgtaggacgcgaacgtacgtacgaacgtagtacctacggaaccgtaaccgtaccgggtaccttaagttttaacgttacgttaggtacgggacggttaacgggttacgtttaccggggttttaccgggttcggttaccggtttttaccgggg

SEQ ID NO: 116391 - DNA, 931 bp, Homo sapiens
  misc_feature: GYAE6OF01ENCR5.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctcgtggtgccgtacggggactatcgtgatcgacccagtcctccagtacctcccgtggctgtgtctcgtgggcgaggacggccaccatacaactgacgtaacgtccacgaccaggtacggtttagtttaacgactacggacctaaccaaaactaaaagttaaaccgtaaccttaacgttaacggtaccgtttaacgggaacccaggtaaaccgaaaaccgggtaaaaccgtagggttaccaacggtccccttaaaccgtaaacggtccgttaacggccgtttaacctttaaacggtttttacccggacgggtacccttaaaccggtttaacccccggggtaaaccccgggggttaaaccgggtttcccccgggggttacccctaacggggtaaacccgttacgtttaaccggaacggggttcgggaacccggtggggtacccgggggttttacgaacgggggaaacttacgggtttaacctttacccggaaccttaccgtaaccctaaccgtaaccgttaccggaaccggtcgtaaccggacccgtttacgggaccggtaacgggtaccgtaaagggaaccggtacgggtttaggtaccggtttaagtttacggttttaccgttacggtacgttacggtacctaacggttacttaaacgtttaactttaacttaacgttaccgtttaccccggtttaaccggtaccgtttaccccgggaccgttaaaccggtaaaccggtaaggtacgtaaaccttaaaccgtaacggaaccgttaaggttcgggtaccgtccgtaaccg

SEQ ID NO: 116392 - DNA, 875 bp, Homo sapiens
  misc_feature: GYAE6OF01CNGL0.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggaccttgaggacttccttcttcgttggtggcagcagccaacaacgacgcccaccgtcccgaggtcgacaacgtggtcgcgtaggtcggtggggcgtaggtagggtaggacgggaacggtccggtcggggtacctcgtaggtaggtaacggttccgtccgttacggacgtaacgggttcttccgttacggtaccttaaccgtaccgtaccgaccggtaccgtaccgttacttaccgtacccgtaggttcgggtacgaccggtaccgtaccgggtcccgtacgggaaccggtacgggttaccggttaggtaacgggttacgggttaaggggtacgggtaacgttaaccggtaaccgttaacccggtaaaacccgttaaaacggtacggtacggggtaaccgtaacccgtaaaacgtaaaccgtttacgacggtaaaccgaacggttaaacggttaacggttaccggaacggggtaccggtacggtaaccgtacgtaaccggtaaccggacgggtaacccgggtaaaccttaccggacctaacgtccgaaccgtaccgtaaccgtaccgacgttaacacggttgaccgtagaccggaacacggacgtagaccgtaactcgtaccgacggtaaccggacttaccggttaacttaccgtttaaggcccggttaaggtcgttaacggggtactttacggggtttaccgttacgggtcggtttaccgggtttttacgttcgggtttaaacccggg

SEQ ID NO: 116393 - DNA, 797 bp, Homo sapiens
  misc_feature: GYAE6OF01BAPY0.45.37.D04.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (586)..(586): a, c, t, g, unknown or other
  misc_feature (586)..(586): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactcggaccgtggagactctcttcgttggtggcagcagccacaaagcgccctaactcccgaggtcncgagctgggtcgacncggtcgtggggctaggagggtggacgggaagccggtgggcctagagtaggtaacggtctccgtagacgtaaggtcttacgtgaccgttaccacccgttaccgaccgggtacctaacctaacgtcctaccccggtaaggtcgggtacgccgaaaccgtccgggaccccgtaggaacccgtaagggtccgtaggtaacgggtaggacggttagggtaagtcggtaaaccgtaccgaaaaacccgtaagaaaaccggttggggaaccgaaacgtaaacccaaaagtttaccgaggaacaaccgggtaaagtaagtacccggtagggacggtaaccggtcaacgaccgtaggaacccggtaaggaacctaccggactaccgaacgnacccggaaacacgtacaacgtacggtacgaaagccgtaaggtaccgaacgtaagggtaccaccgtaaacggaccccttaaggtaacggaaccccgccggtaaacccggttacttaaccgtttacggttaacgtcggtacccggttaacggtaacgggtttacgtttaaccccggttacgggtaccggttggtttaacccggttttacccgg

SEQ ID NO: 116394 - DNA, 685 bp, Homo sapiens
  misc_feature: GYAE6OF01A0DU6.45.37.D04.1.454.CMB.1.raw
  modified_base (179)..(179): a, c, t, g, unknown or other
  misc_feature (179)..(179): n is a, c, g, or t
tcagacgcgatcgacacgaccggtgctcgatttagtagcatactgttgggtttgggggagctacaacaggcaggcaggggcagcaagatggtgttgcagacccaggtcttcattttctctgttgctctggatctctggtgccgtacgggacatcgtgatgacccagtctccagctcccngctgtgtctcgtgggcgagacgggcccacactacaactgacaacgtccagtccgaggtagttgtttagacagcctaccaaacaataagaactacttaagccttaggtaccagacaacgaaccgaggtacacgcctaccgtaagccttacgccttactaacgtttaccgtggggacctaacgtccccggtaacccgggaacggttccccgggggttaccctacggaccgttagtccgagtcggacgaggtccgggtacgtagggactagtcttaccgtactacctaccaaccgtactccgacgcaccgtacgtccggacgacggtagtagaaagtgttacggtcggttacgttagtttacgtcgtgttacgtacaacgtattaacttagttacttacgttaccgttcccgttaccgttaccggtttaccggtacccggttaccggtaacggtaacggttaacgtaattaacgtaactaaacggtacgttacggtcggtcctaaccgg

SEQ ID NO: 116395 - DNA, 670 bp, Homo sapiens
  misc_feature: GYAE6OF01CYA2C.45.37.D04.1.454.CMB.1.raw
  modified_base (253)..(253): a, c, t, g, unknown or other
  misc_feature (253)..(253): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtggaggagccgtggggcctcgagtgaaggtctctgcgaagcttcnggctacaccttcgaccggcgactactctccgacgtgggtcgacgacgaccggcccgtaggaacgaggggtcgttggacggtgggagtgggaatcgggaactaccgaaacctaaacgaagtgggtacggacaaactaaactagtacgacctaacgaaggtaacgtttacggagggaccgtaacggggtaccacccgtaagtaccggaaccgaacgggaaccctacggtaccagtcgaacgaccgaacgaccgtaccctaagacgtagggacgtacgtacggtaacggacgaacgtaccgtcgaactacgtacacggaaaccgaccgaccggtaccttagtttacttacggttcggacggtacggtaggttaacggtttacgggttacgggttcggttcggttttcggttttaaccggg

SEQ ID NO: 116396 - DNA, 580 bp, Homo sapiens
  misc_feature: GYAE6OF01CQTQ9.45.37.D04.1.454.CMB.1.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
  modified_base (396)..(396): a, c, t, g, unknown or other
  misc_feature (396)..(396): n is a, c, g, or t
  modified_base (445)..(445): a, c, t, g, unknown or other
  misc_feature (445)..(445): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactcccaggtgcagctggtgcagtctggggctgaggtgaggagctggggcctcagtgagtcncctgnagctngctacacttcgaccgcgactatctccgactggggcncgacgacggccctaggacgagggtcttggagtggagtgggatggactcaaacccgtaanagtggtacgcaacgaactncgactacgagtagttcagggactagggtcaaccgtancgaaccgtgggaacacgtccatcgacgacacacgacctacaggtcgganacgtagacgtcgaacgacgtacgaccgtaagttccgtaacgaacccgtacgaccggtaccttaagttttacttggtacggtcgacgggttaacggtagtttaccgggtttaaccggtggtttccgtttaccgggg

SEQ ID NO: 116397 - DNA, 132 bp, Homo sapiens
  misc_feature: GYAE6OF01EOH0R.45.37.D04.1.454.CMB.1.raw
  modified_base (130)..(132): a, c, t, g, unknown or other
  misc_feature (130)..(132): n is a, c, g, or t
tcagacgcgatcgacacgaccggtgctcgatttagtagcatactgttgggtttgggcacagcggccctgggctgcctggtcaaggactacttcctcgatcgcgtctgagcgggctggcaaggcgcatagnnn

SEQ ID NO: 116398 - DNA, 674 bp, Homo sapiens
  misc_feature: GYAE6OF01C1CNF.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgagacgggccaccatcaactgacaagtccagcagagttgtttagacagctaccaacaataagaactacttagcttaggaccagacaacgaaaccaggtacacgtacctaccgtaagctgacctactactttacgtggactacgtaccggtaacccgggtacgttccccggggtcctacggacccgtagttccgtaggtacggaccgagggtccgggtcgtagggaccgtaagtacgtttccaacttcctaccacccgtattaccgaatccgacgtcccgtaggaccgaagggtctaaggaaacgtgtttcggacggtattaggttttatcgtcgttacgtacgagtacttaatttatttactaacgttaccctttcccggaccgtttaccggttccggaccccggttaagggaaacccttagggtacgtaaattacccggtaaacgtaaacgtaggttcggacggtaacctaccgg

SEQ ID NO: 116399 - DNA, 827 bp, Homo sapiens
  misc_feature: GYAE6OF01CAJWD.45.37.D04.1.454.CMB.1.raw
tcagacgcgatcgacacgaccggtgctcgatttagtagcatactgttggggtttgggggagctacaacaggcaggcaggggcagcaagatggtgttgcagacccaggtcttcatttctctgttgctctggatctctggtcgccgtacggggacagtcgtgatcgaccctagtcctccacgtaccctcccgtggccttggtcgttccgtcggtaggggacgaacggacgggaccctaaccactactaacgtcgacctaacgtccgagtaccgtaaggtacgtttagttaacgaacacgtacctaaccaaacgtaataaacgtaacttacgttagtaccgttacgacgacgtaacaacggaaaccgtggtaaccacgtcctaccgtaagctacgtccttagttacttacggtcggaactaccgtaccggtaaaccccgggtgttacccccggggtacctaggtaacccgttagtaccggtacggttcgggacgtaacgggtcggttaccggtaacgggaactacggttaccttactcccgtaaccgtaaccaccggtactacgacgtacgtaccgtacgacggacgtaaccgagtaacggtacgtaggtccggttaggagttttaaccgttagttaccgggttacgtacggttaaaccggtaagttaactttaaagttttactttaacgttaactttacccggttccgttacccggtttacggttaaccccggttaccggtaaacggggttaactaaaccggttaggtaaaaccctttaacggtaaaccgaaacccggttttaggacggttcccggtaacgttaccggg

SEQ ID NO: 116400 - DNA, 742 bp, Homo sapiens
  misc_feature: GYAE6OF01EIIB7.45.37.D04.1.454.CMB.1.raw
  modified_base (224)..(224): a, c, t, g, unknown or other
  misc_feature (224)..(224): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcagtccagccncgagtgtttagacagctaccaacaataagaactacttaagctttgggtaacccagacacgaaaaacccgtaaggttaccgagaccccttacccgtaaaaggcctttacgtcctaccttaaactttacggcggtactacgttaaacccccgggtaacccgggtaccggtacccgggtaccgtaccgtacgtacgtacgtacggtacggacggacggtcggtacggtacggtaacgtacgttacttaccgtactacctacctacctacgtacgacgacgtacgtaccgtacgaacggtacgtacgtaagtaacgtacggtacggtacgttacgtttaacgtttacgttacgtacgttacgtacgtaacgtaacttaactttaactttaactttaacgtttacctttacccgttacccgtttacccggttacccggttacccggtaaccggtaaaccggtaaacggtaacgtaacgttaacgtaaaccgtaaaccgtaaccgtacggtacggtaccgtacg

SEQ ID NO: 116401 - DNA, 699 bp, Homo sapiens
  misc_feature: GYAE6OF01AGHD9.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagtagttgttttagacagcctaccaaacaataaacgaactacttagcttaggtaccagacaagaaaccaggtcacgccctactaacgctgctactatttaccgtgggctacgtaccgtaacccgggtaacgtcccgggggttacctacggaccgttagttccgaggtcggcgtagggtccgggtcgtacgggactagtacgtttaccaccttccgtaccaacctatccgacggcctaacggcctaggacgagggtccgtaagtaacggtagttacggggtcggttacttaagggttttacgtcgtacgttacgtacgtaacggttacttaaatttagtttaactttaactttaccgttcccgttacccggtttacgtttcccccggggtaccgttaacgggtaaaccggtaaaggttcggtaaaacttaccgtaaacgtaacggtacgtttcggtaccggtcctaaccgg

SEQ ID NO: 116402 - DNA, 770 bp, Homo sapiens
  misc_feature: GYAE6OF01BZ9FG.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagagggcccaccatacaactgacaacgtccacgccagtagttagttttagacacgcctaccaaacaactaaacgtaactaccttagtcgttacgtaaccagacgaaacgaaaccgacggtaccacgtccctaccgtagctcgtactactaacgtttacgtgggacctaacggtacccggtaacccggggtaacgttccccggggttccctacggtacccgtatttaccggagttcgggcggacgggtccggggtacggtacgggtacgtacgtacgtttaccctacgttaccgtaccaccgtaactccggaacgacccgtaccgtcccgtagaccgggacggtacggtaacggtaagtacggttacgggtggttacccgtttaggttttaacgtcggtacgtttcggtaacctaggtaaaccttaagtttactttaacttactttacccgttacccggtttacccgttaaccggttttccccggacccggttaacgggaaccggttaaacggtacggttaaacgtaacgttaaaccggtaaaacttggttaacgggtcggtccgttaacccg

SEQ ID NO: 116403 - DNA, 617 bp, Homo sapiens
  misc_feature: GYAE6OF01DG3C8.45.37.D04.1.454.CMB.1.raw
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgccgtacggggacatcgtgatgacccagtctccagactcctggctgtgtctcgtgggcgagacgggccaccatcaactgacaagtccagccagtagttgtttagacagctaaccaacaaataaacgaacttactagtacttggtaaccagacaagaaacccaggtacacgcctacctaagctacgctactactttacgtgggctacgtaccgtaacccgggaacgttcccggggtccctaggaccgtattcgaagtggacgacggtcggggtctagggactagtacttccactcctaccacactacacgcacgctagacgacgctagaagngtggtacgtctagtttntgtcgtacgtacgagtactaatttaagttattaactacgtttaccgtccgttaccgtttccggacccgttagggaacccgtaaaggtacgtaacttaacgtaacgtaaaacgtagttacgtcggtcgtaacg

SEQ ID NO: 116404 - DNA, 678 bp, Homo sapiens
  misc_feature: GYAE6OF01C1V5R.45.37.D04.1.454.CMB.1.raw
  modified_base (205)..(205): a, c, t, g, unknown or other
  misc_feature (205)..(205): n is a, c, g, or t
  modified_base (662)..(662): a, c, t, g, unknown or other
  misc_feature (662)..(662): n is a, c, g, or t
tcagacgcgatcgacacgaccggtgctcgatttagtagcatactgttgggttgggggagctacaacaggcaggcaggggcagcaagatggtgttgcagacccaggtcttcattctctgtgctctggatctctggtgcctacggggacatcgtgatcgacccagtctccagactccctggctgtcgtctctggcgagacggccacntcaactgcaacgtccagccagacgttgtttaacgacacgactaccaacgaaataaacgaactaacgtagtccttagtaccagacgaacgaaaccaggtcgaacgtcctacctaagtctacgtctacgtactttacgcggactacgtaccgtaaccccgggagttacccggggtcctaggaccgtacgttacgaggtcgacgacggttcgggtcgtagggactaggtacttcgacctacgtaccactaacgtcaacgactacgtccgtaggaccgtacggcgttaacggagtaaccgttggtacggtttaaccttaaggttttacgtactccggttagttacccgaagttacttaattaacgtttaattacccttaacgtttccccgtacggttccgttacccggtaccggttaggtaccgtaaaagggtcgtaaacgtacgtaaaccgaaacgttancgtacggtcctaaccg

SEQ ID NO: 116405 - DNA, 770 bp, Homo sapiens
  misc_feature: GYAE6OF01EMT8E.45.37.D04.1.454.CMB.1.raw
  modified_base (561)..(561): a, c, t, g, unknown or other
  misc_feature (561)..(561): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
tcagacgcgatcgacacgaccggtgctcgatttagtagcatactgttgggttttgggggggactactaacaagacggcgaggacgggagggacagaacgaaagtgttggttgtcgacaaccgaccgtgttcttacttctttcctgttgtctctggtagtcttctggttggtaccgtaccgggtacggactcgtgtagtacgtacccgtacgtacgtcctacgactccccgttcggtgtcgttgttccgttcggtacgggacggacggacgggacccgacctatacctaaccgtacgtacgaaccgttaccgaccgaccgtacgtaggtttacggttttacgaacgaccgacttaccaaaacgtaaataaagtaaccgttaacctttagtccgttacgtaacgacgaacgtaaacgaaccgtacgtacgaccgtaccgttacctaacgctacgtcttacttaacgttcggttacggacgtactacccggtttaacccgggacggttcccggtcccgtacaacgtacttgaccgtaggtccgacggtcggtcggtagaacgtntacgttcacctctacncacncgtacgactcgtcgacgtgacgtacgtagtacgagtagtagtacgttcgttagttcgtcgtacgtacgtactaacgttaattatttacgttacttacgttcccgttaccgttccgtaccgttaccggtacggtaacgttaacggtactacgtaactaaccgtaacgtacttaaggtcgtagccgtaccg

SEQ ID NO: 116406 - DNA, 714 bp, Homo sapiens
  misc_feature: GYAE6OF01DX4CR.45.37.D04.1.454.CMB.1.raw
  modified_base (546)..(546): a, c, t, g, unknown or other
  misc_feature (546)..(546): n is a, c, g, or t
  modified_base (559)..(559): a, c, t, g, unknown or other
  misc_feature (559)..(559): n is a, c, g, or t
  modified_base (595)..(595): a, c, t, g, unknown or other
  misc_feature (595)..(595): n is a, c, g, or t
  modified_base (604)..(604): a, c, t, g, unknown or other
  misc_feature (604)..(604): n is a, c, g, or t
  modified_base (701)..(701): a, c, t, g, unknown or other
  misc_feature (701)..(701): n is a, c, g, or t
tcagacgcgatcgacacgaccggtgctcgatttagtagcatactgttgggtttgggggctacaacaggcaggcagggcagcaagatggtgttgcagacccaggtcttcatttctctgttgctctgatctcgtggtcgccgtacgggacatcgtgatcgaccagtctaccgagtacctcccgtggtctgttgtctcgtgggcgagcgggccaaccataccaactcgacaacgtccacgccgaagtgttaggttttaacgactacgtccaccaaaactaaataaacgtaaccttacgttacgtaccgtttacgtaaccgaagaccaaaacggaaaccgacgttacgaaccgtaccctaacgtaacgtcgtctcttacttagttttacggtggtacctacgtacccggtaacccgggacggttcccgggtcctacggtaccgtaccgtgtaccggtgggacgacgggtccgggttacggtccgggaaacgttcgttaacctttccggtaaccgtttccaacccctactaccgtcaacggacgtccccgngtacgccgttagngtaacggtaatagttcggacgttatttacgggtttntacgtcgtntagattacttaagtttaatttactcgtttactacccgttcggttaccctcgggtaaacccgtacgggaatacaggtactaactaacgtaacgtgtgnggccctgtaaccc

SEQ ID NO: 116407 - DNA, 620 bp, Homo sapiens
  misc_feature: GYAE6OF01AZMAD.45.37.D04.1.454.CMB.1.raw
  modified_base (467)..(467): a, c, t, g, unknown or other
  misc_feature (467)..(467): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgagggaagccgtggggcctcgaggtgaaggtctcctgcaaggcttcgtcggctaccaccttcaccgggccgactatcctccacgtgggtcgcgacgccggccccgtaggacgaacgggtctggagtgggacgtgggatggactaccaacctaacgaagtggtacgacaacaaacgtagtcgacacgtaagtaacgttcgacgggacgtacgggtacaacctagtacgaccgagggacacgtacatcagcacgacgacctancgtagacggtctaggacgcagtactacgaaccgtntacgtacgaacgaccgaccggtaccttaaagtttaccttaggttacggtcggtacggtacggttacggttcgggttttaaccgggtcgttacggttttccgggttttcgtttaccggg

SEQ ID NO: 116408 - DNA, 766 bp, Homo sapiens
  misc_feature: GYAE6OF01AYSCL.45.37.D04.1.454.CMB.1.raw
  modified_base (631)..(631): a, c, t, g, unknown or other
  misc_feature (631)..(631): n is a, c, g, or t
  modified_base (652)..(652): a, c, t, g, unknown or other
  misc_feature (652)..(652): n is a, c, g, or t
  modified_base (672)..(672): a, c, t, g, unknown or other
  misc_feature (672)..(672): n is a, c, g, or t
  modified_base (683)..(683): a, c, t, g, unknown or other
  misc_feature (683)..(683): n is a, c, g, or t
  modified_base (702)..(702): a, c, t, g, unknown or other
  misc_feature (702)..(702): n is a, c, g, or t
  modified_base (712)..(712): a, c, t, g, unknown or other
  misc_feature (712)..(712): n is a, c, g, or t
tcagacgcgatcgacacgaccggtgctcgatttagtagcatactgttggtttggggagcatcacccagcaaccacatctgtcctctacgagaatcccctgagagctccgttcctcaccatggactggacctggaggatcctcttcttggtgcagcagccacagcgcccactcccgagtgctaacgtggtgcagtcgtggggctgaggtgaaggacgtccgtagggtcctcgagtaggaacggtcttcccgtggactaacgggccgtttacgtcgggtacctaaccgtccgttaccggaccggtaccgtaacgttacgtccgtacctaccgttcggggtacgtaccgaaccgtaaccggtccccgtacggaaccgtaaggggtcctttagggacggttttaccgggagtttaggggaaccttagggaccttaccgaaaccccgttaaagtaaggttccgggtacggacccgtaaaacgttaaaccctaggtaccgtacgtaaacccggtaggttaaccggtttaacgaccgggggtacgtacgggtaccctaacccggtattaaccgggaccggtaaaccgggaccgttacggtacccaaagtcgaaacgtccgtaaacgacgtacccgtanacggtagacgaccgtgaaccngacgtcgacggcttacgacngggtaaacccncgaccgttaatccgtttanacgttacggnccggaagttaccgtttggttacccgtaggttcccttaggttttcccgtaacggg

SEQ ID NO: 116409 - DNA, 637 bp, Homo sapiens
  misc_feature: GYAE6OF01A4V4Z.45.37.D04.1.454.CMB.1.raw
  modified_base (373)..(373): a, c, t, g, unknown or other
  misc_feature (373)..(373): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagcgtggtgcagtcgtggggctggaggtgaggagccgtggggcctcagtgaggtctctgcaggcttctggctacaccttcgaccggcgactactctccacgtgggtgcgacgcggccccgtggacgaagggtcttgaggtggagtgggatggactaccaaaccctaacagtggtaggacaactaaactntgacacgtaagtagttacgagggtcgagggtaccactagtacggaacccgaacgggacctaccgtaccagtaccgacgaccgaacgacgtaccctaacgacgtacggaacgtcgtggaacgcgaacgtacgtcggaactcggttaccgacggtaccgaaccgtaacccgggtaccttaatttaaccgtttacgttaggtacggtacggttaacgggttacgttttaccgggtttaccggggttcggttccggtttttaccgggg

SEQ ID NO: 116410 - DNA, 804 bp, Homo sapiens
  misc_feature: GYAE6OF01C9SK5.45.37.D04.1.454.CMB.1.raw
  modified_base (464)..(464): a, c, t, g, unknown or other
  misc_feature (464)..(464): n is a, c, g, or t
  modified_base (528)..(528): a, c, t, g, unknown or other
  misc_feature (528)..(528): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacagtcgtgatcgacccagtctccagacctcctggctgtgtctcgtgggcgagacggccacactcaactgacaagtccagcagagttgtttagacagctaccaacaaagtaacgaacttaactagtcttacggtaccagacaacgaaaccgaggtaccacggtacctacgtaaacgcctacgtcgttactacgtttaacggtgggactacgtaaccgtacccggggtaaccgttcccggggtccctacggtaaccgttagttacgacggttcggacgacgggtccggggtctacggggactaggttactttaccncttacctaccaaccgtacttcgaactcgtacgtcctacggctagggtaccgtaagggtaaacgnggtttcggtaacggtccgttttaaagtttttcgggacgtttcgggttaacgtccctaagggtaactttaaacgttttaaagttttacgtttaaacttttaaccccggttttcccgttaccccggggtttacccgttttcccccggggtaaacccgggttaaaccgggggttaaacccgtttaaaaaggggttcgttaaaacccggtttaaccttaaaacccgggtaaaacccggtttaaaggtttcggggtaacccggttccggttaaaccccggg

SEQ ID NO: 116411 - DNA, 699 bp, Homo sapiens
  misc_feature: GYAE6OF01B2Q80.45.37.D04.1.454.CMB.1.raw
tcagacgcgatcgacacgaccggtgctcgatttagtagcatactgttgggtttggggagagcatcacccagcaaccacatctgtcctctagagaactcccctgagagctccgttcctcaccatggactggacctggaggatcctcttcttggtggcagcagccaacaagacgcccactcccaggtgcagctggtgcagtcgtgggctggaggtgaggaacgccgtggggcctcgagtggtaaggtcctcgtgacgtaaggtccgttcgtcggaccttaccgtacccgttccgaacccggtcgtaaccttactcccgtaccgacggttacgggtcgaccgaccgaccgggtccccgtaggtaaccgaagggtcgttacggagggtggtacgtgggtacgtagacttaccaaacctaacgtagtggtacggacaaacgtaaactagtacgaactaacgtaacggttaacgtttacggaacgggtacggtacgggtacctaacgtaacgtacggaacccggaacgggtacctaccgacctagtacacgacctaacgaccgtaccgagtagtcggtaacgactacggagtacgacgtatcgataccgtcgacgaccgaaccgacgtacttaacgttacgttcgtcggtacggtacggtacggttaacgtttaggttaccgggttgttcggtttttaacccggg

SEQ ID NO: 116412 - DNA, 675 bp, Homo sapiens
  misc_feature: GYAE6OF01C0KHZ.45.37.D04.1.454.CMB.1.raw
  modified_base (445)..(445): a, c, t, g, unknown or other
  misc_feature (445)..(445): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgtgctctggatctcgtggtcgaccgtacggggacatcgtgagtcgaccccagtcctccacgtacctcccgtggctgtcgtctcgtgggcgaggccggccacagtacaactcgaccaacgtccgagaccgaggtagttgtttaaggactacgacctaaccaaactaaaacgtaaacgtaacttaacgttacgtcgttacggtaaccacgacaacgaaaccgacggtcaccgtccgtacctaacgcctacgtctactacgtttacgacgggtactacgtacccggtaaccgggtacggtccccgggtacctagtaccgtagtaccggnggtacggcgtacggtacgggtcggtagggacctagttactctactccgtaccactanccgacgccacgtcacgcgaacgtcgtaaggaactcgtaggttcgacgtttaagtttgactcgtacgtacgtaagattaatttagttacttaacttccttaccgttccgtaccgttcccggacgtacggtaaacgtaacgcgtaaactcgtaaaccgaattcggtgtgcccgta

SEQ ID NO: 116413 - DNA, 886 bp, Homo sapiens
  misc_feature: GYAE6OF01E264Z.45.37.D04.1.454.CMB.1.raw
  modified_base (197)..(197): a, c, t, g, unknown or other
  misc_feature (197)..(197): n is a, c, g, or t
tcagacgcgatcgacacgaccggtgctcgatttagtagcatactgttgggtttggggagagcatcacccagcaaccacatctgtcctctagagaactcccctgagagctccgttcctcaccatgactggacctggaggactcctcttcgttggtggcagcagccacgaagacgcccactcccgaggtgcagcgtggncgagtcgtggggctggaggtgaggacgccgtcgggcctcgagtgaacggttctccgtgacgaacgggtctttccgtcggtaccttaccgtacccttcggacccggtacgtaccttacttcccgtaccctacggtcggggtcggaccgaaccgccgggtccccgtagggaaccggtaacggggttccttagggacggttagggacggttaggggacgtacggtaaccgtaccctaaaaccccgttaaacgaacgttcggggtacgaaccaaaccgtaaactgtacgaacctaacggtacgtaaacggtttacgggaagggtaccgtaccgggtactaacccgtaaggtaccggaccccgggaaacgggtacccgtaaccgtaaccccggtataacccggaacgtacccgtaaaccgtacccgtaccgttaaacgtaccgggttacgggtaaccggtccgttaagggtaacccggacggtaacggggtttaccgtaacgggtaaccgttaccgtaaccggggttaaccggaaacccggttaaccccggggtaacccggggtttacccgtttaaaggggtttaaccgtttccggggtaacgggtttaccgggggaaccgggtaacggggaacccggtttaacgggttaaaacgggttttaaaccgggtttaacccgggtttttttaaggggg

SEQ ID NO: 116414 - DNA, 818 bp, Homo sapiens
  misc_feature: GYAE6OF01A615P.45.37.D04.1.454.CMB.1.raw
  modified_base (186)..(186): a, c, t, g, unknown or other
  misc_feature (186)..(186): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctcgtgggtcgccgtacggggacagtcggtgatcgaccagtcctcagactcccgngtctgtcgtctcgtgggcgacgcggccacatccaacgtgactaacgtccacgaccgaggtatttaggtttaacgacgtacgtctaaccaaacaagttaacgtaacttacgttagtacgttacggactacgacgaacgtaaaaccgtggtaaccaccgtacctaccgtaacgtccgttacgtaccttacgttaacgtttacggtacggggtactaaccggttaacccggtaaccggggtaaccggttaccccgggggttcctaacggtacccggtatttacggacggtttacggacggtacggtcggtacgggtacgggactaggtactttccgactacccgtactaaccgtctacgacgtcccgtaagtccgtacgggaaccgtagggtaccttaggaaaccgtggttacggtaccggttaattttaacggttactggttacggttactaccggaacgtttacgtttaaatttacgtttacgttaacccgtttaccgttacccggtttacccctacggtttacccgggaacccgggtttaacggaaaccgtttaaacgggggttacctaacgggtaaaccgttaaacccggttaacggggttaaccttcggggtaacgttaccgtaaccccg

SEQ ID NO: 116415 - DNA, 802 bp, Homo sapiens
  misc_feature: GYAE6OF01A3KAM.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgagagggccaccagtacaactcgacaagtccacgaccagtagttagttttagactacgcctaccgaaacaaataaacgtaaccttaacgttacgtccgtttacggtaaccaggaccgaacggaaaaccgaggtaccgacggtacccttaccgtaaacgtcgtacgtacctacgttaacttttaacggtcgggtactaaccgttacccggtaaccccggggtaacggttccccggggttacccgtacggtacccgtactttaccgaacggttcggaccgtaacgggtccggggtaccgtacgggaacctaacggttactttaccgaacttcctaaccgtacctagtaccgacgtccacggtaccctacgtccggtaacggtacgtagtaacgtaacggttcggtacggttacgttaagttttacgtcggttaccgttacggtaccgtaacggttaaactttaacttaacttttaattaacgtttacctttacccgtttacccggttacccgttttacccgggaccccgttaacgggtaaacccggtaaggttaacggttaacttaacgttaaccgtaaacgtacggttacggttcgaccggtaccg

SEQ ID NO: 116416 - DNA, 700 bp, Homo sapiens
  misc_feature: GYAE6OF01D5BJF.45.37.D04.1.454.CMB.1.raw
  modified_base (199)..(199): a, c, t, g, unknown or other
  misc_feature (199)..(199): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtcgnggggctggaggtgaggaagccgtcggggcctcgagtggaacggtctccgtgacgaaggtcttacgtggtcctaccgtaccccttcgaccgggcgtactactcctccctacgttgggtcggaccgaccgaccggccccgtagggacgtaagggtcttaggaggtaggagttgggagtcgggactacctaaacccgttaagaagtcggtacggaacaacctaaacgtagtgaccaagtaacgtaacgtttacggacgggtacgtaacgggtccaacgtgacggaccgacgggaccaacgtccatacgacgacgaccgagtaaccctacgagtcgggcgtacgtacggacgtacgaacgaccgtaggacctacgttaaccggtacggaaccggtaacccgtacgggttaccccttaaagttttacgttaccggtggttacggaaccggtacgggtttacgtttaccggggtttaccgggtttggttacccgggtttttaccggg

SEQ ID NO: 116417 - DNA, 761 bp, Homo sapiens
  misc_feature: GYAE6OF01DQMOY.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtcctccgagacctccctggctgtgtctcgtgggacgaggacggccaccatacaactgacaacgtccagaccgagtagttgtttagacgacgcttaccaaactaagtaacgtaaccttacgttacgtctttacggaacctagacgaacgaaaccgtaggtaccacgtacccttaccgtaacgcgtcgtacttactacgtttaccggtcgggacctaacgttacccggtaaaccccgggtaacggtttccccgggggttaccctacgggtaacccgttacgttaccggtaaggtccgggaccggtacggggtaccggggtccgttaaggggaactaacggtttacctttccgtaacccttccgtaaccaaccgtaactcgaaccggccgtaacgtccgttcggaccgtagggaccttaagggaacgtgttggtacgttacttagttttacgcgttacctaggtaactacgtaactttaatttagtttaacttaccggtttacccttccggtacccgtttaaccggttcccggtacccggtagtaaaccgttaaggttcgtaactacgtaaacccgtaagtacgttgcgtcgtaccg

SEQ ID NO: 116418 - DNA, 634 bp, Homo sapiens
  misc_feature: GYAE6OF01EU1EM.45.37.D04.1.454.CMB.1.raw
  modified_base (392)..(392): a, c, t, g, unknown or other
  misc_feature (392)..(392): n is a, c, g, or t
  modified_base (610)..(610): a, c, t, g, unknown or other
  misc_feature (610)..(610): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccaacaagacgcccactcccaggtgcaacgtggtgcagtcgtggggctgaggtgaggaacgccgtggggtcctcgaggtaggaacggtctcctgcgaaggtcttcgtggcctacaccttcgaccggcgtactatcctccgacgtgggtcgcgaccgccggcccgtggacgaagggtcttggaggtggagtggagtggactaccaacctaagagtggtcgtacgaacaacgttnagacaagacgtaacgttcgaggggtcgaggccgacgtagacggtaaccgacggggaactaccggtaccacgtaccgagcctaaccgacgtacccgtaacgtcgtacgggaccacggtacggacgacgaacggtacgtagaccctagtaccgtacggaccgaaccgacggtctttaacgtttactcggtggtcgacgtaggtacgttacgggtttcggngttcggtttacgttcggtttacgg

SEQ ID NO: 116419 - DNA, 787 bp, Homo sapiens
  misc_feature: GYAE6OF01D1V3D.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctcgtggtcgccgtacggggacagtcgtgatcgaccagtctccagtacctccctgactgttgtctcgtggggcggaacggacgggacccaacctataccaacgtgccgtacggtaccgacgccgaggttagttttcggtttttaccggaccctaagtaacgtaacgtaaacttacgttacgtcttacggaccagacaaggaacgccgaggcaccgtcctcgtacgccgttcgtctttacgtttcgcggtccgtccggtacccggggtccggttcccgggtcctacggtaccgtactacgacggtcggcgtacgggtcgggtcggtcgggactacgttactttacgtaccttccgtactaaccctacgtaccgacggtacccgtaccggcccctaggacccgtacggtaccgtaagggtaacggtcgttcggttaccgtacgtttaacgttttacctaccggttgtaacccgtaataacgttaacgtttaactagggtaccgttaactttcccgttacccgttccgttaccggttaaccggttaccgggggaacgggttaaccggtaaccgggttaaacgggtttccaaacggtttaacccgtaaaccgggaaagttccgtaacgggtccgtaactcccggaaactcccgttagttccg

SEQ ID NO: 116420 - DNA, 708 bp, Homo sapiens
  misc_feature: GYAE6OF01BDBT9.45.37.D04.1.454.CMB.1.raw
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtggaggagccgtgggctcagtgaggtctctganaggcttcgngctactccttcgaccggcactactctccacgtgggtcgcgacgacggccccgtaggaacgtaagggcttacgaggtcggagtgggataggactaccgaaacctaanaacgtgggacgacaaactaactntacgacgacgtaaggtaacggttcgagggtcgtagggtaccaaccgagtacgaaccgtacgggaaccaccgttacccaataccgaacgtacccaaccgtacccgacctaacgaggtacgggagtaccgacggtacgaccaacggtacgaacgtactaacgttaccgtaacgacccggtaacccggaacccgggttaccctttaaagttttaccggtttaacggttcggtacggggttaaccgggttaacggggtttaacggttttacccggggttttaacccggggttcgggttttccccgggttttacggggtttttttaccccgggg

SEQ ID NO: 116421 - DNA, 703 bp, Homo sapiens
  misc_feature: GYAE6OF01D53NC.45.37.D04.1.454.CMB.1.raw
  modified_base (180)..(180): a, c, t, g, unknown or other
  misc_feature (180)..(180): n is a, c, g, or t
  modified_base (187)..(187): a, c, t, g, unknown or other
  misc_feature (187)..(187): n is a, c, g, or t
  modified_base (661)..(661): a, c, t, g, unknown or other
  misc_feature (661)..(661): n is a, c, g, or t
tcagacgcgatcgacacgaccggtgctcgatttagtagcatactgttgggtttgggggagctacaacaggcaggcgaggggcagcaagatcggtgttgcagacccaggtcttcatttctctgttgctctggatctctggtgccgtacggggacagtcgtgatgaccagtctcagctccgnggctgtntctcgtgggcgaggacggccaccatcaactgacaagtccacgccagtagttgtttagactacgcctaccaaactaaataacgtaaccttaacgtttacgtctttacggtaaccaagacctaacggaaaccgtagggtccaacggtcccttaccgtaacgcgtcgtaccttacgtaacttttacgtgggctacgttaccggtacccgggtaacgttcccggggtcctacggacccgtattcggaaggtcggcgtacggtcgggtacgtgggaactaggttactttaccacttcctaccaacctactacgacggtaccacggccttaggacgtacggtactaaggaacgtgttcggtaagggtacttaggttttcgtctcgttacgactaacgttactaagtttaactttactttaacgttaccttcccgttacggttacccgttttcgggcccgtaagggtaaacctacggggtnttaaccgtacgtaaacggtaaaccggtgttcgtggactaccc

SEQ ID NO: 116422 - DNA, 658 bp, Homo sapiens
  misc_feature: GYAE6OF01BK50J.45.37.D04.1.454.CMB.1.raw
  modified_base (479)..(479): a, c, t, g, unknown or other
  misc_feature (479)..(479): n is a, c, g, or t
  modified_base (567)..(567): a, c, t, g, unknown or other
  misc_feature (567)..(567): n is a, c, g, or t
  modified_base (651)..(651): a, c, t, g, unknown or other
  misc_feature (651)..(651): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatcgacccagtctccagacctccctggctgtgtctcgtgggcgaggacgggccaccatacaactgacaagtccagccagtagttagtttagacagctaccaacaaataaacgtaactacgttagtcgttacggtaaccagacgaacgaaaacccgtagggtaccaacggtacccttaaccttaaacggccttacgtaccttacttaacgtttaccgtagggacctaacgtaccgtaaccccggggtaacgtcccgggtaccctagacccgtataccgtaggtcggacgtacggtcgggtcgtagggaactagtacttacactacnctaaccatcgagactaggtccctaggccgtaaggctaaggaacgtgtggtcggtattaagtttatcgctgtaccagtaacttaagttnttaagtactacgttccgtacgtaccgttcgacccgttaggaacctagacggtataaccgaacctaaacggaactgggtcacgtntaacccg

SEQ ID NO: 116423 - DNA, 827 bp, Homo sapiens
  misc_feature: GYAE6OF01ADJUC.45.37.D04.1.454.CMB.1.raw
tcagacgcgatcgacacgaccggtgctcgatttagtagcatactgttgggtttgggggagctacaacaggcaggcaggggcagcaagatggtgttgcaggacccaggtcttcatttctctgttgctctggatctctggtcgccgtacggggacatcgtgatgacccagtctaccagacctcctggtctgtcgtcgtcgtgggcgaggacggccacatcaactgacacgtccagccagtagttacgtttagacgagtacctacccaaacgaaacgtaaacgtaaccttaaccgttacgtacgtttacggaaccctacggaccgaacgaaaacccgtacggggtaccctaaccgccccgttaccgtaaaggtcccgttcggtaccttaccgtttaacgtttaccggtacgggtacctaaccggttaccccgggtaaaaccccggggtacggtttaccccgggggtaccctaacgggtaacccgttaagttccgggtaaggttaccgggaccgtaccggggtcccgggggtttacgggaccggggtaaaccgttaggtttaaccccgtttccgtaaacccgtttcccgtaacccgtacccgtaacgtttacccgaccggttacccggtacgtacccgtacggtacccgtaccggtacccgtaacggtaacgtacgttaccgtacgtaccgttaacgttaaccttcgtacgtaccgtaatacgttaattagtaacgtacgtacgttacttacccgtcgttaccgtcggtacccggtacgggtacgtacgtaggtaccgacgtaacgtaccggtaaactcgtaggtcgtacg

SEQ ID NO: 116424 - DNA, 876 bp, Homo sapiens
  misc_feature: GYAE6OF01AV0N8.45.37.D04.1.454.CMB.1.raw
tcagacgcgatcgacacgaccggtgctcgatttagtagcatactgttgggtttgggcatcacccagcaaccacatctgtcctctagagaatcccctgagagctcccgttcctcaccatggactggacctggaggatcctcttcttggtggcagcagccaacaagacgccccactcccgaggtgcaggctgggtcgcagtcgtggggctggagggtgaagggacgccggtggggccctgaggtggaacggttcctcctggacgaaggtcttacgtggacctaccgtacccttccgaccggacgtacttactcctacctacggtcgggtcgaccgaccgccggccccgtaggacggagggtcttgggagggttaggacggtggggtactacggtaactaacccgtaaacccgtaaagaacggttcgggaacggaactaaacctaaacgttacgtacgaaccgtaacgtaaacgggtttaacggttacggaaacggggtacgggtaaccgggtaccaaccgttacgtaaccggggaaccggtaaccggggaaccctaacccgtaacccggtaactacccggaacgaccgtaacccggaaccgttacccgaaacggttacggacgggtaaccgtacggtaacggaaccgggtaccgtaaccggtaacccgttacgaaccgttaccgtaccggtaaccggaccccggtaaacccgtacccggtttaaacgtttaacggtttttaaacccgttacgggttaaggttaccgggtaaccggggtttaagggttttaacccggttttaccggggggttttaccccgggttagggttttccccggggttttttaaaccgggtttttcccggtttaacccggggggg

SEQ ID NO: 116425 - DNA, 948 bp, Homo sapiens
  misc_feature: GYAE6OF01ECZ4W.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctctggtcgaccgtacgggacagtcgtgactcgacccagtcctccgagaccctccgtggtctgttgtcgtcggtcgggcgaggacggacccacgactaccaacgtgaccgaacgtccaacgccgtaaggtagtttacgtttaacgaccgtacgaccctaaaccgaaactaaaagtaaaacctaacgtttaacgttacggtaccgtttacggaacccgaaggtaccgaaaaccggtaaaccggacggtaccgaccgtacccgttaccgtaacgtccgtcgtaccgttacctttaagtttaacccggtggtaaccttaacccgtaaccccgggttaaacccggggtaacccggtttccccccggggtaacccttaacggtaccccggttaagtacccgggtaaggtccgggaccgtacgggggtccgggttacgtaacgggtaccgttaacgttaccgttttaccgtactaaccgtaccctaaccgtactaaccgcgtaaccgcccggtaccgtggaaccggtacggtacgttaacggaggttaccggtttaggtaccggtttaagtttacgtttttacggtaccggtacgtttccgtaaaccgtaacggttaaattttaaacgttttagtttaaacgtttaaccccgttttaccgttaaacccccggtttaccccgggttttaaagtttccccccggggttaaacgttaacccgggggttaaaaacccttgggttttaaaccaaacggtttaaacccgtaaaacccgggtaaacgtttaacgggtacgggtttaaccggaccgttaaccccggttaaacc

SEQ ID NO: 116426 - DNA, 699 bp, Homo sapiens
  misc_feature: GYAE6OF01A5OFV.45.37.D04.1.454.CMB.1.raw
tcagacgcgatcgacacgaccggtgctcgatttagtagcatactgttgggtttgggggagctacaacaggcaggcaggggcagcaagatggtgttgcagaccccaggtcttcatttctctgttgctctggatctctggtgccgtacggggacatcgtgatcgacccagtctccagcctcccgtggctgtgtctcgtgggcgaggcgggaccaccatacaacgtgacaacgtccacgaccgagtacgttgtttagacagacctacaaacaataaacgaacttaacttagcttacggtaccagcaacgaaccaggtcaacgcctaccgtaagctcgtacttactacttacgcggacctacgtacccggtaacccggggaccgttcccggggtaccctacggaccgtattcgaggtcggacgtaggtcggtcgtagggactagttacgtttacacgttcacctacacgtacacgacctacggtccgtagaccgtacggtagtaacggtaacgtcggtcggtacggttacttagggtttttactccggtacgttacggtaaccgtagttaaccgttaaatttaccttaagtttacccttaacgtttccccgaccgttttaccggttacccggaccggttaacgtaaacggtaacgtacggtaataaccgtaacgtaaacgttaccgtggtccggtcgtaaccg

SEQ ID NO: 116427 - DNA, 696 bp, Homo sapiens
  misc_feature: GYAE6OF01AKPKC.45.37.D04.1.454.CMB.1.raw
  modified_base (317)..(317): a, c, t, g, unknown or other
  misc_feature (317)..(317): n is a, c, g, or t
  modified_base (671)..(671): a, c, t, g, unknown or other
  misc_feature (671)..(671): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatcgacccagtctccagactcccgtggctgtgtctctgggcgaggaggccaccatcaactgacaagtccacgccagtagttcgttttaagactacgcctaccaaacgaactaaagtaacctacgttaggtcttacggtaacccaagacaacgtaaaacccnggtaccaacggtccctactaacgccttgacttactacgttttaccgcgggtactacgttacccggtaccccgggtaagtccccggggtaccctacggaccgtacttcgtaggtcggactacggtccggggtctacgggtaacctagttactttaccacgttccgtaccaccacgtcacgacacgtcctaggccgtacgacgtacgaagtgtcgtacggtacttagtttctcgtacgtagtactagtctaatttacgttataacgttcgtacccgtacgttaccgtccggttacccgtagggttaacccgtaaggtttacggtaaaccgttaaccgtaaaccgaaaccggtttanacgggttaaccgtccgttaaacccg

SEQ ID NO: 116428 - DNA, 801 bp, Homo sapiens
  misc_feature: GYAE6OF01CTG1H.45.37.D04.1.454.CMB.1.raw
  modified_base (309)..(309): a, c, t, g, unknown or other
  misc_feature (309)..(309): n is a, c, g, or t
tcagacgcgatcgacacgaccggtgctcgatttagtagcatactgttgggtttgggggagcatcacccagcaaccacatctgtcctctagagaatcccctgagagctccgttcctcaccagtggactggaccgtggaggactcctcttcgttgggtggcagcacgccacgaagacgccccactcccgaggtgccgagtcgtgggtcgcgtaggtcggtgggggcgtagggtaggggtaggagggaacggtccggtcgggggtcctacgaggtaggtaacgggtcctacgtgacgtaacggttcttacgnggtacctacctacccgttccgaccgggcctacttactacctccgacggtgggtcgccgaccgccggcccgtaggaccgtaggtcgtggaggtggtaggtgggacgtggtaactaccaaccgtaaacgtacggtggacgacaaacgtaatagtacgacgaagtaaaggtacgttacggacgggtacgtacgggtaccaacgacggtacggaaaccggacgaccgtactaccgacgtacgaaccgacgtaacgccgaactaggtagacgggacgtacgacggaccgtaacggagtaacctacggaccttaccggtagaacccggtaacccggtaccgggtaaacccgtttaacccgttttaaaggttttaaaccccgtacgggtacggggtttaaccggaccgggtttaaacgggttttaaccccgggttttcggggttaacccgggtttcccggggttttaacccggttttttcggggtttttaaaccccggg

SEQ ID NO: 116429 - DNA, 801 bp, Homo sapiens
  misc_feature: GYAE6OF01CJD5F.45.37.D04.1.454.CMB.1.raw
tcagacgcgatcgacacgaccggtgctcgatttagtagcatactgttgggtttgggggagatacaacaggcaggcaggggcagcaagatggtgttgcagacccaggtcttcatttctctgttgctctggatctcgtggtgccgtacggggacagtcgtgatcgaccctagtcctaccgagtacctcccgtggctgtcgtcctcgtgggcgaggacggacccaccgatacaactgacagtccagccagtagttgtttacgactacgcctaaccaaacgaaattaaacgtaaaccttacgttacgtaccgttacggtaccacggactaacggaaaaccgtggtaccaccgtaccctaccgtaacgtcgtacgtaccttacgtagttttaccggcgggtactacgttacccggtaacccgggtaacgttccccggggtacctacggtaaccgtacgttacggacggtacggaccgtaggggtcccgggtacgtacgggtaaccgtacgtttacgttacccgtaaccgttccctacccgtaaccgtacgtacgaccgtacccgcgtaccgtaggcgtaacggtacgtaaggaagtcggtacgtacggttactttaggtttacgttccgtacgtacgtacgtaacgttaacgttaactttaacgtttacttaaaccgtttccgttaccccgttacccggtttaccgggttaccccggtaccggttaaccgggtaaacgttaaccgggtacgtaaaacttaaccgtaaaccgtaaacggttaccgttcggtaccgttaacgtacccg

SEQ ID NO: 116430 - DNA, 748 bp, Homo sapiens
  misc_feature: GYAE6OF01EKNKK.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggaccgtggaggatcctcttcgttgggtggcagcagccacaagacgccccactcccagggtcgcgagcgtggtgcgaggtcgtggggctggaggtgaggacgccgtgggcctcgaggtgaacggtctcctgacgtaaggtcttcgtcggctacctaccgttccgaccggcgactactcctcctacgtgggtgcgacgacggccccgtggaccgaggtcgttggaggtggtaggtgggagtaggactaaccgaaaccctaagtaacgtggtacggaacaaacaaagtactcgaacacgtaaggtaacggttacggacgggacgtacgggtacctaacccgaaggtacggaacccgtacgggaacccgtaccggttaccacgttaccgaacgtacccgaacgaaccgtacccgttaacgacggttacgggaacggtacccgtagggaaccgaccgtaaccggtaaccgtaccggtaactaccggttaccgtaaccggaccggaacccgtaaccggttaccctttaaagtttaccggtttacggttacggtacggtacgggtaaggttaccggtttaccgggttttaccgggtaccggtttccgttttcgggtttttaacccggg

SEQ ID NO: 116431 - DNA, 690 bp, Homo sapiens
  misc_feature: GYAE6OF01C3Z3B.45.37.D04.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgnggggctggaggtgaggaagccgtggggcctcagtgaaggtctccgtgcaaggtcttgnggcctacacccttcgaccggcgactactcctccacgttgggtcggccgaacgccggtcccccgtagggaaccgaacggggtctttagggaggttagggagtaggggacttagggactaaccgtaaaccctaaacgtaacggtgggtacggacctaaaacgtaaaccgttatacgacctaagtaaggtaacggtttcggagggtacgacggtacccaaccgagtaccggaaccggacggaccgacgtacccgaagtccaacgaccgaacgccgaacctacgaagacgggtaacgcgttaacggacggaccgtacggtaactacggaacctatacccggtaacgaaccgttaacccgaacggtcccttaagtttaccgttagtcgtaggacgtaggtacgtttcgggtttacggcggttccgtttggtttacccgg

SEQ ID NO: 116432 - DNA, 708 bp, Homo sapiens
  misc_feature: GYAE6OF01D9C8V.45.37.D04.1.454.CMB.1.raw
  modified_base (197)..(197): a, c, t, g, unknown or other
  misc_feature (197)..(197): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctgtgcagtcngggctgaggtgaaggaagccgtggggcctcgagtgaaggtcctcctgcaaggcttctggctacaccttcgaccggcgactactcctacctacgtcgggtcgcggaaccgtacgggccccgtaggaaccgaaaggggtccttttaggaaggttgggagttggggacgttgggaacttaccgtaaacccctaaacgaaagttcgggagtaccaaacgtaaacctagtccgactaacgaagtaaacggtttacgacggggtacgaacggggtacctaacccgtaagttacggaaccccgtaacgggaaccaaccggtacccgtaacgttacgacgaacctaacgacgacccttaacgagtacgggacgtacgtacggacgtaccgacgtagttacgacgtaagttccgtacggacgtacccggaaccggtccgttaattttaacgttaccgtcggttcgacgggtaacggttaacgttccggggttttaaccggtggttccggttttaaccggg

SEQ ID NO: 116433 - DNA, 790 bp, Homo sapiens
  misc_feature: GYAE6OF01E5Z5T.45.37.D04.1.454.CMB.1.raw
  modified_base (590)..(590): a, c, t, g, unknown or other
  misc_feature (590)..(590): n is a, c, g, or t
  modified_base (770)..(770): a, c, t, g, unknown or other
  misc_feature (770)..(770): n is a, c, g, or t
tcagacgcgatcgacacgaccggtgctcgatttagtagcatactggttgggtttgggggagctacaacaggcaggcaggggcagcaagatggtgttgcagacccaggtcttcatttctctgttgctctgatctcgtggtgccgtacgggactactcgtgactcgaccctagtcctccgagtcctccgtggtctggtgtccgttcggcggggcggaaggaccggtcccaactactacaacgtcggacaacgtccagcctaagtagttacggttaacgacgtactacctaaccaaaactaaacgtaacgtaacttacgtacgtaccgttacggaccagaccgtaacgaaaccgtcgtaccgaaccgtccttaacgtaacgtcgtacgtacttacttacgtttaccgcggacctacgtacccggtaccggtacggtcccggtccacggacgttcgtacgaggtcggacgtcgggtcggtacgtacgggtactacgttacttacctacgttacccaccgacgtaccgtagcggacgttacgcccgtggaaccggtcgtacgtaagacgttacgttgggtcttaggtttcgttancgttaaccgtgttaaccgttaaagttaaccttaaattttacccgtttaacgttacctttccccgggtttccccaaccccgggttttacgtaacccccgggttaaggttaaccgggttaaaaacgttaccggttaagggtaaaccctttaaacgggtaaacccctaaagggtttacccggngtttaccgccggttaccccg

SEQ ID NO: 116434 - DNA, 786 bp, Homo sapiens
  misc_feature: GYAE6OF01DWLM5.45.37.D04.1.454.CMB.1.raw
  modified_base (124)..(124): a, c, t, g, unknown or other
  misc_feature (124)..(124): n is a, c, g, or t
  modified_base (552)..(552): a, c, t, g, unknown or other
  misc_feature (552)..(552): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctntggatctcgtggtcgccgtacgggacatcgtgactacgacctacgtcctccagtacctcccgtggctgtcgtcgtcgtgggcgacggacggaccacactacactgactacgtccagccgtagtagtttagttacgacgacgtaccaaccaaaacgtaaagtaaacgtaccttaacgttacggtacgttaccggtaaccgaagaaccgtaaacggaaccgtacggtaccgtacgtaccctaacggtaacgtcctacgttccttaacgttacgttacggtacggtacgtaaccgttacccgggttaacccggggtaccggttacccggtaccgttacggtaaccggtacgttcgagggtacgtcgggtacggtcggggtacgtacggacgtacgttacgttccgaccttcgaacccgacgtactacgacncgtacgaccgttaggaccgtacgtcgaacggtagttacggtcgtaacgtgtttaacgttcgtcgtagtacgtacgtaacgttattaacggttttactaagtttacccgttacgtttccccgtaaccggttttacccgacccggtacgggttaaccgaaaggttaacggttaccgaaagtttaaccgtaacggtaaaccggttacggttacgtaaccccggtcgtccgtaacccg

SEQ ID NO: 116435 - DNA, 811 bp, Homo sapiens
  misc_feature: GYAE6OF01ASFCL.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttgggtggcagcagcccacaagacgcccactcccaggtgcagctggtgcagtcgtggggctgaggtggaggagccgtgggcctcgagtaggaacggtcctccgtgacgtaaggtccttcgtcggtcctaacctaccgttaccgaacccgggtaccgtaaccttactccctaccgtacggtcgggggtacggaccggaaccggacccgggtaccccccgtaggggaaccggtaaacgggggtccgtttacggaggttaggggtaggtaggggtacgttacggggtaaccttaaccccgtaaaacccgtaaagtaacggttaggggttaccggaacctaaaccgtaaacgttactacggtaaccgtaacgtaaacggttaaggttaccggtaacggggtaacggtacgggttacccaaccgtaacggtacggaaaccgggaacggtaaccgtacgtaacctacgttacgaccgaccgaccgtaacggtcctaacggtacggacggtacgtaccgtaggacgtacgtacgtaacctagtaccgtatacccgtacggaacccgtacgaaccggttaccttagtttaacgtacgttcggaacgggttaggttaacggttacggtttacgggttcccgggttaacggttccggttttacgggtttacccgg

SEQ ID NO: 116436 - DNA, 783 bp, Homo sapiens
  misc_feature: GYAE6OF01DWAGC.45.37.D04.1.454.CMB.1.raw
  modified_base (189)..(189): a, c, t, g, unknown or other
  misc_feature (189)..(189): n is a, c, g, or t
  modified_base (264)..(264): a, c, t, g, unknown or other
  misc_feature (264)..(264): n is a, c, g, or t
tcagacgcgatcgacacgaccggtgctcgatttagtagcatactgttgggtttgggggagcatcacccagcaaccacatctgtcctctagagaatcccctgagagcttccgttcctcaccatggactggacctggaggatcctcttcttgggtggcagcgagccaacaagacgcccactcccgaggtcncagctggtgcagtcgtggggctggaggtgaggaacgtccgtgggcctgagtgacggtctctgcgaaggtcttcgnggcctactacccgttaccgaccggacgtaactactccgtacccgtacggttcgggtacgaccgtaacgtacccgggcccccgttaggggaaccgtacggggttaccgtttgggaacggttgggaaacggttggggtaacttacgggtaacctaacccgtaaaacccgttaaacgtaaggttacggggtacgaaccgtaaaacgttaaaaccgtagtacgaaccgtaacggtaaacggttaaacggtttcgggaagggtccgtaacgggtacccaccggtaagtaccggaccggtaaggaccctacggtaccagtaccgaggtaacccagtaccgtacctaagacgggtacggacgtacgtcggaacgccgtaacgaccgtagaactccgttaacgaccggaaccgtaccgacccggttaaccgtttagtttaacgttacgtcgggttaacgtacgggttaaacgtttccggtttaaccgggttacccgggttggtttcccggtttcggtttttacccgg

SEQ ID NO: 116437 - DNA, 733 bp, Homo sapiens
  misc_feature: GYAE6OF01C9ZCW.45.37.D04.1.454.CMB.1.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
  modified_base (713)..(713): a, c, t, g, unknown or other
  misc_feature (713)..(713): n is a, c, g, or t
  modified_base (722)..(722): a, c, t, g, unknown or other
  misc_feature (722)..(722): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgccgtacggggacatcgtgatcgacccagtctccgacgactccctggtctgtgtctcgngggacgaggacggccaccatacaacctgacaacgtccacgaccgagtagttcgtttagaacgngactaccaaacgtaataaagtaaccttaacgttagtcgttacggtaaccagaccgaaacgaaaccgtaggtaccgtaccggtaccctacgtaagtccgtgaccttactaacgtttcgtaggacctacgtacccggtaaccgggtacggttcccgggtacccgtggtaaccgtacgttacgacggtacgggacgacgggtcggtacgtacggggtaactacggtactttacgaccgtttcaccgtaacctacgtaccgaggtccgtaacgtcccggttaagaacccgtggtaacgtaacggaagtcgtaggtcgttaacgtttaggtttaccgtacggtcttgtaacgagtacttaaagttattttaacgttctttaaccgtcccgtttacgtacccggtttcccgaaccggtacgggtaaacctaggtaactacgtaaatacgtaaaccgtacgngtttaccgngtacctaaccg

SEQ ID NO: 116438 - DNA, 772 bp, Homo sapiens
  misc_feature: GYAE6OF01B0AU1.45.37.D04.1.454.CMB.1.raw
  modified_base (396)..(396): a, c, t, g, unknown or other
  misc_feature (396)..(396): n is a, c, g, or t
  modified_base (418)..(418): a, c, t, g, unknown or other
  misc_feature (418)..(418): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttgggtttgggggagctacaacaggcaggcgaggggcagcaagagtggtgttgcagacccaggtctcatttctctgtgctctggatctcgtggtcgaccgtacgggacacgtcgtgactcgacccgagttcctccagacccttcccgtggcgtgttcgtccgtcggtcggggcggacggacgggacccacctactaccgaacgtcggacctaacgtccaggccgtaaaggttgtttacggtttaacgacgacctaccaacctaaacgtaaacgtaaaccgtaaacgttacgttacgtacgttacgaaccgacgacgaaacaaccggtggtaccgaccgtaccctaccgtanccgtctactacgtacgttacgnggtccacgtacccggaccgggtaccgtccggtccgaacgcgtagtcggacgtcgaacgcgggttcgagacggtacncgttactacgtactaccacctacacgtcgacgtcgcgtaccgtacgcgaggtacctaaggtagtacggtacgtagttcctttaagggtttcgacggttacgtaaccgtacgttaacgtacttttaaaagtttcttaacccttacgtttccccctaacggtttcccggttaaacccggtttccgggaacggttaaacccgtaaacggttaaaccgttaaggttaactaaacccggttaaacggacggttaacccgtgggttcccggtaaccctaaccgg

SEQ ID NO: 116439 - DNA, 781 bp, Homo sapiens
  misc_feature: GYAE6OF01A5R77.45.37.D04.1.454.CMB.1.raw
tcagacgcgatcgacacgaccggtgctcgatttagtagcatactgttgggtttgggggagcatcacccagcaaccacatctgtcctctagagaactcccctgagagctccgttcctcaccatggactggacctggaggatcctcttcttggtggcagcacgccacaagacgcccactcccaggtcgcaacgtggtgcagtcgtcgggcgtgaggtgaggacgccgtcgggcctcgagtggacggtcctcgtgacgaacggtcttcgtcggacctacctaccgttccgaccggcgtactactaccgtccgaccggtggggtcgaccggaccgacccgggtcccgtacggaaccggtaaaggggtccgtttaggaggttagggacggttagggtaacgttacgggtactaaaccccgtaaacccgttaaaacgtacggttcgggtacgaaccgtaaacgtaaacgttaataccggaactaaccggtaaggtttaacggttaacggacgggacggtacggtaaccaccgtaagaccggaaccgagggtacccgaccggtaccaacgtccgaacgaccgaccgtaccggtaacctaacgacggtaccggacgacgtacggacgtacgtaagtaacccgtataacgtacgacgtaccggaaccgtaacggtacccgttaacgtttaaacgtttacgttacgtcgggtaggaaccgggtttaaggttcggttaccggggttttacgggttagtttacccgggtttttcggttttccggtttaacggg

SEQ ID NO: 116440 - DNA, 908 bp, Homo sapiens
  misc_feature: GYAE6OF01AV3NE.45.37.D04.1.454.CMB.1.raw
  modified_base (200)..(200): a, c, t, g, unknown or other
  misc_feature (200)..(200): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccaggtgcagcgtggtgcagtcgnggggctggaggtgaggacgccgtgggcctcgagtgacggtctccgtgacgaacggtcttcgtcggtacctaccaccttccgaccggtccgtaacttactaccctccgacggtcggggtacgaccggaccgaccggtcccccggttaggggaaccgtaaacgggggtctttacgggacgggttgggtaaggttcgggggtaacgttacgggtaaccttaaccccgtaaaaccccgttaaacgtaaaggttacggggtacccggaacctaaaccgtaaaaccgttagtacggaaaccgtaaacggtaaacggtttaaacgggtttccgggaaacgggggtaccggttaccggggttaacccctaaaccggtaccgggttaccgggaaacccgggtaacggggtaaacccgttaaccccgggtaccctaacgggtttaccccaaccggaaccccgtaaccggtaacccgtaacccgtaacggtaccgggtttaggggaacctacggttaccgggaaccggtaccgaacggtaacccgttcggtaacctaccggttaacggacccgtaacgggacccggttaacccggtaacccgtttttaagtttaaccggttaaggttccggtaacggtacggggttaacggtttacggttttaacccggggttccgggttacggggttttccggttttaacgggtttttaaccccgggg

SEQ ID NO: 116441 - DNA, 782 bp, Homo sapiens
  misc_feature: GYAE6OF01EGXQ3.45.37.D04.1.454.CMB.1.raw
  modified_base (120)..(120): a, c, t, g, unknown or other
  misc_feature (120)..(120): n is a, c, g, or t
  modified_base (155)..(155): a, c, t, g, unknown or other
  misc_feature (155)..(155): n is a, c, g, or t
  modified_base (163)..(163): a, c, t, g, unknown or other
  misc_feature (163)..(163): n is a, c, g, or t
  modified_base (268)..(268): a, c, t, g, unknown or other
  misc_feature (268)..(268): n is a, c, g, or t
  modified_base (329)..(329): a, c, t, g, unknown or other
  misc_feature (329)..(329): n is a, c, g, or t
  modified_base (361)..(362): a, c, t, g, unknown or other
  misc_feature (361)..(362): n is a, c, g, or t
  modified_base (763)..(771): a, c, t, g, unknown or other
  misc_feature (763)..(771): n is a, c, g, or t
  modified_base (773)..(774): a, c, t, g, unknown or other
  misc_feature (773)..(774): n is a, c, g, or t
  modified_base (776)..(780): a, c, t, g, unknown or other
  misc_feature (776)..(780): n is a, c, g, or t
  modified_base (782)..(782): a, c, t, g, unknown or other
  misc_feature (782)..(782): n is a, c, g, or t
tcagacgcgatcgacacgaccggtgctcgatttagtagcatactgttgggtttgggggagctacaacaggcaggcagggcagcaagatggtgttgcacgacccaggttcttctacttttnccgttcgttgttcgtcttcgtagtacttccgtccngggggtcnccgttaccgggggtacattcgtacgatcgtaccccagtcctgcccctacggactccctgggtcgtcgttggtcggtacctggggaccgcgaaggtccacctagtncccaagttccgacgaccgtacgaggtccgtttaggacgttacggtttacgaacccgaaagntaacctaaacgaacttaacgttaaacgtacgnntttaggtctacggtaccgacgaaccgaacgtaaccgtacgtacgaccgtacccgtaccgtaacgtacgtcgtacgttacgttacgttacgtacggtacgtacgtaccggtaccggtaccggtccggtaccgtacgtacgtacgtcggtacggtacgtcggcgtacgtacggggtaccgtacgggtaacgttacgtacgttaccgtaaccgtacccgtacgtacccgtaaccgttaccgtaaccggtacccgtacggtaccgttaccgggtacccggttaacgggtaaccggttaaccgggtttaaaccgggggttttaaacccgggggttttaaaccccgggggttttttaaaccccgggggggtttttttttaaaaaccccgggggttttttttaaaaannnnnnnnntnntnnnnngn

SEQ ID NO: 116442 - DNA, 849 bp, Homo sapiens
  misc_feature: GYAE6OF01DUZ6D.45.37.D04.1.454.CMB.1.raw
tcagacgcgatcgacacgaccggtgctcgatttagtagcatactgttgggtttggggagagcatcacccagcaaccacatctgtcctctagagaactccccgtgagagcctccgttcctcaccagtggactcggacctggagactcctcttcgttggtcgcagcacgaccaacgaacggaccgacccactcccgaggtcgcagtcgtggtcgacgtaggtccggtggggtcttaggagggtacgggaagggtacggtccggtccggggtcctacggaggttacgggaacgttcccgttcgtacggtaccggtaacggttcctttacggacggtaaccctttaaccgtaccccgtttaccgggaacccggtcttaaccttaccgttccccgtaaccggtacgggtttaccggggaccgacccggttaaccggaccccggttcccgggaacgggtaaccgggtaagggttcctagggacggttaaggggacggtacgggaccgttaggaaccctaacccgttaaaccgtaagtacgggtacgggttacaaccgtaaactaacggtgaaccgaacgtaacgtaagggttaaccgttgggaacggacggtaaccgtccgtaacgacgtacggaaccggtacggaaccgtccgtaacgacgtacaaccgacgtaacgacccgtacgtaacgtagacgggttcacggtacgacgtacgaaccgtacgtacgtacgtaccgttacggacctaaccggaccgtaaccgttacccgttaagttttacggccgttaggtaccggaacgtttacggtacgggtttacgtttcccgggtttgttaccggtttttacccggg

SEQ ID NO: 116443 - DNA, 878 bp, Homo sapiens
  misc_feature: GYAE6OF01AWMNS.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtcgtctcgtcgggcgaggcggcccacatacactgacacgtccagccgagtgttagtttacgacacgtcctaccaaactaataaacgtaacttaacgttacgtccgttacggtaaccacgactaacggaaaccgtacggtaccacgtaccctaccgtaacggtcctcggtaccttacgttaacgttttacggcggggtaacctaccgttacccggttaaccccggggtaaccggttccccggggggttacccctaccgggtaacccgttacgttacccgtaacggggttacggtaccggtcggggtcccggggttaccggttacggggaaacgtacgttacctttacccgtaaccttcctaacccaaccgttacacgaacgtcccgtaacggcccgtaggaacccgtacggttaccgtagggaaagttcgggtaacggtttacggtagttttaacgggttttctacgggttaccgtttacggaaccgttaaggtaactttaaaacttttaacggttttaaactttcgtttaacccccgtttcccgggttaacccgttaccccgggttttaccccggggtaacccccggttaaacggggttaaacccggttaaggttaccgttaaacggttaaccccgttaaaaacggaacccgggttaaccggttcgggttaccggtcccgtaaacccgg

SEQ ID NO: 116444 - DNA, 761 bp, Homo sapiens
  misc_feature: GYAE6OF01DQ5P2.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagtacctcctggctgtcgtcgtcgtgggcgaggacgggccaccatccaactcgacaacgtccagccagtagttgtttagacacgcctaccaaactaaataaacgaacttacgttacgtcgttacggtaaccagaccaacgaaaccgaggtaccgacgtaccctaccgtaaacgcgtcgtacttacgtagtttacgcgggacctaacgtacccgggtaaccccgggtaacggttccccgggggttacccctacggtaacccggtacgttacggacgggtaccggaccggtaacggggttccggggtacgtacggggaacgtacgggttactttaccgaccttccgtaccgaacctacgtacgaacggtccaacggtccgtcgaacgacggtacgtaggtaaacgtgttcggtacgttaacttagtttacgcgtacgtcgtacgacgtaacttaagttaatttcgtaatttacccgtacccgttaacccggttcccgtttacccggggacccgttaagggttaaaccctaaagggttcggtaaaaccttcgtaaaaccggaaacggtacgttcggtacggtcgttaacccg

SEQ ID NO: 116445 - DNA, 740 bp, Homo sapiens
  misc_feature: GYAE6OF01CVJ03.45.37.D04.1.454.CMB.1.raw
  modified_base (169)..(169): a, c, t, g, unknown or other
  misc_feature (169)..(169): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (685)..(685): a, c, t, g, unknown or other
  misc_feature (685)..(685): n is a, c, g, or t
  modified_base (708)..(708): a, c, t, g, unknown or other
  misc_feature (708)..(708): n is a, c, g, or t
tcagacgcgatcgacacgaccggtgctcgatttagtagcatactgttgggtttgggggagctacaacaggcaggcaggggcagcaagatggtgttgcagacccaggtcttcatttctcttgttgcttctggtacttctcgtggtcgtccggtacggggactttagtcgngactcgacccgagtcctacacgtcctccgtggcgttgtcgtccgtcggtcggggcgacggaccggaccctaaccgtagtaccctaacgtcggaacctaacggtacccgagacccggtaaggttacgtttaggttaacgactacgtacctaacaaacctaaataacgaacttaacgttntacgttagaccagacaacgacgngtcacgtcctacagctagaccttagtacgttacgcgggaactaccgtaacccggtaacccgggtaacgttcccgggtacccgtaagggaccctttagacgtacgggtacgcccggtacggggttaccgggttacggtacgggtaacccgttaagtttacctttaccgtaccccgtaccgtaaccgaacctacgtaacgaccgttacgacgttaccggagtaccgacgtacggtaagtagaccgtggtacctagtttacgttagtctagtcgtataacgtataactttacttattaacttaccgtacttaccggtntacccgtgtaggtaactaaggtntaacgataacgtaaacgcttggcgtacgtacg

SEQ ID NO: 116446 - DNA, 784 bp, Homo sapiens
  misc_feature: GYAE6OF01EW91C.45.37.D04.1.454.CMB.1.raw
tcagacgcgatcgacacgaccggtgctcgatttagtagcatactgttgggtttggggagagcatcacccagcaaccacatctgtcctctagagaactccctgagagctccgttcctcaccatggactggacctggaggactcctcttcgttggtggcagcagaccaacgaagacgcccctactcccgaggtcgcagcgtggtcgcgtagtccggtgggctggaggtggaaggaacggccggtaggggcctacgaggtaggtacggtcctcgtagaccgtaacggtctttcgtcggacctaccgttacccttaccgaccggtcctaacgttacctcctacccgtacggtggggtccgaccgtaccggtcccggtcccggtagggtaacccggtaagggtcgtttagggagggttaggtacgggttaggaacggtacgggttaacctaaaaccccgttaaacccgtaaaacggtacgggtacggttaacgggaacctaaaccgtaaaacgttcgttacgaaccttaaacgggtaacgttaaacgggttacgggaacgggggtaaccgtaccgggttaacccaacgtacggttaaaccgggacccggtaaaccggtaacggtaccgtaaccgtaccgtaccgaaccgaccgtaaccgaccgtacttaacggacgtcggtacgtacgacgcgtagtacgacttacgactcgacgtaccgacgtaacgtccgtacttagttactgtacgaggtacgttacggtacgtttacgtcggtgttcggtttacg

SEQ ID NO: 116447 - DNA, 779 bp, Homo sapiens
  misc_feature: GYAE6OF01C20AN.45.37.D04.1.454.CMB.1.raw
  modified_base (138)..(138): a, c, t, g, unknown or other
  misc_feature (138)..(138): n is a, c, g, or t
  modified_base (194)..(194): a, c, t, g, unknown or other
  misc_feature (194)..(194): n is a, c, g, or t
  modified_base (279)..(279): a, c, t, g, unknown or other
  misc_feature (279)..(279): n is a, c, g, or t
  modified_base (448)..(448): a, c, t, g, unknown or other
  misc_feature (448)..(448): n is a, c, g, or t
tcagacgcgatcgacacgaccggtgctcgatttagtagcatactgttgggtttggggagagcatcacccagcaaccacatctgtcctctagagaactccctgagagctccgttcctcaccatggactggacctggagntcctcttcgtggtgcagcagccagaagacgcccacgtcccaggtgcgagcgtggtncgtagtcgtgggctggaggtggaggacgcggtcgggcctgagtacgtacggtcctcgtagagtacgtccttacgtcgacctaccnccgttaccgaccgtactaccgtactccgaccggtggtcgggacaccggtaccgaccgtcccggtaaggaaccggtaggtcgttaggacgggtaggttaggacgggtacgtagaaccttaaacccgtaaaccgtaagtacgggttaggaccgaaacctaagtaaacgttnacggtacgaaacgtaggttacgttaacgggacggtcgtaacggtaccaacgtacgaaaccggtacggaaacggtaaccacgtacgaaccgtacgaccggtaacaaccggtaccgttaacggaaccggtcgggtaccgggtaacggaccggtaacggtaccggtaaaccgtaacggttactaaccggtaacgttcgttaacccggaaacggaacccggttacccgaacggttttaaccttaaacgttttcgtacggtacggtaacgggttacggtacggtttaaacgggtttttccgggtaacggttccgggtttacgttttttaacccggg

SEQ ID NO: 116448 - DNA, 799 bp, Homo sapiens
  misc_feature: GYAE6OF01EICZG.45.37.D04.1.454.CMB.1.raw
  modified_base (109)..(109): a, c, t, g, unknown or other
  misc_feature (109)..(109): n is a, c, g, or t
tcagacgcgatcgacacgaccggtgctcgatttagtagcatactgtgggttgggggagctacaacaggcaggcaggggcagcaagatggtgttgcagacccaggtcttnatttctctgtgctctggatctcgtggtgtccgtacgggactagtcgtgtacgtcgaccctagtcctaccgaacgtcctcccgtaggcctggttcgtcgtcggtcgggacgaggaccgggaccaaccgtaactacgaaaccgtcgaaccgtaacgtaccgtaacggcctaaggttacggtttacggtttaacaccgtaacgtacctaacctaaaagtaaacgtaaacgtaaccttagttacgtacgttacggtaacagtaaccgaagaaccgtggtacacggtacctacgtaacgcgtgtacctacgtacgtttaccgaggtaacgtacccgtaaccgggtacccgggtaaccgtcccggggtaacctacgtaaccgttacgttaccggaggtacggacgtacgggtaccggtcggaaacggtactacgttacttaccgacgtacgtaccgtacctaacgtacacgtacgtacgtccgtacgtacgtacgtacgtaacgtagtacgtcggtagttcgttaagttcgagttactacggtagtaacgttacttaagttaaccgttaacgttacctaccggtttacccgttaccggtacccggttttaccggtaaccggtaacggtaaacccgttaaggttaacgtaaactacggtaaaccgtaacgttacgtcggtaccggtaacctaacccg

SEQ ID NO: 116449 - DNA, 955 bp, Homo sapiens
  misc_feature: GYAE6OF01DVSOW.45.37.D04.1.454.CMB.1.raw
tcagacgcgatcgacacgaccggtgctcgatttagtagcatactgttgggtttggggagagcatcacccagcaaccacatctgtcctctagagaactcccctgagagctcccgttcctcaccagtggactggacctggagactccttcttcgttggtggcagcagccaacaagacgcccactcccgaggtgcagcgtgggtcgctacggtcgtggggctagggtaaggtgacgggaacgtccgtacggggccctgaaggtagaacggtcctacgtacggacgaaggtccttcgtcggaccttacctaacccgttccgaacccggacgtaacctacgttcccgtaccgtacgggtagggtacgacccggaacccgaccgggtcccccgtaagggaaccgtaacggggtccttaggagggtacggtaggtacggggtaacttacgggtaaccctaaacccggtaaaccccgtaaaggtaacgggtacgggtacggtaaaccgtaaaaccgttaaaccgtaggttaccgaaaccgtaaacggttaaacgggttaaacggtttaccggggaaggggtaaccggtaaccgggttaacctaaccgtaacgggtaacccgggaaacggtaaaccgggtacccgtaaaccgttaaccggaacctaaccggtaacggaaccctaaccggtaaccgttaacccgtaacggttaacgggtaacgggtacccgttaagggaaccggaaccgggtaaaccaaccgggtttaaacgaaccgtaaccggtaaaccgtttaacccgggaaacccggtaacccggtaaaacccggggttacccttaaacgttttaacccggttttaaccggttacgggttaccgttaaacggggtacgggtaaccgggttttaacggtttacccgggggtttaacccgggttaacgggttttcccgggtttttaaccccggg

SEQ ID NO: 116450 - DNA, 829 bp, Homo sapiens
  misc_feature: GYAE6OF01DX6Q1.45.37.D04.1.454.CMB.1.raw
  modified_base (819)..(819): a, c, t, g, unknown or other
  misc_feature (819)..(819): n is a, c, g, or t
tcagacgcgatcgacacgaccggtgctcgatttagtagcatactgttgggtttgggggagctacaacaggcaggcaggggcagcaagatggtgttgcagacccaggtcttcattttctctgttgctctggatctctggtcgccgtacgggacagtcgtgaagtcgacccagtcctccgacgtacctcccgtggtctgtcgtctcgtgggcgaggacggccacgatacaactcgactaacgtccacgaccgagtacggtttgtttaacgactacgtacctaccgaaaataaactaaacgtaaccttaacgttacgtcgttacggaaccgtagaccaacggtaaaaccgtcggtaccaccggtacccttaccgtaaacgtccgtacggtaccttactaacggttttacggaccggtacgtaaccgtacccggttaacccgggtaaccggttccccgggggtaccctacggtaaccgttacgttacggtagggacggttaccggtacgggtccggggtacggtacgggtaacgtaacgggtttaaccttttcccgaaccgtttccgtaaccccgtaaccgtacgtaccgaccggttacgaaccgttccgtcgacgtaggggttaccaaggtaaccgttggtacgggttcgtagtttaacgtttacgttcggtactcgtaacgtaacttaagtaaattttaccttaatttaaccgttcccgttacccgttaaccgtcccgtttaaccgggacccggttaagggtaacctaacgggtttacgaacgttaaacgttaaacccggaacgtttaacgtcgggtaccncggttacccg

SEQ ID NO: 116451 - DNA, 789 bp, Homo sapiens
  misc_feature: GYAE6OF01B97LD.45.37.D04.1.454.CMB.1.raw
  modified_base (595)..(595): a, c, t, g, unknown or other
  misc_feature (595)..(595): n is a, c, g, or t
  modified_base (657)..(657): a, c, t, g, unknown or other
  misc_feature (657)..(657): n is a, c, g, or t
tcagacgcgatcgacacgaccggtgctcgatttagtagcatactgttgggtttggggagagcatcacccagcaaccacatctgtcctctagagaactcccctgagagtccttcccgttcctcaccagtggactggacctggagatccttcttcgttgggtggccagcacggcccaacgaacggacgaccccctacgtccccgagggttcgcacggtcgttcgggtcgccgtaggttccggtgggggtacgttggagggtacggaagggaacggtcccgggtcgggggtacccttaggacgggttaggaacggttccccttcggtacggaccggtaaccggtcgtttccgtacggtaccttacccgtaccgttacccggaccggtccgtaacttactcccgtaccgtcgggtcggcgaccgtacgcccgccgtaggacgacggtctagacggtggtacggtgggtatacgacgtaacctaaccgtaagtaggtacggacgaacctaaagtaaccgtagacgacgtacgtaacggttaacgtaccggaggacgggtaccgataccgacgtaccggaacggtacgtacccgacgtacncgtacgaacgccgtaaccgcgtaaccgacgtcgtacggcgtaggtcgacgaatacgtaccgngtacctatacccggtaaggacccttcccggaaacgtttccgttaaatttcggtttaacggcggttaaccgggtaccggtttaaggttcggttttaaccggggttccgggttcgtttaccgggttttacccgg

SEQ ID NO: 116452 - DNA, 647 bp, Homo sapiens
  misc_feature: GYAE6OF01BP7ZA.45.37.D04.1.454.CMB.1.raw
  modified_base (482)..(482): a, c, t, g, unknown or other
  misc_feature (482)..(482): n is a, c, g, or t
tcagacgcgatcgacacgaccggtgctcgatttagtagcatactgttgggtttggggagagcatcacccagcaaccacatctgtcctctagagaatccctgagagctccgttcctcaccatggactggacctggaggatcctcttcttggtggcagcagccacaagagcccactcccaggtgcagctggtgcagtcgtgggctggaggtgaggagccgtgggcctcgagtgaggtctccgtgcgaaggtcttcgtggcctacctaccttcgaccggcgacttactcctccacgtgggcgcgacgacggcccgtaggacgagggtctgaggtggagtgggatggactaccaaaccgtaacaagtggtacgactaacaactagtcgacaacgaaggtacgttacggacgggtacgtaggtaccacgtacgtacgaaccgaaggtaaccgaccgtacacgtacgacgtaccacgccgtacctaanacggtagggaacgtcgtacggacgtacgacgtaacgtagaactcgtacggtacgaaaccggtaccgtaaccggtacctttaagttttaacgtacgtacggttacggtacgggtaaggggttacgttttacggggtttaccgggttgggtttcccggttttacggg

SEQ ID NO: 116453 - DNA, 773 bp, Homo sapiens
  misc_feature: GYAE6OF01BZQ2I.45.37.D04.1.454.CMB.1.raw
tcagacgcgatcgacacgaccggtgctcgatttagtagcatactgttgggtttgggcatcacccagcaaccacatctgtcctctagagaatcccctgagagctcccgttcctcaccatggactggacctgggaggatcctcttcgttgggtggcagcacgaccacaagacgcccacctcccgagggtcgcgagcgtgggtgacgtggtcggtggggcgtaggagggtaggaggtacgtccggtcggggacctcgaggtacgtacggtcctcgtgacgtaggtcttcgtcggtactaccgtacctaccgaccggtacgtactacctaccgtaccgtaggtcggggtcgaccgaccggcccggtcccgtaggaaccggtagggtcgttaggacgggtaggaggttagggtacgtacggaaccgttaacccgaaaccggttaaggaacggttacgggtacgaacctaaaacgtaacgtactacggtaactaacggtaagttacggttacggacgggtaccggaggttacccaacgtaacggccggtaaccggtacggaaaccgtaccgaccgtacgtacgacgtaccgaacggtaccgtaaccgagtaccggtacggacgttcgaacgtacggacgtacgtagcgtaacgtacgtaacgacccggacggttaacccgtacgttaacgtttagttaacgtcggaggttaccggacgttagggtttacggttaccggttacccgggtgtttaccggttttccggtttcggtacccggg

SEQ ID NO: 116454 - DNA, 702 bp, Homo sapiens
  misc_feature: GYAE6OF01AJA0N.45.37.D04.1.454.CMB.1.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaggagcccactcccaggtgcagcgtggtgcagtcgtgggctgaggtgaagacgccgtggggcctcgagtgacggtctccgtgcaggcttcgtaggactacaccttcaccggtctacgtatactacacgtcgggtcgcgaccgacggtcccccgtagggaaccgtaacgggtctttacggaggtcgggaaggtggggtaagttcgggtaactacccgtaaaccctaaacggtaagtcgggtacgacgtaacctaactagtcgactacgtaagttaacgtttacggacgggtaccggtacgggtaccacgtagtaccggaaccgacggtaccgaccgttaccacgtacgacgaccacgaaccgtactaacgtaggtacggactacggtaggacggtacgacgggtacgtacggtacgtacgtacggtacgaaccggtaccggtaccgggtccggttaaggtttaccgttacggttcgggtacgggttaacggacgggtacggaaccggttaaggttaaccgtttaacgggttttaaggg

SEQ ID NO: 116455 - DNA, 777 bp, Homo sapiens
  misc_feature: GYAE6OF01A0K5E.45.37.D04.1.454.CMB.1.raw
  modified_base (170)..(170): a, c, t, g, unknown or other
  misc_feature (170)..(170): n is a, c, g, or t
  modified_base (327)..(327): a, c, t, g, unknown or other
  misc_feature (327)..(327): n is a, c, g, or t
tcagacgcgatcgacacgaccggtgctcgatttagtagcatactgttgggtttgggggctacaacaggcaggcaggggcagcaagatggtgttgcagacccaggtcttcatttcctctgttgctctggatctctggtgccgtacggggacatcgtgatcgacccgagtcnccagacctccctggcgtgttgtctcgtgggcgaggacggccaccatcaactgactacgtccgacgccgagtacgttagtttacgacgacgtacctaaccaaataaagtaacgtaaaccttacgtacgtcgttacggaaccagaccgaacgaacccgnggtcacgtcctacgtagctcgtcctacgttacgttacgcggaactacgttacccggtaacccgggtaacggtcccgggtaccgtacgaaccggtacgttcggaacgggtcggccggtaacgggtccggggttacggacggtactaacgtttcttacccgaccgttaccctaccctaaccgtaccgtaccgtacggcccgtaccgtaccggtacggtaccggtaacggtacgtaggtaacggtaggttacggtacggtacggttacgtttacggttcgtccgttacgtacgtacgtaacgttaactttaacgtttacttacgttaccgttacccgttacccggtttaccggttaccccggttaccgggttaccggtaacccggttaaaggttacgtaacgttaacgtaacggtaaaccggttacggtacggtccgtaccgtacgtaccccg

SEQ ID NO: 116456 - DNA, 775 bp, Homo sapiens
  misc_feature: GYAE6OF01EAM6S.45.37.D04.1.454.CMB.1.raw
  modified_base (768)..(768): a, c, t, g, unknown or other
  misc_feature (768)..(768): n is a, c, g, or t
tcagacgcgatcgacacgaccggtgctcgatttagtagcatactggttgggttgggggagctacaacaggcaggcaggggcagcaagatggtgttgcagacccaggtcttctatttctctgttgctctggatctcgtggtcgccgtacgggacactcgtgagtcgacctagtcctaccgtagtaccgtcccgtggcgttgtcgttccgtcggtacggggcgaggaccgggccctaacgactaccgacgtacgacgacgtaccgacgtaccgtaggtaggtttacgttttaacgaacgtacgtacctaacctaaacgtaaagtaaacgtaacttacgttacgttcgttaccgtacgacgtacaaaccgtaacgacggtacctaacggcctacgtacgacgttcgctttactacgttacgtcggacttaccggtaccggtaaccgggtacccggtccggggtacctaccggtacgttacgtacggtacggtcggtaacgggttcggtacggggtaccgggtcgggtaaacggtaacgttacgttaccgtaaccgttcgtacctaactaccgtacgaactaccggtaacggtccgtacgggacgtaacggtaggtaacgttaacggtaggttcgttacgttaacggtttgttacgtggttacgtacgtagtaactacgttaacttatttacgtactaccgtttccgttacctccgttaccggaccggttaggaacgttaggtactagttaacaacgtacgtacgcggtcgngtacccg

SEQ ID NO: 116457 - DNA, 660 bp, Homo sapiens
  misc_feature: GYAE6OF01D50AZ.45.37.D04.1.454.CMB.1.raw
  modified_base (395)..(395): a, c, t, g, unknown or other
  misc_feature (395)..(395): n is a, c, g, or t
  modified_base (500)..(500): a, c, t, g, unknown or other
  misc_feature (500)..(500): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (654)..(654): a, c, t, g, unknown or other
  misc_feature (654)..(654): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatcgacccagtctccagacctcccgtggcttgtcgtctcgtcgggcgaggagggcccaaccgataccaactcggactaacgtccacggccaaggtagtttacggttttacgacgacgtacctaccaaaactaaacgttaaacgtaaccttacgttaagtccgtttacggtaaccacgacgaaacgaaacccgtggtccacggtacccttaccgtaagctcgcttacgttactttacgnggacctaacgtacccggtaaccggtaccgtcccggggtacctcggaccgtagtacgacggtcgacggaggtcggtcgtagggactagtacttccacgtcacaccntcgacgccgagtccgnggacngggtactaggagtagtcgtggtactttagttgtcgacgttcacgaacgttataattactttagtacttacctcccgttacgtccgttacggccgtagaacggtatcgtaatacgtaactaacgtagtggtcgngtaccg

SEQ ID NO: 116458 - DNA, 749 bp, Homo sapiens
  misc_feature: GYAE6OF01DLBYQ.45.37.D04.1.454.CMB.1.raw
  modified_base (420)..(420): a, c, t, g, unknown or other
  misc_feature (420)..(420): n is a, c, g, or t
  modified_base (720)..(720): a, c, t, g, unknown or other
  misc_feature (720)..(720): n is a, c, g, or t
  modified_base (733)..(733): a, c, t, g, unknown or other
  misc_feature (733)..(733): n is a, c, g, or t
tcagacgcgatcgacacgaccggtgctcgatttagtagcatactgttgggtttggggctacaacaggcaggcagggcagcaagatggtgttgcacgacccaggtcttcatttctctgttgctctggatctctggtgccgtacggggactacgtcggtagtacgtcgaacccgtagtacctccaagtacctcccgtggtccttggtcgtctcggtcgggaccgaggacggggcccaaccgactacctaaaccgtcgaccaaacggtccaacggacccgtaaggtacggtttgttttaacgacgtacggtactaaccgaaactaaagtaacgtaacttaacgttacgtaccttacggtaaccaggacaacgaaaccgtggtaccgacgtcctacgtaacgcctacgtctacttacgttacgnggacctacgtaccgtaccgggaacgtcccgggtcctagaaccgtcgttacgaggtcgacgtacggcgtcgtacggactagtacttcacgtcctacactagtcacgcgtacgcgtcgccgaggttcgtaaggaacgtggtggtacgcgtttattcgtcgtcttcgacgtagtaattaacggttattaccgttacgttaccccgttcttaccccgggttaacgttccccgggtaaccggtttaacggaaaccggttaacgggttacggtaacgttaccgtttaaaaaccgaaaccgggttanacggggtttaccnccgtccgttaacccgg

SEQ ID NO: 116459 - DNA, 734 bp, Homo sapiens
  misc_feature: GYAE6OF01BY8GD.45.37.D04.1.454.CMB.1.raw
  modified_base (363)..(363): a, c, t, g, unknown or other
  misc_feature (363)..(363): n is a, c, g, or t
  modified_base (494)..(494): a, c, t, g, unknown or other
  misc_feature (494)..(494): n is a, c, g, or t
  modified_base (514)..(514): a, c, t, g, unknown or other
  misc_feature (514)..(514): n is a, c, g, or t
  modified_base (534)..(534): a, c, t, g, unknown or other
  misc_feature (534)..(534): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggtatctctggtgccgtacgggacatcgtgactcgacccagtcctccagacctcctggctcggtctctcgtgggcgaggacggccaaccatacaacgtcgacaacgtaccacgaccagtgttgtttaagcgagacctaccaaacaataaagaacttacgtagtcgttacggtaccaagtacaacgtaaaccgagtaccacgtaccctaccgtaacgctagacctacttacgttacgnggtacctacgtacccgtaccgggtaacgtcccggtaccgtagtaccgtactcgtacggtcgaccgtagcgggtcgtacggaactagtagttaccgtcgtaactcccaactcgtcaaaccggtcacggtccngacacgggatacgtaagtcngggtttagtacttacgtttncgggtaaccttgggtaacctaactacgttaaattttacgttacgtttaacctttacccggttacccgttaaccggtttcccgggttttccgaaaccccggggtttaaggtaaacccttaaaggggtacccggtttaaaactaccgttaaaaaccccggaaaaccggtttaccggtaggttacccgggtacccctaaacgg

SEQ ID NO: 116460 - DNA, 854 bp, Homo sapiens
  misc_feature: GYAE6OF01DCB8O.45.37.D04.1.454.CMB.1.raw
  modified_base (107)..(107): a, c, t, g, unknown or other
  misc_feature (107)..(107): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (679)..(679): a, c, t, g, unknown or other
  misc_feature (679)..(679): n is a, c, g, or t
tcagacgcgatcgacacgaccggtgctcgatttagtagcatactggttgggttgggagagcgatcaccagcaacctacatctagtcctctagacgaactccctgagngcctcgttccacaccatcggactggacctggaggtctcctcgttcttgggtgacgagcgaacgccaagaagccgcccctacgtcccgagggtcncgtaacgnggttacgggcgcgtacgttcggacggggtctggggaaggtcggaggttaaccggccggttcgggtaccacggtaagggttgaaacggttccagtgggaacgtaagggtcctcggtacacgtaaccgtaccgttcgaaccgtcgaactactaccgtccgtaacggtcggtaccgacgtaccgggaccgtaccggttaagaaccgggaacgggttcgttaagttaccggggtagtaacgggttacgggtaagtacgggtaaccttaaccgaaaaccgttacgtaaagggtcgggaaccggtaaactaacgggtaaactaccgcgtacgaacggtacgttaaacggtcgggagaccggtacggttacctaaacggcggtaacggaaccgggtacggtactaaccggtgactaaccggtgtaaccgaccgttaacgtaccgtaacgcggttaacgggaacctagttaaaccggngtaccgggtacgtaccggtaacgtacgttcggtaaacccgtcggaaaccgggttacaaccgggtttaacctttaaagggttaccgtagggttaaaccggtacggttacgggttaaaaccgggttcgttttacccgggttaagggttacccgggttttggttttaaacccccgggg

SEQ ID NO: 116461 - DNA, 680 bp, Homo sapiens
  misc_feature: GYAE6OF01B65GS.45.37.D04.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtgcagcagcacaagagccactcccaggtgctaactggtgcagtcgtgggctgnggtgaggacgccgtggggcctagagtggaagttccncgtgacgtaaggtcttcgtggacctacacccgtttcgaccggtcgtaacctagtcctaccgaccgtgggtcgtaccggacgtaccgggtccctaggacgtaagggtcttaggaggtgtaggtggtactagaacgttaccaaacccgttaagaagttcgggtagtaaccaacaaacgttgacgacgaacgtagttaacgttacggaggacgtaggtacacccgagtacgaccgaaggacgtaaccgtacaggtcacgacgaacgtacgaccgttagacgttacggacgtaccgttaagacggtacacgtaagtacaaccgtacgttaccgaacggaccgtaacgtacccgtaacgttactttaagttaccgtaggttacgggacgttacggtagttaccgggtttacggacgggtttcgttacggttttccgtttaaccggg

SEQ ID NO: 116462 - DNA, 778 bp, Homo sapiens
  misc_feature: GYAE6OF01EEU38.45.37.D04.1.454.CMB.1.raw
  modified_base (769)..(769): a, c, t, g, unknown or other
  misc_feature (769)..(769): n is a, c, g, or t
tcagacgcgatcgacacgaccggtgctcgatttagtagcatactgttgggtttgggggagctacaacaggcaggcagggcagcaagatggtgttgcagacccaggtcttcattttctcgtgttgctctggactctcgtggtcgccgtacgggactattcggtacgtagtcggacctagtcctaccgaacgtccgttcccgttggcgttcgttcgtccgttaccggtcgggacgaacgggtaccggaccctaccaactaccgaacttcgacgtaaccgtacccgacgtaccgaaggttacggttttacgttttaaccgaacgtacgttacccgtaacctaaaacgtaaagttaaaccggttaaccttaacgttacggttaccgttacggtaaccacgaccgaaaagtaaacccgtcggtacctaccgtcccgtaacgtaacgtcgtctaccttacgttacgttacggaccgtacgtaccgttacccgggtaccggttaccgtcccggtacgtcgtaacgtcgtacggaggtcgacggtacgtacggtcggacggtacttagtaccgttcgacctacctaccgtaacgtccgtaacgactacgccgtacgtacgtacgtcgtaacgtagaagtgtcggtacgtacgttagttctcgtactggtaaccctagttacgttaattacgttactttaccgtccgtttacgtacccgtacggttacccgtacggtaagtaaccgtagtactacgtaacgtaactacggtagttcgngtacctacg

SEQ ID NO: 116463 - DNA, 768 bp, Homo sapiens
  misc_feature: GYAE6OF01ENG2G.45.37.D04.1.454.CMB.1.raw
  modified_base (255)..(255): a, c, t, g, unknown or other
  misc_feature (255)..(255): n is a, c, g, or t
  modified_base (539)..(539): a, c, t, g, unknown or other
  misc_feature (539)..(539): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaccatcaactgacagtccagccagtagtagtttagacagctaccaaanaaataacgaactacttaagtcttaggtaccagacgaacgaaaaccgtaggtcaacgtcccgtactaacgtctcgctactatttacgtgggactagtcccgtaacccgggaacgttcccgggggtaccctacggacccgtacgttacgacggtcggacgtacgggcgggttaccgtaggggtacctaaggttacttaccgtactttacctaacccgtaacccaactaccggaacgtcccgtacggtaccgttaagcccgtaaagggtccgttaagggaaaacggngtttacggtacgggttaaccgttttaagttttaacgttcgggtaaccttacggttaacccgtaacgttaacttaaaatttaactttaagttttaaacgttaccgtttaccccgtttacccgtaccggttttacccggtacccggttaacggggtaaacccgtaaaaacgggttggtaaacgttaacgttaaacgaaaaccgttaaccgttgggttacgggacctaaccg

SEQ ID NO: 116464 - DNA, 689 bp, Homo sapiens
  misc_feature: GYAE6OF01BCCQH.45.37.D04.1.454.CMB.1.raw
  modified_base (424)..(424): a, c, t, g, unknown or other
  misc_feature (424)..(424): n is a, c, g, or t
  modified_base (485)..(485): a, c, t, g, unknown or other
  misc_feature (485)..(485): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctgatctctggtgccgtacgggacatcgtgatcgacccagtctcagacctcccgtggctgtgtctcgtgggcgaggacggccacatacctaacgtcgacaacgtccacgccgagtagttacgttttagacgtagtacctaccaaacaacgtaacgtaactacgttagtcttacgtacgacgacaacgaaaccgtacggtacgacgaccctaccgtaacgctcgtaccttactacgtttacgagactaccgtaccggtaccgggacgtcccggggtaccctacggaccgtacgttaccgnggcggacgtacggtcgggtacgtacggtactacggtactttacacttccgaccaacccgtntacgctaccgacggtccgtacgacgtacgggctaggacgtagtcggtgtaggtttacgttcgtgtctacgtatacgtaattattagttacttacgttaccgtttcccgttacgttaccggtttcccggtccggttaacgggtaaccgttaggtaacggtaaccttaagaaaccgttaacgttacggtacggttagccgtaacgg

SEQ ID NO: 116465 - DNA, 750 bp, Homo sapiens
  misc_feature: GYAE6OF01EZCTV.45.37.D04.1.454.CMB.1.raw
  modified_base (742)..(742): a, c, t, g, unknown or other
  misc_feature (742)..(742): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggacgggccaccatacaactgacaagtccagccagagttgttttaggacagcctaccaacaataacgaactacgttacgcttacggtaaccagacaacgaaaccgtaggtcacgccctacctaacgctcgaccttactactttacgtgggtacctacgtacccgtaacccggggtaacgtcccggggtaccctacggtacccgtacgttcgaggtcggacgtacggtccgggttacggacgggtaacgtacggttacgtttaccaaccgttccctaccgtaacccgtacgttacgaccggactaccggtaccgtacggtaccgacgggtactaacgggaaacgtacggttgggtacggttacgttaaggtttttacgtcggtacgttcggtaccgtaacggttaacttaaagttactttaagtttaacctaccgttttaccccgttaccggttacccgtttacccgggtaccccgttaagggtaacccgtaaggttacggtaaacttaccgtaaaccgtaaacggtaacgttcggtaaccgggtntaacccgg

SEQ ID NO: 116466 - DNA, 692 bp, Homo sapiens
  misc_feature: GYAE6OF01CDPOM.45.37.D04.1.454.CMB.1.raw
  modified_base (107)..(107): a, c, t, g, unknown or other
  misc_feature (107)..(107): n is a, c, g, or t
  modified_base (167)..(167): a, c, t, g, unknown or other
  misc_feature (167)..(167): n is a, c, g, or t
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (232)..(232): a, c, t, g, unknown or other
  misc_feature (232)..(232): n is a, c, g, or t
  modified_base (285)..(285): a, c, t, g, unknown or other
  misc_feature (285)..(285): n is a, c, g, or t
  modified_base (353)..(353): a, c, t, g, unknown or other
  misc_feature (353)..(353): n is a, c, g, or t
tcagacgcgatcgacacgaccggtgctcgatttagtagcatactgttgggtttgggagagcatcacccagcaaaccacatctgtcctctagagaactcccctgaagngctccttcctcaccatggactggacctgggagactcctcttcgtggtggcagcagccaanaagacaccctactccgaggtgcagcgtggcncaggtcgngggctggaggtagaggaacgtccggngggaccacgagtacggaacggtcctaccggtgacgagtcttcgcgtactaccnctaccgccgtcgtactactctccacggtggtcgaccgacgccggccgtaggacggagtcgtaggaggnggtagtacgggtatcggtaacctaacccgtaaactaaacggtggtacggtacaacgtaactaaacgttcgacgacgtaaaggacggtttaacggtcggaacggacggtacggtaccacggtagacggaacgtacggaaccacgtcaacgtacacgtaccaacgacgtaaccgagtacggacgtgaacggtacgaacgtacgaacgtacgacgtaacgtcgaacctacgggtaaccaacgttccgttaaacgttaacgtttacggtcgttacgggtacggtacgttaaccggttacgggttttaacggtcccggggttgtttccggtttttaacccgggg

SEQ ID NO: 116467 - DNA, 660 bp, Homo sapiens
  misc_feature: GYAE6OF01BFSBT.45.37.D04.1.454.CMB.1.raw
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccactcaactgacaacgtccagccagtagttcgttttagacagacctaccaaacaataaacgtaacctaacttacgtccgttacggtacccgagacgaacgaaaccgtacgggtaccacggtcccttaccgtaagtccgtagtccttactactttacggcggactacgtaccgtacccgggtaacgtcccggggtcctacggacctnttcgaggtcggcgtacggtcgggtcgnggacagtacttcactctactaccatcgacgacacgcctcggaccgtaggcgttagaacgtagtggtacggactttacgtttgctcgtagtactagtacttaatttacttatttacttaccttccgtaccggttacccgttacggtaccccggtaagtaccgttaaagggtcgtaaactaacggtaaactaaaccggttagtcgggtaccgcgttacccg

SEQ ID NO: 116468 - DNA, 754 bp, Homo sapiens
  misc_feature: GYAE6OF01EIUT0.45.37.D04.1.454.CMB.1.raw
  modified_base (371)..(371): a, c, t, g, unknown or other
  misc_feature (371)..(371): n is a, c, g, or t
tcagacgcgatcgacacgaccggtgctcgatttagtagcatactgttgggtttgggggagctacaacaggcaggcaggggcagcaagatggtgttgcagacccaggtcttcattttctctgttgctctggatctctggtgccgtacggggacatcgtgatcgacccagtcctccagacctccctggctgtgtctcgtgggcgaggacgggacccaaccataccaactgacaacgtccacgccagtagttgtttaacgcagcctacaaacaaataacgtaacttacgtagtccgttacggtaccagaccaacgaaaccgtacggtaccgacgtacccttaccgtaacgtctacgtacctactacgtttacgnggacctaccgtaccgtaacccgggtacgtcccggggtcctacgtaccgtagttccgaggtccggacggaccgggtcggggtacgtacggggtaacgtaacgttctttaacccaccgttaccctacccgaaccctactacgaaccgtcgtaaccgcgtacgacggtacgacgttaagaagttcggtagttcgacgtttagtttacgtcgtcgttaacggtacgttaaggtacttttaaatttaacttttaacgtttactttacccgtttacccccggttaaccggtttaccccgtttacccggggtaacccggttaacggtaaaccggttaaagacgtaacttaacgtaaacccgtaacggtaacgttcggtaggtcctaaccg

SEQ ID NO: 116469 - DNA, 937 bp, Homo sapiens
  misc_feature: GYAE6OF01A7MNV.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtcgtctcgtgggcgaggacgggccaccataccaactcgacgtaacgtccaggccaaggtagttgttttacgacacgtcctacccaaactaaacgtaacggtaaaccttaacgtttacggtacgttttacgggtaaccctaaggaccgtaacggaaaaccccgtacgggtaccaacgtccccgttaccgtaaacggtccttacggtaccttacttacgttttaccgtacggggtaccctaacggttaccccggtaaccccgggggtaaaccggttcccccggggggttaccccttacccgggtaaacccggttacgtttacccggtacggggtcgggtacccgggtaacggggtcccgggggtttaccgggttaccggggggaaaccgttaaacggttaccgttttacccccgtaacccgtttacccttaaccccgtaacccgtacttaacccgtaaccggcccgtaaaccgggttccccggttacggacccggtacgggtaccgttaacggggaacgttaaccggttgggttacgggttaccctttaagggtttttacgttcggttaccgtttacggtaaccgtaagttaccgtttaaaagttttacttttaacctttagtttaccccgttaccccgtttaccccgggttacccggttttcccggggtaccccgttaaggggtaaccgtaaacggtttcggtaaacttaccgtaaaccgaaaccggttagtcggttccggtacgtaacccgg

SEQ ID NO: 116470 - DNA, 734 bp, Homo sapiens
  misc_feature: GYAE6OF01ED3XL.45.37.D04.1.454.CMB.1.raw
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtcncagctggtgcagtcgnggggctgaggtgacggaagcccgtgggcctacgaggtagaacggtcctccgtgacgtaaggtcttcgtcggacctaaccgtccgttaccgaccggtcgaaccttactcctccgacgttcgggtcgacgaaccggacccggtcccgttaaggaccggtaacgggtcttacgggaggtcggtagttcggggtagtacggtacttaacccgaaacccgttaagtaagttcgggtacggacctaaactaaacgttcgtacggacaacggtaacggttaacggtttcggaacgggacgttaacgggtccctaaccgactaccgggaaccggtacgggacctaccggcctacgtacgaccgaccgacacgtcctaagctacgggtcctagacgaacgcgtagtacgtacgtaaccgactacggtaccgacccgaacgttcccggactttaaggtttaccgtaacgtgggtaacgtaccgggtaaggttttaaccggttcggtttacccgggttagtttaccgtttcggggtttccttaaccgggg

SEQ ID NO: 116471 - DNA, 789 bp, Homo sapiens
  misc_feature: GYAE6OF01BY27X.45.37.D04.1.454.CMB.1.raw
  modified_base (248)..(248): a, c, t, g, unknown or other
  misc_feature (248)..(248): n is a, c, g, or t
tcagacgcgatcgacacgaccggtgctcgatttagtagcatactgttggggtttgggggagcatcacccagcaaccacatctgtcctctagagaatcccctgagagctccgttcctcaccatggactggaccgtggaggatcctcttcttggtggcagcagccacaagacgcccaactcccaggtgcagctggtgcgagtcgtggggctggaggtggagacgccgtgggcctcgagtgaagtctccgngacgaagcttcgtcggctacctacctcgaccggctactactcctccacgtggtcgaccgacgaccgtcccgaggaacgtaggtcgttaggacggtggacgtgggatacgggtactaaccgtaaccgtaacgtaagtacgggtacgtaacctaaacgtaaactacgtacgtacgtaaagtaacggttaacggtttacggaacgggtacggtaacgggtaccgtaacccggtagtaccgggaaacccggtaaacgggtaacccgtaaccggttaaccaacggtaccaaaccggtaaccgtaaccgtaaccgtacccgtaaacggtacggtacgaacggtacgtacgggactaaccggtaacgtacgtaacgtaccgtaacgtaccggtacgggaaaccctaccggtaacccggttaacccttttaaacggttttaaccgttacgggttacggtaacggtaacgggtaacccgtttaggggttttaccccgggttttaaggggttacccggggttcggtttttaccccggggtttttaaccggg

SEQ ID NO: 116472 - DNA, 681 bp, Homo sapiens
  misc_feature: GYAE6OF01A3SSF.45.37.D04.1.454.CMB.1.raw
  modified_base (469)..(469): a, c, t, g, unknown or other
  misc_feature (469)..(469): n is a, c, g, or t
  modified_base (670)..(670): a, c, t, g, unknown or other
  misc_feature (670)..(670): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttcgctctggatctctggtgccgtacggggacatcgtgactcgaccagtctccagacctcccgtggctgtgtctcgtgggcgagcggccacatacactgacgaacgtccgagccaagagttagtttacggacacgtacctaaccaaagaaacttaaacgaaacttacgttagtaccgttacgtaacccgaagaaccaaacgaaaccgagggtccaacgtacctaaccgtacgtacgtacgtacgttacttacgttacgtcggactacgtaccggtaacccgggacgttccggtaccgacgacgtgtacacggtcggacgtcggtccggtgacggacgtacgtagttacnctaccgactacgactacgacgcacgcgtacgacgacggacgtaagacggtaagtcggtagtacgttatttcggtacgtcgtagtactacgtacgttaaatacgtttacttaacttccgtttaccgtacccgttacggttaccgtacccggtaaacgggtaacaaggttacgtaacgtacgtaacgtaacgttacgtcggtnaacccggtacg

SEQ ID NO: 116473 - DNA, 1115 bp, Homo sapiens
  misc_feature: GYAE6OF01A2EM8.45.37.D04.1.454.CMB.1.raw
tcagacgcgatcgacacgaccggtgctcgatttagtagcatactgttgggtttggggagagcatcacccagcaaccacatctgtcctctagagaactcccctgagagccttcccgttcctcaccagtcggacgtcggacctgggacggtactccttctttcgtttggtacggcagcgacgaccaacgaacggaccgccctaccgtcccgtaagggtcgaccgtacgtccggttggtacgacctacggttccggcggggtactagggtgggtaggtaacgggaacggtccggtcgggggtaccctacggtacggtacggtaacggttcccgttcgtaaggtaccggtaacggttccgttaccgttacggtaccctaaccgtacccgtttaccgaacccggactaccgttaccttacccgtacgaccggtttcgggacccggtaacgtaccggaacccggttaccccgaagggtaaccgggtacggttaccgtaaggtaccgggtaggtacggtaggtaacggtaataaccgtaaccgtaaaaccgttaacgacggttaaccggtcgtaaacgaaaccgtttaagttaccgaacgggttaaaccaaaacggtttaaaccggtttaacgggtacgggtaaaccggggttacggtaaccggttaaccgaacccgttaacggtaaaccgggttacccggaaacgggtaacccgttaaacccggtaccgtttaaccggaaccccggtaaacggtaaccccgtaaacgggtaaccccgttaacccggtttaaccggtacgggttaaacccggggtaaccggtaccgggttttaacgggaaccgggtttttaaaccccggaacggtttaacccggttaacccgggaaacgttaccccggttaaaacccgggttaaaccgggaaaccccgggtaaaacccggtttaaaccccggtttaaccgggtttttaaccgttttaaaccggttaaccggggttttaaccgggttacccggggttaaaacccggtttaccggggtttttttaaacccggggtttaaccgggggtttttaccccgggtttacccgggggtttttttaaccccggggttttttaacccccggg

SEQ ID NO: 116474 - DNA, 690 bp, Homo sapiens
  misc_feature: GYAE6OF01BEG99.45.37.D04.1.454.CMB.1.raw
  modified_base (680)..(680): a, c, t, g, unknown or other
  misc_feature (680)..(680): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatcgacccagtctccagacctccctggctgtcgtctcgtgggcgtaggacggaccaccatacctaactcgactaacgtaccacgaccgagtagttagtttagaccacgtacctaccaaacaaacgtaaagtaaccttacgttacggtaccgtttagggtaacccagtacaacggtaaaccgaggtacctacggtaccctacgtaacgcgtagtacctacgttaacgtttccgacgggtacctaacgtacccggttaacccgggtacgtacccggtacggtcccgtaccggtaccgtacgttcggaggtcgacggtacggtaccgggtgtaggactaggttacttccgtacttcctaccgtactacgtacgacgtcgtacgtcctaggcgtacggtcgtacggaagtcggttggtacgtaccgttagttcgtcgtcgttagtacggtactacttaagttattacgtacttaccgttccgtaccgttaccgtcgtaccgtagaacgtagtgacttacgactaacgngttgtggtac

SEQ ID NO: 116475 - DNA, 839 bp, Homo sapiens
  misc_feature: GYAE6OF01CED1E.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttctatttcctctgttgctctggactctcgtggtcgccggtacgggacatcgtgatacgaaccctagtcctccgacgtacctcccgtaggtccgtgtcgttccgtcggtacgggacggaggaccggacccacctactaccgaacgtcggaacctacgtccgaccgaccgtaagttacggtttagtttaacgactaccggtacctaaccgaaaacttaaacgtaaaacgtaaaccttaccggtttaacgtaccggtttacggaaccgtacggaaccgtaaaaccggtaaaccgtcggaacccctacccggtaccccgtaagtccgtagtaccttacgttacgttacggtacggacctaacccggtacccgggtaacccgggtaccggtcccgggtaccgtaacgtaccgtacgtacgacggtacggcggtacggtcggtacgacggtactacgttcgttaccaccgtcacctaacgtcgtaccacgtccgaccgttcgcggaacgtacggtgtaaacggtcggttagtcgggttcttacgtttaaggttccgtagtacggttacctacggtaacttaagttttaactttaccttaccgtttacttacccggttaccccggttccgttaaccccgggtacggtaacccggtaacgttaaaccgaaaggttccgttaaaaccctacggtaaaccggtaaccgtttacggcggtcccttaaagcccccttaacgg

SEQ ID NO: 116476 - DNA, 698 bp, Homo sapiens
  misc_feature: GYAE6OF01DLS4V.45.37.D04.1.454.CMB.1.raw
  modified_base (384)..(384): a, c, t, g, unknown or other
  misc_feature (384)..(384): n is a, c, g, or t
tcagacgcgatcgacacgaccggtgctcgatttagtagcatactgttgggtttgggggagctacaacaggcaggcaggggcagcaagatggtgtgcagacccaggtcttcatttctctgttgctctggatctcgtggtcgccgtacggggactatcgtgatcgaccagtctaccagacctccgtggctgttgtctcggtagggcgaggacggccacctataccgaactcggacaacgtccgaagtaccgaggttacgtttagtttaacgacctacggacctaaccaaataaaagtaacgaacttaacgttagtaccgttaggaacccacgaacgaacgtaaaccgaggtccactccgtacgtaacgctgacttagtaacttcgngactacgtaccggtacccgggtacgtccggggtcctcggaactcgtacgagcggccgaacggtcgggtaccgtaggacgtaagttcctttaccaccgttccgtaaccgacctacgtaccgacgccgtaacgtcgtacggacgacggtacgtaggtaacgtagtcggtcgtacgttagtttacgtcgtcgtaggtccagttattaacttagtttatacgttaccgttcctaccggttacccgtacggtcccgtaaggtaaacggtaagttacggtaattaaccgtacgaaaccttaggtacgtcgtacgtacccg

SEQ ID NO: 116477 - DNA, 672 bp, Homo sapiens
  misc_feature: GYAE6OF01DTMOA.45.37.D04.1.454.CMB.1.raw
  modified_base (432)..(432): a, c, t, g, unknown or other
  misc_feature (432)..(432): n is a, c, g, or t
  modified_base (566)..(566): a, c, t, g, unknown or other
  misc_feature (566)..(566): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggactcctcttcttggtggcagcagccacaagacgcccacctcccaggtcgcagccgtggtgcgtagtcgtgggctggaggtagaaggacgccgtcggggcctcgagtggaacggttcctaccgtgacgtaaggtcttcgtcgtaccgtacctaccttaccggaccgggctaacttactcctccgacggttgggcgccgtaacgcccggtcccgtaggaacgtaggtctaggagtggagtcggatacggtaactaccgtaaactaacgtaaggtcgggtacgaacaaactaacgttnacggacctaaacgtaaggttaacgttcggagggtacgacggtaccactacgtacggaacgaacggactaccgtactactcgaacgtaccacgtaccaccgtagaggacgtagccgtaggacagtaacgtactanacctgtaacgcgtaacggaccgtacgtcgttaaacttagtacggtgtacgggagttaacgggtcgtttaccggttaccgggttcgttcgggtttcgtttaaccggg

SEQ ID NO: 116478 - DNA, 731 bp, Homo sapiens
  misc_feature: GYAE6OF01DSKTA.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtcgccgtacgggacactcgtgacgtcgacccagtcctccacgtacctcccgtggctgtcgtcgtcgtgggcgaggacgggaccacctataccgaacgtgaccaacgtccgacgaccgaggtagttcgtttaacgactacgctaaccaactaaataacgaacttacttagccgttacgtaaccgagtacgaacgaaaccgcgtacacgtcctacgtaacgctacgtctacttacgttacgcggtactaccgtaccggtaacccgggtacgttccgggtaccctacggaccgtacgttccgaggtccgacgtacggtcggtcggtaggactacgttactttccgacttccactaccgactacgagtccgacgtccgtgacgacggtacgaagtaagtcgtaggttcacgtttagttaacgttgtaacctaggtactaacggtacttaacgtttagtttacttacttaccccgtttacggttacccgtttcccggttaaccgggtcccgttaaacgggtaaccggttaaagttacccggtttaaacaaacccggtttaaacgaaacggttacgtttccgggagttacccgttaaccg

SEQ ID NO: 116479 - DNA, 926 bp, Homo sapiens
  misc_feature: GYAE6OF01AQ28Z.45.37.D04.1.454.CMB.1.raw
  modified_base (77)..(77): a, c, t, g, unknown or other
  misc_feature (77)..(77): n is a, c, g, or t
tcagacgcgatcgacacgaccggtgctcgatttagtagcatactgttgggtttgggggagcatcacccagcaaccanatctgtcctctagagaactcccctgagacgcttccgttccctcacctatggacgtcggaccgtgggaggactccttcgtttcgttgggtcggctacggtcgacgaccgaacgtaaacggaccgtaccccctaccgttaccccgagggttacgtaccgtaaccgttcgggggttaccgtaccggtacgggttcgggttcggggggtccgttacggggtaaggggttacgggaacggggaaccgggttcccgggttacggggtccctaccggttaaggtacgggtaaccggttcccgtccggtacggtaaccgtacggttccttcggtaacggtacccgtaacctacccggttacccggacccggtaaccttacttacccgtcccttaaccggttcggtttacggggccggaacccgaacccgggtccggtaccccggttaaggggaccggtaaggttccggttaacgggagttcgggtacggttagggaactcgggtaaacctacccgtaaaaccgtaacggttaggtaccggtacaaacccgttaaagtacgttacgaacgttaccgaaacggttacggttaaacggtccggtaacgggtaccggtaacggtaccgtaccgaaaggtaccggaaccggtagggtaccccgtaacgtaccgtacggtaaccgaccgacttaacggtaccctacggtacggtaagtccgtggaacgtggtaaccgtacgaggtactagtacgtacgtacgacgttaccaggttacctacgttagttaccgtagtggtcggtacggttggtaacggtttcgggtacgtttggtttaacccggttttccggttaacgtacggg

SEQ ID NO: 116480 - DNA, 669 bp, Homo sapiens
  misc_feature: GYAE6OF01C11JM.45.37.D04.1.454.CMB.1.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggactcctcttcttggtggcagcagcccaacaagacgcccactcccaggtgcagctggtgcagtctgggctgagtgaggagccgtgggcctcgagtgaaggtctcctgcaaggcttcgnggctacaccttcgaccggcgactactctccgacgtgggtncgacacggccctggaacgaaggtctagagtggagtaggatggactaccgaacctaaanaagtggtaggactaaacgaaaactagtacacaaccaagtaagttaccgaagggtaccgtaagggtaccaaccgagtaaccgggaaccgaacggggaacctaaccgggtaccctaacgtacgaaacgtaccgaacctacgacccttaaacaggtacggtaacgtcgtaggaacgacgtaacgacgtacgtacaacgttccgaagtaaccgacctaaccgggaacctttaacgtttaacgttagttcgggtaaccgttacggtaaggttacgtttaaccgggtttacgggttacgttcccggttagggttttttacccg

SEQ ID NO: 116481 - DNA, 925 bp, Homo sapiens
  misc_feature: GYAE6OF01BG3D5.45.37.D04.1.454.CMB.1.raw
  modified_base (442)..(442): a, c, t, g, unknown or other
  misc_feature (442)..(442): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtagggactagtcgtgatcgacccagtcctccagacctccgtggtctgtgtctcgtcgggcgaggacgggtcccactatacaacgtcgacaacgtccacgccgtagtagttgtttacacgtacgtcctaacaaacgtaacttaaagtaccttaacgtacgtcgttaacggaaccctagaacgtaaccgaaaccgtacggtaccaccggtcccttaccgtaacgccgttacgaccttacttacgtttacgacggtacctaaccggttaccccggtaacccgggtacggtccccggggtaccncgtaccgtacgttacggaggtcggacggtacgggtccggtacggtacggggaacttacgttaccgtttacctaccgttcctaacccgtaaccgtacgttaccgaacggtacccggaaccgggttccgaacgggttaccggtaacgggttacgtaaacgggtaaacgtttacgggttccgggttaacggttaacgttttaaccgggttttagttaccggttacccggtttacggaaccggttaacggttaaaccgtttaaacgttttaaccgttttaaacggttttaaccccgtttaaccggttttaacccccggtttaccgggtttaaccccgggttttacccggggtaacccggggttaacccgggtaaaaccggtttaccggggttaaaacggtaacccgttttaaaaccggtaaacccgggttaaacccgggttttaaccggtttaccgggtcccggggttttaaaccccggtaaccggg

SEQ ID NO: 116482 - DNA, 816 bp, Homo sapiens
  misc_feature: GYAE6OF01EA4P2.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggactctctggtcgccgtacggggacagtcgtgatcgacccagtctccaacgacctccgtggctgtcgtctcgtcgggacgaggacgggaccaccatacaactcgacaacgtccacgccagtagttcgtttagacacgacctaccaaactaaataacgtaactacgttagtacttacggtaaccacgacgaaacgaaaccgtaggtccaacgtcccgtaacgtaacgtcgtacgtcctacttaacgtttacgacgggtactacggttacccgggtaacccgggtaaccggttcccggggtacctacggttaaccgtacgtttacggaggtcggtacgacggggtaccgggttcgggacgggtaacgttaacgttacgtttaccgacgttcctaccgacctactaccgacgtaccgtacggtcgtaccggacggtagggtacgtaacggtacgtacggttacgggtacggttaaccgtttaacggttttacgtacggtcctttaacgggaaccttaggtaactttaacgtttaatttacgtttaaaccttaccgttacccggttacccggttacccggtttacccgggtaacccggttaacggaaaccggttaacgggttaacgttaaccgttaaaccgttaaaccggttaaaaaccgtaggtttacgggtaaccgggtcctaacccggg

SEQ ID NO: 116483 - DNA, 606 bp, Homo sapiens
  misc_feature: GYAE6OF01BMJF6.45.37.D04.1.454.CMB.1.raw
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
  modified_base (415)..(415): a, c, t, g, unknown or other
  misc_feature (415)..(415): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccgaggtgcagctggtgcagtcgtgggctggaggtgaggagccgtgggcctgagtgagttcttcgtgacgagtcttcgtggacctacctacccttcgaccggctactactcctccgacgtgggtcnccgacgcggccccgtaggaacgacgggtcttggaggtggagtggagtcgactaccaacctaanacgtgtacgcaacaactancacacgagtagtacgaggcgacggtcaacgngtacgacgtacgacaacgtcagtacacgtaccacgaaccgtcctaacggtggtacggagccgtaagaccgtacgacgtacgacgtacgagtaccgacgaaccggtaccgaacgttaccttaactttagtacggttggacgaggtacggttcgtttacgggtttacggacggtttcggtttcggtttaccgg

SEQ ID NO: 116484 - DNA, 932 bp, Homo sapiens
  misc_feature: GYAE6OF01E1ZEF.45.37.D04.1.454.CMB.1.raw
  modified_base (132)..(132): a, c, t, g, unknown or other
  misc_feature (132)..(132): n is a, c, g, or t
tcagacgcgatcgacacgaccggtgctcgatttagtagcatactggttgggtttggggggagctacaacaggcaggcaggggcagcaagatggtgttgcagacccaggtcttcatttctctgttgctctggntctcgtggtgcctacggggacagtcgtgatgacccagtctccagacctcctggctgtgtctcgtggggcgaggacgggccaccatacaactcgacaacgtccacgccgagtacgttgtttagacagtacctaccaaacaaataaagaaccttacgttacgtacgttacggtaacccgtacgaccgaaacgtaaaaccgtacggtaccgacggtaccctaccgtaacggccgttacgtaccgttacgtaacgtttttaacccggtcgggtaaccgtaaccgttaccccgggttaacccggggtaacccggttaccccggggggttacccctaccgggtaaccgtaacgtttaccggtacgggttacgggaccggtacggggtaccggggttacgggtacggggtacttaaccggttacttttacccgtaaccttcctaacccgtaaccctacgtaccgtaaccggaccgtaccgttaacccggacgtaacggtacgttaacggtaaacgggtaaacgtacggtttacgggtacgggttacggtttacgggttttaacgtttaccggtaccgtttaacgggttacctaaacggtttaccttaaaagtttacgtttaaacgttttagtttaaccccgtttaccccggtttaacccggtttaaaccccgggttttcccgggtacccccggttaaaggggggtaacccgttaaaacggggtttaccgtaaagtttaaacccggtaaacccggaaaaccggtttaaacccggtttcgggttaaacccgggtccgtttaaaccccgg

SEQ ID NO: 116485 - DNA, 801 bp, Homo sapiens
  misc_feature: GYAE6OF01BWUWM.45.37.D04.1.454.CMB.1.raw
  modified_base (165)..(165): a, c, t, g, unknown or other
  misc_feature (165)..(165): n is a, c, g, or t
  modified_base (199)..(199): a, c, t, g, unknown or other
  misc_feature (199)..(199): n is a, c, g, or t
tcagacgcgatcgacacgaccggtgctcgatttagtagcatactgttgggtttgggcatcacccagcaaccacatctgtcctctagagaactcccctgagacgctccgttcctcaccatggactggacctgggaggattcctcttcgttgggtgcagcagccaanaagcgcccactcccgaggtcgacaggctgggtcncgtaggtcgtggggcttgggagggttaggaacgggaccgtccgggtacggggtcctacggaaggtacggtacggttcctccggagacggtcggttccgttcggacgtaccgttacctaccggtcggaacccggtctaacgttactccgtacggtcgggttggaccggtaaccgccgggtacccgtaccggtaagggtacgggtacgggtttcgtaagggtcgggtaggttaacgggtcgggtactaccggtaaaccgtaaccgtaaaccgtaacgggtaaggttccgggaaactaaccgaaaacgttccgtacgacggtaaacgtaacggtttaacgggttacggttaaccgggacgtacgggaaccgtaccgtaacggtacgtacccgggaacgggtccgtaaacccggtacctaacgtacgtaccggaccgtaaccgaccgtaaccgttacggaccggttaggagttacccgaggtaacgcgtaacgccgtagtacccgattaccgacggtacgccgttaaccgactttacgtagttaccggtgtacggtgtaccgggttagttcggttcggttagttcgttcgtttcggtcggttacgg

SEQ ID NO: 116486 - DNA, 792 bp, Homo sapiens
  misc_feature: GYAE6OF01CL2NB.45.37.D04.1.454.CMB.1.raw
  modified_base (59)..(59): a, c, t, g, unknown or other
  misc_feature (59)..(59): n is a, c, g, or t
  modified_base (109)..(109): a, c, t, g, unknown or other
  misc_feature (109)..(109): n is a, c, g, or t
tcagacgcgatcgacacgaccggtgctcgatttagtagcatactgttgggttggggganctacaacaggcaggcagggcagcaagatggtgttgcagacccaggtcttntattctctgtgctcgtggatctcgtggtcgccggtacgggactacgtcgtagactcgaccctacgtcctaccgacgtcctcccgtggtcgtgtcgtccgtggtcgggcgaggaccggtccacataccgaacgtgacctacgtccgacgccgtaggttacgttaggttaacgacaccgtacctaaccaaaagtaaaacgttaaaccgtaaaccttacttaaccggtaccgttaaccgaaccgtaacgaaccggtaaaccgtaacggtccggacctaaccgtcccttaaacgtacgtcgtacctaccttaggttaaccgtttagggacccggtactaccgggtacccgggtaacccgggtacggtccccggtacctacggtacgtacttaccggaggcgtccgggagggttacccgtagggtaacggtacttgttaacccttcccgtacctccgtaacccgtactacggcgacgacgttccgtacgacgtcgaacggtagtacggtaggccgttaggtccgttagtttacgtagttcgagttacgtaactaattacgttaagttaacctttcgttaaccttcccggtaaccgttcccggttaccgttaccccgggtaggttaaaacccgtagggccttaaactaaacgttacccgtaaactaacgtggtccgttacgacctacgg

SEQ ID NO: 116487 - DNA, 693 bp, Homo sapiens
  misc_feature: GYAE6OF01ERIR1.45.37.D04.1.454.CMB.1.raw
  modified_base (105)..(105): a, c, t, g, unknown or other
  misc_feature (105)..(105): n is a, c, g, or t
tcagacgcgatcgacacgaccggtgctcgatttagtagcatactgttgggtttgggggagcatcacccagcaaccacatctgtcctctagagaatcccctgaganctccgttcctcaccatggactggacctggaggatcctcttcttggtggacagcacgccaacaaagacgccccactcccgaggtcgcagctggtgcagtcgtggggctggaggtgaggacgcgtgggcctcgaggtgaagtctcgtgacgaggtcttctcggtacctaccaccttccgaccggacgtactactcctccgtaacggtcggggtcgaccggacgacccgggtcccccgtagggaaccggaagggtccgttagggaggtgggaggtagggtagttacggtacctaacctaaaccgtaacgaaggttcgggtaacgactaacaaactagtcgacaagtagtaacggttgaagggcgtacggtacgacagtaccgacggacggtacaccgtcactacgacacgaaccacgtacctagacgtagggactccggtagacgtagacggtactacgaacgtactacgtacaaccggtaaccgtacggttaacctttagtttacgtacggttacggtacggtacggttaacggttcggttttacgggttaacccggttcgggtttaccgttttccgggttttaaccggg

SEQ ID NO: 116488 - DNA, 762 bp, Homo sapiens
  misc_feature: GYAE6OF01EJWI3.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatcggactggacctgggaggatcctcttcgttggtggcagcacggaccaacaagacgccctactcccgaggtcgcaggtcgtggtagcgtaggtcggtcggggctggaggtaggaggacgtccggtcgggcctgacgtaggacgtctccgtcgacgacgtcttcgtcggtacctaaccgtacctccgaccggtacctacttacgtcccgtccacggttgggtcaccggtaccggaccggtcccgaggtaacggtacgggtcgtaggtacgggtcggtaggtacgggaacgtttcggaaccttaacccgtaaaacccgtaacgtagggtcggtaaccgaactaaacgtaaacttggtacacgtaaagacggttaacggtttaccggagggtacgtacggtaacccaacgtaacggtacgtaaccgggaggtacccgtacccgtcaacgtaccgacgaccgaccgtaaccgtccgtaaacgtggaccggtaacggcgtaacggacgacgtaacgtcttaacgaccgtacgtacccggaacggacgtaacccgaccggtttaacttacgtttaagtcggttacggtagtaccgggtagttaccggtttcggtacgggtttccgttaccgggtttccggttaacggg

SEQ ID NO: 116489 - DNA, 915 bp, Homo sapiens
  misc_feature: GYAE6OF01BO0NC.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagacgcccactcccgaggtgcagctggtcgcagtcgtggggctggaggtgagggacgccggtcggggtcctacgtaggtacggtaacggtccgtccgtgacgtaacggtccttccggtacggacctaccgtacccgttaccgaccggtacgtactacgtccgtccgtacgttcggggtacgaccgacggaccggtccccggtagggtaaccgaacgggtcgttagggtacggtacgggtaggtacgggtaacgttacggaaccttaacccgaaaaccccgttaaggtaacggttaggggtacccggtaactaaaaccgttaaaccgtacgtacggaacccgtaaaaccggttaacggtttaaaccgggtttaccgggaacggggttaccgtaaccgggggtaaccctaaccgggtaaccgtcccgggaaaccggtaaaccggggtaaccctaaacccggttacgaacccgttacccgggaaccgtaacccgtaaccggtaacctaacccggttaacgggtaacggttaccggggacttaccgggtaaaggaccggttaaaccggaaacgttcggttaaccgacggttaaccgtaccggaaccggaaacccggtaacccggtaccggtttaaaccgttaacgtttttaacgtacgggttcggtaaccggggtacggttaaccgggtttacggttttaacccggggtttacgggttcgggttttaccccgggttttggtttttaaccccgggg

SEQ ID NO: 116490 - DNA, 771 bp, Homo sapiens
  misc_feature: GYAE6OF01AED4V.45.37.D04.1.454.CMB.1.raw
tcagacgcgatcgacacgaccggtgctcgatttagtagcatactgttgggtttggggagagcatcacccagcaaccacatcgtgtcctctagagaatcccctgagagctccgttcctcaccatggactggaccgtggaggatcctcttcgttggtggcagcagccacaagagcccactcccgagtgcagctggtgcgtagtcgtgggtctagagggtagagggaacgccggttcggggcctacgaggtaggtaacggtcctaccgtgacgaacggtcgttcgtcggtactacctaccttccgaaccggtccgtactacgtcctcctacgtgggtacgcgacgccggcccgtaggaacgtaggtcgttacgaggtggtacgtcgggtacgtacggacctaacccgtaaccgtaaactaacgggtggtaccgtacaaccggtaaatgtacgacgaacgtaaggttaacgttacggaccgggtagtaaccgggtacaacccggtagtacggtaacccggaacgggtacctaacccggtataccggtacgaacgaccctaacggtacccgacaacgttacgggacggtcctaacggtacggagttaaccggaccgttaacgtacggaactttacgaccccggagaacccggtaaccgtaaacccgttccgtttaaggtttaaaccgttcggtaacgggttaggtaacccgggttaaaggggttcccggttttaaaccgggtttccgggtgggttttaacccgggtttttccccgg

SEQ ID NO: 116491 - DNA, 673 bp, Homo sapiens
  misc_feature: GYAE6OF01A7U9X.45.37.D04.1.454.CMB.1.raw
  modified_base (384)..(384): a, c, t, g, unknown or other
  misc_feature (384)..(384): n is a, c, g, or t
  modified_base (580)..(580): a, c, t, g, unknown or other
  misc_feature (580)..(580): n is a, c, g, or t
  modified_base (655)..(655): a, c, t, g, unknown or other
  misc_feature (655)..(655): n is a, c, g, or t
  modified_base (668)..(668): a, c, t, g, unknown or other
  misc_feature (668)..(668): n is a, c, g, or t
tcagacgcgatcgacacgaccggtgctcgatttagtagcatactgttgggtttgggggagctacaacaggcaggcaggggcagcaagatggtagttgcagacccaggtcttcatttctctgttgctactggatctacgtggtgccttaacggggcatcggtagacgtcgaccagtctaccgacgaccgtcccgtggcctggttcgtcgtcgtgggacggtaacggacgggcccaacgattccgaaacttcgagtaacgtccgacgaccgtagtacggttatttaccgactacggtcctaccgtaaacaacgtaaacgtaacctacgttagtaccgttacggtaaccaggaacctaacggaaacgtacgtcacgtccacgtaacncgtgactactagttaccgtagggacacgtacgtaccgggaacgtccgggtacctggaaccgttgactaggtacgccgtaggggtaccgtacggtcggggaactacgtacggtttacaccctacgtacccgactacgtcgacgtacaacgggttcacggaccgtagaccggtgaacgtgtaacgtgttaactagttntcggtactcgtatacgattaagtaattatacgtacacctcggtaactcgtacgtacggacagtacggattacganacgtatgtcggtntaccg

SEQ ID NO: 116492 - DNA, 749 bp, Homo sapiens
  misc_feature: GYAE6OF01A0DOR.45.37.D04.1.454.CMB.1.raw
  modified_base (607)..(607): a, c, t, g, unknown or other
  misc_feature (607)..(607): n is a, c, g, or t
  modified_base (718)..(718): a, c, t, g, unknown or other
  misc_feature (718)..(718): n is a, c, g, or t
tcagacgcgatcgacacgaccggtgctcgatttagtagcatactgttgggtttgggggagctacaacaggcaggcagggcagcaagatggtgttgcagacccaggtcttctatttctctgtgctctggatctcgtggtcgccgtacgggactagtcgtgactaccgaccctacgtcctccgagtacctcccgtggtcctgtcgtcttcggcgggacgacggacggaccacactaccaactcgactacgtccgagccgtagtacgttagttacgaactacgtacctaaccaaactaaagtaacgtaaccttacgtacgtacgttacggaaccacgacgaacgaaccgcgtaccgtacgtaccctacgtaacgtcgtcgtacttacgtacgttccgacgtactaaccgtaccgggtaacccggtaaccgggtccccgggttaacctacggtacccttaaggtcggtacggtaccggtaaccgacgggtcggtaacggtacggtaaccgtaacgttacccttaccgtacctaccgtacccgtaccaccgttacgacccgggtaccgccgtacgtcggaaacgtcgtcgtaaaggccgttaggtacggttntttaccgggttaattacggtctaggttacataactagtttattaccgttataccgtacgttaccgttccgtaaccggttccgaccggtaataaccgtaaggcccgttaaanacggtacaaccggttgtggccgtcgtaaccg

SEQ ID NO: 116493 - DNA, 774 bp, Homo sapiens
  misc_feature: GYAE6OF01AJM27.45.37.D04.1.454.CMB.1.raw
  modified_base (599)..(599): a, c, t, g, unknown or other
  misc_feature (599)..(599): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctcgtggtgccgtacggggacagtcgtgatcgacccagtcctccacgtacctcccgtcggtcgtgtgtcgtcgtgggacgaggacggcccacgactacaacgtcgacacgtaccgacgaccgagtagtttacgtttaacgacacgacctaaccaaactaaactaaacgtaaacgttacttacgtaccgtttacggtaaccagaaccgaacgaaaccgtacgtacgtaccgtaccctaccgtaacgtcttcgtacgttacttaacgttacgtacggtcgtaccgtacccggtaacccgggtaccggttccccgggtccgtaccggacgtacgttacggtacgtacggcggtacgggtccggtacgggtagtaccgtaagtttaccgtccgtacctaccgtaccgtaacctagaccgtacgacccgtacgtacggaccgtaccgggaacgttgaaacggtacgtgttacggngttttaacgttgttacttcgagttaccagtagttaacttaagttaactttactacgttaccccttccgtcggttaaccccgttacggggtcccggtaaacggttaaggaacgttcctaaaacgcggttaaaaccccgttagttgggttaccccgaggttcccgtaccgtaacccc

SEQ ID NO: 116494 - DNA, 722 bp, Homo sapiens
  misc_feature: GYAE6OF01BX7D5.45.37.D04.1.454.CMB.1.raw
  modified_base (404)..(404): a, c, t, g, unknown or other
  misc_feature (404)..(404): n is a, c, g, or t
  modified_base (507)..(507): a, c, t, g, unknown or other
  misc_feature (507)..(507): n is a, c, g, or t
  modified_base (530)..(530): a, c, t, g, unknown or other
  misc_feature (530)..(530): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttcgctctggtatctcgtggtcgaccgtacgggacatcggtgatcgacctgtcctcacgtcctccgtggcgtgtcgtcgtcggtgggtcgaggacggaccacctataccaactgtaccgaacgtccgacgccgtaggtacgtttaggtttaacgactacgtacctaaccaaaacgtaaactaaacgtaaaccttacgttacgttaccgttacggaacctacgaaccgaaacggaaaccgtcgtaccaccgtccctaccgtagtcgtcgtccttactacgttcgngtacctacgttaccggacccgggtaccgtccgggtccacgtaccgtagtcgtcggtcgcggtggtcggtacggtacgactacgttacttcctactaccgaccnctactcgacgacgtccgcggtanacgggctaacggagtagtcggtcggttacgtgttaactttgaccgttagtacgtaacgtacgttattaaagtttcttaacttcgtttaccgttccccgttaccggtttccggttacccggtaccggtaaggtaaccggtaagttccgtaactaacggtaaccgttaacgtacgggttctacgggtccctacc

SEQ ID NO: 116495 - DNA, 810 bp, Homo sapiens
  misc_feature: GYAE6OF01DQKFC.45.37.D04.1.454.CMB.1.raw
tcagacgcgatcgacacgaccggtgctcgatttagtagcatactgttgggtttggggagagcatcacccagcaaccacatctgtcctctagagaactcccctgagagctccgttcctcaccatggactggacctggagatcctcttcgttggtcggcagcagaccaacaagacgcccactcccgaggtcgcagcgtggtgctaggtcggtcggggcgtggaggtacggaggaacgccggtcggggcctacgaggtacggtaacggtcctccgtgacgtaacggtccttacgtacggtacctaacccgtacccgttaccgaaccggacgtaactaacgttcctaccgtacggtcggggtcgaccggaaccggaccggtaccccggtaagggaaccggtaacggggttacgttagggtaagggttacgggtaacggtaacggggtacgtacgggaaacctaacccgtaaaacccgttaaacgtaagggttaccgggtacggtaaacctaaaacgtaaacgtaaccgtacgaaccgtaaaccgtaaacggttaacgggttacggacggggtaacggaaccggttaccgaaacgtacgtaaccggaaaccggtcgggaaacctacccgtactacgaccgtacgacgtacctaccgtactaacgaggtacgaacgcgtaagacgtacgacgtagtacgactacgtaccgaacggaaccgacgtaaccgttaacgttaagtttcgttacgtacggtacggaaacggttacggttaaccggttttaccgggtaacgggttcgttcgggttttaaccg

SEQ ID NO: 116496 - DNA, 933 bp, Homo sapiens
  misc_feature: GYAE6OF01CZSTM.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttctatttctcttgtgctcgtggatctcgtggtgtcccggtacggggacagtcgtgacgtcgacccgtacgtcctaccgacgacctccctggtcgtgttcgtccgtcggtcgggacggacggacgggacccaacctataccgtaaacgtcgacgtaaaccgtccgaacgaccgtaggttaggtttacgtttaagaccgtacgtacctaaccaaaacgtaaagtaaacgtaaacttacgttaacgttaccgttaacggtaaccgaacgaaccgaaacggtaaaccgagggttaccaccgtacccgttacgtaacgtccgtaccgtacttacgttacgttaaccggtcggtaactaccgttaacccgggtaacccggtaccgggttccccggttacccgtacgaaccgttacgtacggtacggtcggtacggtacgggtccgggtacggtaacggacgtacgttacttacctacgttaacctacccgtaactaacgttccgaacgtaccgtacgtcccgtaaacggacccggaggggtaaccgtagggtaacggtacggtttaacgggttacgggtaaccgtttttagggttttaaccggcgggttttacctaaaggtttaacggtaaacccgttaattttaaacgtttttaaactttaccgtttaaacggtttcccccgttttaaaccgttccccccggtttaaccgggttttaaccccgggaccccggtttaaaccgggtaaacgggttaaacgttaccggttaaaacgaaacccgtttaaaaccggaacccggtttaaagtccggggtaccgtcggtaaacccg

SEQ ID NO: 116497 - DNA, 735 bp, Homo sapiens
  misc_feature: GYAE6OF01BIC8S.45.37.D04.1.454.CMB.1.raw
  modified_base (129)..(129): a, c, t, g, unknown or other
  misc_feature (129)..(129): n is a, c, g, or t
  modified_base (193)..(193): a, c, t, g, unknown or other
  misc_feature (193)..(193): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggntctcgtggtgccgtacgggactagtcgtgagtcgacctagtcctccgagcctccgtgtctagtntcgtcgtggacgaggcgggtccaccagtcaacgttcgaacacgtccacgcctaggtacgttggtttacacgacgtacctaacgaaagtaacgttaaacgtaccttaacgttacgtaccgttacggtaacccgagtacaaaccggtaaaccgtggtacctaccgcctaacgtaacgtcgtagtactcgttaagttacgcgaacctggtacccgtaccgggtacggtcccggtactaccggaacgttccgtggtaaccggcgggtacgtacggtcggtacggaggtactacttaccgtacctaccgttaccgtcgtacctacgtaccgaacgtcccgtacggttccgacgaccgtcgggtaacgtaaggacgtagtacggtacttaggttacgttagtacgtccgttagtacgtattaccgttaatttagtttaacttcctaacgtttacccgtaccggtttacccgtacccggtacggttaggtaaccgttacggtaataccgttaaacgtaacgttaaccgaaggtttcggaccgtctacgg

SEQ ID NO: 116498 - DNA, 722 bp, Homo sapiens
  misc_feature: GYAE6OF01EMITL.45.37.D04.1.454.CMB.1.raw
  modified_base (369)..(369): a, c, t, g, unknown or other
  misc_feature (369)..(369): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtcgccgtacggggacatcgtgactcggacccagtcctccagacctccctggcttgtcgtctcgtcgggcgaggacggcccaccactacaactcgaccaacgtccacgaccgagtagttagttttacgacacgtacctaccgaaactaaagtaaacgtaaccttaacttacgtacgttacggtaaccagacaacgaaaccgaggtccacgtacccttaccgtaacgccgtacnccttacgttaacgtttacggcgggtacctaacgttacccgggtaaccccgggtaccggttcccggggttaccctacggtaacccggtagttccggaacgggttcgggtaccggtacgggtaccggggttacggtacggggaacgtacggttactttaccgtaaccttaccgtaacctaacccgtaacgtcaccgtaccgacgtacccgtggaccgtacgtacgtacgaagtacggtcgtacgtagttacttagcgtgtacgtactagtactagttattactattcgtccttacgtccgttaccggccgttagaaccgtaagtcgaaattactaaacgacgtagtgtcgcgtcg

SEQ ID NO: 116499 - DNA, 800 bp, Homo sapiens
  misc_feature: GYAE6OF01EWOSB.45.37.D04.1.454.CMB.1.raw
  modified_base (105)..(105): a, c, t, g, unknown or other
  misc_feature (105)..(105): n is a, c, g, or t
  modified_base (642)..(642): a, c, t, g, unknown or other
  misc_feature (642)..(642): n is a, c, g, or t
tcagacgcgatcgacacgaccggtgctcgatttagtagcatactgttgggtttggggagagcatcacccagcaaccacatctgtcctctagagaactccctgagngcttcccgttcctccaccagtggactggaccgtagggaggacttcccttctttcgttgggtcggcacgcagcccaagaacgacgcccacgtcccgaggtgacgagtcgtggtcgcgacggttcggtggggtcgtagggtagggtaggaacgggaacgtccggtcggggtaccctagtacggtaggaacggttccgtccgtgaccgtaggtccgttcgtcgtcctaccgtaccgtccgaccgggtctacttacgtcctccgtacggtcgggtccgaccgaccggtaccggtcccggtacgggtaaacgggtacgggttcgtacggtacgggttaggtacgggtagggaacgttagtaacctaaaccgtaaacccgtaagtacggtacgggttaccggaaacctaacggtaaacttaggtacgaaacccgtaaggtaacgttaacggttacgggaccggtacggtacgggttacccacgtacgaacccgggtaacggaaacggttaccaccgtaccagtacaaccgacaaccggtaccncgtaaacggtcgacgggaacttacggaccggaacgtctaacggtactacggacttacggtccgaacgaacgtaccgtaacggtttacttggttaaccttagggtccggtagtaccgttacggggtacgttttggttaccggtgtttccggttttacgg

SEQ ID NO: 116500 - DNA, 703 bp, Homo sapiens
  misc_feature: GYAE6OF01C34PW.45.37.D04.1.454.CMB.1.raw
  modified_base (165)..(165): a, c, t, g, unknown or other
  misc_feature (165)..(165): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (559)..(559): a, c, t, g, unknown or other
  misc_feature (559)..(559): n is a, c, g, or t
  modified_base (568)..(568): a, c, t, g, unknown or other
  misc_feature (568)..(568): n is a, c, g, or t
  modified_base (599)..(599): a, c, t, g, unknown or other
  misc_feature (599)..(599): n is a, c, g, or t
tcagacgcgatcgacacgaccggtgctcgatttagtagcatactgttgggtttggggagagcatcacccagcaaccacatctgtcctctagagaactcccctgagagctccgttctcaccatggactggacctgggagatcctcttcgtggtggcagcagccaanagacgtcccactcccgaggtcgcagcgtggtcncgaggtcgngggcgtggaggtcgaggacgcggacgggtccagaggtacggtacgtcctccgtagtaccgaaggtcgttcgtcgtcctaacctaccgttccgaccggtctaacttactaccgtaccgtacggttaggggtaccgacgtaaccggtacccggtcccgttagggaaccgtaaacgggttcgtaaggtcgggtaggaggtacggtacgtaggtacaaacccgtaacctaagtacggtcggtacgaactaacgaacttagacaccgaatacggtacggtcggaggtacgtagacctactagaccgacggactacgtaccgaactcgacgagtaccgactaccgaacgtacaccggngtaacgtanacgggaataccgtaacgacaactaccggtanaccggagtaaccgaccgtacggttaaccttaaggtttcctaggttcggtaacgacggttaacggttacggtttacggtttccgggtaggttccgtttttccggg

SEQ ID NO: 116501 - DNA, 714 bp, Homo sapiens
  misc_feature: GYAE6OF01CVBAG.45.37.D04.1.454.CMB.1.raw
  modified_base (375)..(375): a, c, t, g, unknown or other
  misc_feature (375)..(375): n is a, c, g, or t
  modified_base (412)..(412): a, c, t, g, unknown or other
  misc_feature (412)..(412): n is a, c, g, or t
  modified_base (640)..(640): a, c, t, g, unknown or other
  misc_feature (640)..(640): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgacaactggtgcagtcgtggggctggaggtaggaggaacgccggtcggggcctcgaggtggaacggttcctccgtggacgtaaggtcttctcgggacctaccgtaccgttaccgacccggacgtacctactcctaccgtacggtcggggtcgtaccgaccgaccggccccgtaggaacggtaacggtcttaggnggtacggagtgggatacggactaccgaaacccgtaanaacggttcgggacgacaaacgtaaatcgtacgacaacgtaaggtaacggtttcgaaggggtaccgaggtaccacgtagtacgaaccggtacgggactaccgtaacagaccgacgaaccaccgtacgtacctaaggacggtgggaactacggaacgtacgacgtaaccgtacgttacgaactacggtcgtaccggtaaacgacccggtaacgtaccttaagtttaaacncgggttaaggacggtaggtacggtaccgtttacggggttacgtcgggtttactttcgggttttcccggttacgg

SEQ ID NO: 116502 - DNA, 590 bp, Homo sapiens
  misc_feature: GYAE6OF01BI0HP.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactccccaggtgcagctggtgcagtcgtggggctggaggtgaggaagccgtggggcctcgagtggaaggtctccgtgacgtaaggcttcgtggcctacaccttcaccggcgactactcctccacgtgggtcgcgacgacggccccgtggacgagggtcttggaggtggacgtgggatcggactaccaaccgtaagagtggtacgcaacaactatcgacacgagtagttcgagggacgaggtaccacgtagtacggaccgagggacacgtacctactcgacgcaccgacgacctacgacgtaggacgtacgtacgacgacgagtacacgtacagtcgacggacaccgacgtacttaatttacgttacgtgtaccgtacggtacggtacgttacgggtttccggtggttcgtttaccgg

SEQ ID NO: 116503 - DNA, 870 bp, Homo sapiens
  misc_feature: GYAE6OF01B7FWB.45.37.D04.1.454.CMB.1.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
tcagacgcgatcgacacgaccggtgctcgatttagtagcatactgttgggtttggggagcatcacccagcaaccacatctgtcctctagagaactcccctgagagctccgttccctacaccatggactggacctgggaggactcctcttcgttggtggcagcagccaacaacgacgcccactcccgaggtcgcagcgtggtcncacggtcgtggggctggaggtggaacggacgtcccggtaggggccctgaggtgaacggtcctccngacgagtcttacgtcggtacctaccgtaccgttccgacccggtacgacttacctccgtacccgtacggtcggggtacgtacccggaacggtacccgggtacccccggtaaggggaaccggtaacggggtttaccgttagggtaagggttaggggtacggtaccgggggtaagttacgggtaacctaacccgtaaacccgttaaaccggtaagggtttacgggaaccggtaacctaaaccgtaaacccgttagtacccgaacccgtaaacggttaacgggtttaaccggtttaccgggacggggtaaccggttaccggggttaacccaacccggttacggtaacggaaccccggggtaacggtaaccccttaccgggtaccaaccgttccgaacgtaaacccgacggtaacccgtaacccgttaggaacgggttccggttaagacccggtaggggtaaccacgggtaacgttaccgaacttaacggtccgtaacggaaccgggtacccgaacggttaacccggtactttacgtttaacgttcggtggtacgtaaccggtggttaaccgttccgggttacggtacgtttgtttcgggtttaccg

SEQ ID NO: 116504 - DNA, 129 bp, Homo sapiens
  misc_feature: GYAE6OF02FVNQG.45.37.D04.1.454.CMB.1.raw
  modified_base (128)..(129): a, c, t, g, unknown or other
  misc_feature (128)..(129): n is a, c, g, or t
tcagacgcgatcgacacgaccggtgctcgatttagtagcatactgttgggttggcacagcggccctgggctgcctggtcaaggactacttcctcgatcgcgtctgagcgggctggcaaggcgcatagnn

SEQ ID NO: 116505 - DNA, 491 bp, Homo sapiens
  misc_feature: GYAE6OF02GAIB1.45.37.D04.1.454.CMB.1.raw
  modified_base (487)..(487): a, c, t, g, unknown or other
  misc_feature (487)..(487): n is a, c, g, or t
tcagacgcgatcgacacgaccggtgctcgatttagtagcatactgttgggtttggggagctacaacaggcaggcaggggcagcaagatggtgttgcagacccaggtcttcatttctctgttgctctggatctctggtgcctacgggacatcgtgatgacccagtctccagactccctggctgtgtctctggcgagagggccaccatcaactgcaagtccagccagagtgttttagacagctccaacaataagaactacttagcttggtaccagcagaaaccaggtcagcctctaagctgctcatttactggcatctacccgggaatccggggtccctgaccgattcagtggcagcgggtctgggacagatttcactctcaccatcagcagcctgcaggctgaagatgtggcagtttattgctgtcagcaatattattatattcctcgtactttcggcctggaccaaagtgatatcaaacgactgtgntacg

SEQ ID NO: 116506 - DNA, 495 bp, Homo sapiens
  misc_feature: GYAE6OF02IYS3C.45.37.D04.1.454.CMB.1.raw
  modified_base (477)..(477): a, c, t, g, unknown or other
  misc_feature (477)..(477): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctccagcaaggcttctggctacaccttcaccggcgactatctccactgggtgcgacaggcccctggacaagggcttgagtggatgggatggatcaaccctaacaatggtggcacaaactatgcacagaagtttcagggcaggggtcaccatgaccagggacacgtcatcagcacagcctacatggagctgagcagactgacatctgacgacacggccatttatactgtgcgaggatgtttaccggnggcttggttcttttacgg

SEQ ID NO: 116507 - DNA, 541 bp, Homo sapiens
  misc_feature: GYAE6OF02F39VM.45.37.D04.1.454.CMB.1.raw
tcagacgcgatcgacacgaccggtgctcgatttagtagcatactgttgggtttgggggagctacaacaggcaggcaggggcagcaagatggtgttgtagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtccctgaccgattcagtggcagcgggtctgggacagtatttcactctcaccatcagcagcctgcaggctgaagatgtggctagtttatgctgtcagctaattattaattattacttcctaccgtaccttttccggaccccgttgggaaccctaaaggtcggtaattaacgtaccgaaacgtaaccttaggtcggtcctgtaccc

SEQ ID NO: 116508 - DNA, 648 bp, Homo sapiens
  misc_feature: GYAE6OF02JQKZP.45.37.D04.1.454.CMB.1.raw
  modified_base (313)..(313): a, c, t, g, unknown or other
  misc_feature (313)..(313): n is a, c, g, or t
tcagacgcgatcgacacgaccggtgctcgatttagtagcatactgtgggtttgggggaggctacaacaggcaggcaggggcgagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgttttagacagctccaacaataagaactacttagcttggtaccagcagaagccagggcagcctcctagccctgctctttacngggcctctacccggggatccggggtcctgaccgattcaggtcggcagcgggtctggggccagactttcgactcctcacccgatcgtacgcaacgtccctaggttacgacccgttggaaacgtactttcggtaccgtaccgtaggttttaacctaccgttgttaccaggtacctaaagttacttttagtagtaacgtactttacccgtaccgttaccgtaccgtttttccgggaccggggtaaccggggttaaaccctaacgggggttttacgacccggttacgttaaccgaaaacccggtaacgttacgggttacgggtaccgttacgaaccccg

SEQ ID NO: 116509 - DNA, 516 bp, Homo sapiens
  misc_feature: GYAE6OF02IOC2I.45.37.D04.1.454.CMB.1.raw
  modified_base (408)..(408): a, c, t, g, unknown or other
  misc_feature (408)..(408): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtgccagcagaaaccagggcagcctcctagcctgctcttttactgggcctctacccgggagtccggggtcctgaccgattcagtggcagcgggtctggggcagatttcactctcaccatcagcagcctgcagcctgaagntgtcgctagtttactactgtcagtcaattattatgagtattcctactctacgtttcggcggtacggacctaagggttgacgattacgaaacgtactggtacggctcgg

SEQ ID NO: 116510 - DNA, 502 bp, Homo sapiens
  misc_feature: GYAE6OF02GEN1Y.45.37.D04.1.454.CMB.1.raw
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttactgggcatctacccgggaatccggggtccctgaccgattcagtggcagcgggtctgggacagatttcactctcaccatcagcagcctgcaggctgaagatggtggctagtttattgcttgtcagctaaattattattatacttcctccgtactttcggccctggaccaagtgatancaaacgactgtgntcg

SEQ ID NO: 116511 - DNA, 509 bp, Homo sapiens
  misc_feature: GYAE6OF02HRM5P.45.37.D04.1.454.CMB.1.raw
  modified_base (314)..(314): a, c, t, g, unknown or other
  misc_feature (314)..(314): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataaagaactacttagcttggtaccagcagaaaccaggtcagcctcctaagctgctcatttacnggcatctaccggaatccggggtccctgaccgattcagtggcagcgggtctgggacagatttcactctcaccatcagcagcctgcagctagaagatgtgctagtttatgctgtcagtcaattattattatattcctcgtactttcggcccttgggaacctaaggtcggatactacaaacgtaactgtcggtctacg

SEQ ID NO: 116512 - DNA, 510 bp, Homo sapiens
  misc_feature: GYAE6OF02IUX53.45.37.D04.1.454.CMB.1.raw
  modified_base (507)..(507): a, c, t, g, unknown or other
  misc_feature (507)..(507): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactactagcttggtaccagcagaaaccaggtcagcctcctaagctgctcatttactgggcatctacccggaatccggggtccctgaccgattcagtggcagcgggtctgggacagatttcactctcaccatcagcagcctgcaggctgaagatgtggctaggtttattgctgtcagcaatattattaatacttcctccgtactttccggccctagggacctaaagtggtatactacaaacgtactgtacggntcg

SEQ ID NO: 116513 - DNA, 499 bp, Homo sapiens
  misc_feature: GYAE6OF02G42UI.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctcaacaataagaactactagcttggtaccagcagaaaccaggtcagcctactaagctgctcatttactggcatctacccgggaatccgggtcctgaccgattcagtgcagcgggtctggacagatttcgactctcaccatcagcagctgcaggctagaacgatgtgctagtttatgctgcagcaattattatatacttcctcgtactttcggcctaggacctaaaggtcgtagtactacgaaacgtatggtgctacg

SEQ ID NO: 116514 - DNA, 657 bp, Homo sapiens
  misc_feature: GYAE6OF02HEQB8.45.37.D04.1.454.CMB.1.raw
  modified_base (316)..(316): a, c, t, g, unknown or other
  misc_feature (316)..(316): n is a, c, g, or t
  modified_base (483)..(483): a, c, t, g, unknown or other
  misc_feature (483)..(483): n is a, c, g, or t
tcagacgcgatcgacacgaccggtgctcgatttagtagcatactgttgggtttgggggtaggcgtacaacaggcaggcaggggcgagcaagatggtgttgcagacccaggtcttcatttctctgttgctctggatctctggtgcctacggggacatcgtgatgacccagtctccagactccctggctgtgtctctggcgagagggccaccgatcaactgcaagtccagccagagtgtttagacagctccaacataagaactacttagctggtaccagcagaaaccaggtcagcctacctaagctgctcatttacgnggcatcctaaccgggaactccggggtccctggacctattcaggttggactggcgggtctgggggaacacgggtattttccgaccttacgtccctaacctaacgtacctaaacggccgaaacgcccgttacggcgaacggtccgttacggaaacggtaatttccgggnggtaccgtaaggtttttaagttcggtacgttcggtacctagtaaccgtaattaactttaattaattaacgttcccttaccggtaccttttcccgggccctaccggggtaaccgtaaaacggttgtaacgtaacttaaccgaaaaccggtaaccgttgtaccgggtcgttaccgg

SEQ ID NO: 116515 - DNA, 218 bp, Homo sapiens
  misc_feature: GYAE6OF02G6Y9U.45.37.D04.1.454.CMB.1.raw
  modified_base (176)..(218): a, c, t, g, unknown or other
  misc_feature (176)..(218): n is a, c, g, or t
tcagacgcgatcgacacgaccggtgctcgatttagtagcatactgttaggggtttgggggaagaggaagactgacggtcccccaggagttcaggtgctgggcacagcggccctgggctgcctggtcaaggactacttcctcgatcgacgtctgagcgggctggcaaggcgcatagnnnnnnnnnnnnnnnnnnnnnnnnnnnnnnnnnnnnnnnnnnn

SEQ ID NO: 116516 - DNA, 681 bp, Homo sapiens
  misc_feature: GYAE6OF02IJSW4.45.37.D04.1.454.CMB.1.raw
tcagacgcgatcgacacgaccggtgctcgatttagtagcatactgtgggtttgggggagctacaacaggcaggcaggggcagcaagatggtgttgcagacccaggtcttcatttctctgttgctctggatctcgtggtcgccgtacgggacatcgtgatcgacccagtcctccagacctccctggctgtgtctcgtgggcgaggacgggcccaccatacaactcgacaacgtccacgaccagtagttgtttaacgacagcctaccaaacaaataaacgaacttaacttagcgttacggtaacccagacaacgaaacccgaggtacacgaccctactaacgctgcctactatttaacgtgggactactccgtaacccgggtaacgtcccggggtaccctaggaccgtacttccgaggtcggacacggcgggtcgtacgggacaggtactttaccgacttccgtaccaccatcacgcacgtcctacgcgacggctaggaagtgttggcgtcgtaaggtttttatcggtaccgtttgtacgtaggaaccttaaagtttactttaaacgttttaacttaaccgttttcccctacccggtttaaccgttttcccgggcccggtttaaccggggaaaccctaaaggtcggtaattactaaccgaaacgtaccgtggtacgcgtaccg

SEQ ID NO: 116517 - DNA, 510 bp, Homo sapiens
  misc_feature: GYAE6OF02GHLSG.45.37.D04.1.454.CMB.1.raw
tcagacgcgatcgacacgaccggtgctcgatttagtagcatactgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaaacctggccaggctcccaggctcatcatctatgacgcatcgaacgagggccacgtggcatcccagccaggttcagtggcaggtggtctgggacagtacttcactctcaccatcagcagcctgacctgagtatttgctattactactgtcagcagcgtcggcgacgagcgctcacgttcggcggaggaccgaggtgagagtacgaacgacgtgtggctgcacatcgtgtcttcgatcttccgctacg

SEQ ID NO: 116518 - DNA, 501 bp, Homo sapiens
  misc_feature: GYAE6OF02I956E.45.37.D04.1.454.CMB.1.raw
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtccctgaccgattcagtggcagcgggtctgggacagatttcactctcaccatcagcagcctgcaggctgaagntgngcagtttatgctgtcagcaatatattatattccctcgtactttcggccctggacctaaagtgatactacaaacgtaactgtaggctcg

SEQ ID NO: 116519 - DNA, 500 bp, Homo sapiens
  misc_feature: GYAE6OF02FXX8O.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactggcatctacccgggaatccggggtccctgaccgattcagtggcagcgggtctgggacagatttcactctcaccatcagcagcctgcaggctgaagatgtgctagtttatgctgtcagctaatattattatattcctcgtactttcggccctgggacctaaagtgatatacaaacgtactgtagctcg

SEQ ID NO: 116520 - DNA, 514 bp, Homo sapiens
  misc_feature: GYAE6OF02IAUI9.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtcctgaccgattcagtgcaggcgggtctgggacagatttcactctcaccatcagcagcctgcaggctgaagatgtggctagtttatgcttgtcagcaattattattatattcctcgtactttccggcccttgggaaccctaaggtcgaattactacgaaacgtacgtggtcgctacg

SEQ ID NO: 116521 - DNA, 506 bp, Homo sapiens
  misc_feature: GYAE6OF02JWV19.45.37.D04.1.454.CMB.1.raw
  modified_base (432)..(432): a, c, t, g, unknown or other
  misc_feature (432)..(432): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtgccagcagaaaccaggtcagcctcctaagctgctcatttactgggcatctaccgggaatcccggggtccctgaccgattcagtcggcagcgggtctgggacaggtatttcactctcaccatcagtagcctgcaggctgaagatgtggctagtttatgctgtnagctaatattattactattcctcgtactttcggccttagggactaagtcggatactacaacgatagtgtntacg

SEQ ID NO: 116522 - DNA, 672 bp, Homo sapiens
  misc_feature: GYAE6OF02H0RRJ.45.37.D04.1.454.CMB.1.raw
  modified_base (311)..(311): a, c, t, g, unknown or other
  misc_feature (311)..(311): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaatgcaagtccagccagagtgtttagacagctccaacaataagaactacttagcttggtaccagcagaaaccaggtcagcctcctaagctgctcatttacngggcactccgtaacccgggaatccggggtccctgaccgattccaggtcggcgaggtcggggtctggggacagtacttttcgacttccgtcacccgtaattccgaacgtccaacggtccctacgaccgtacgggacctaggaaagtacgtcgggtacggacctaaggtttttagtcggtccttaggttaccaacggtactaaagtttaatttaaatttaacgtttacctttacccgttacccggttaacccgtttttcccggggtacccgttaccgggggtaaccctaaaagggttcggtaaacgtttaactaacccggtaaaaaccgttaaccggttaggttacggggtacttaacccggg

SEQ ID NO: 116523 - DNA, 529 bp, Homo sapiens
  misc_feature: GYAE6OF02I2TB8.45.37.D04.1.454.CMB.1.raw
  modified_base (312)..(312): a, c, t, g, unknown or other
  misc_feature (312)..(312): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctaccaacaataagaactacttagcttggtaccagcagaaaccaggtcagcctctaagctgctcatttacgnggcatctacccgggatccggggtcctgaccgattcagtggcaggcgggtctgggacagtactttcactctcaccatcagcagcctgcagctagagatgtgctagtttatgctgtcagtactaattattattatacttacctcgtaccgtttccggcccgttacggtaaccgtaagtcggtaattacgtaccgtaaacgtacgtacggtcggtctacg

SEQ ID NO: 116524 - DNA, 531 bp, Homo sapiens
  misc_feature: GYAE6OF02HIZO0.45.37.D04.1.454.CMB.1.raw
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtccctgaccgattcagtggcgagtcgggtctgggacagtatttcactctcaccatcagcagcctgcaggctgaagntggtgctagtttntgtctgtcagtataattattattattacttccctccgtacgttttcccggcccttacgggaacctaaggtgtaactacgtacaaacgtacgtggtacggctacgg

SEQ ID NO: 116525 - DNA, 497 bp, Homo sapiens
  misc_feature: GYAE6OF02IFZGA.45.37.D04.1.454.CMB.1.raw
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (409)..(409): a, c, t, g, unknown or other
  misc_feature (409)..(409): n is a, c, g, or t
  modified_base (494)..(494): a, c, t, g, unknown or other
  misc_feature (494)..(494): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaaacaataagaactacttagcttggtaccagcagaaaccaggtcagcctcctaagctgctcatttacnggcatctaccgggaatccggggtcctgaccgnttcngtggcaggcgggtctgggacngatttcactctcaccatcagcacgcctgcaggctgaagntgtggctagtttatgctgcagctaatattattatattcctcgtacttcggcctaggacctaaagtgatacacaaacgactgtcgntcg

SEQ ID NO: 116526 - DNA, 533 bp, Homo sapiens
  misc_feature: GYAE6OF02JCHKN.45.37.D04.1.454.CMB.1.raw
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggcctcagtgaaggtctcctgcaaggcttctggctacaccttcgaccggcgactatctccacgtggtgcgacacggcccctggacaagggcttgagtggatgggatggatcaacctaacaagtggtgcaacaaactatgcaacgagtaagtttcgagggcaggggtccaaccagtacgaccgagggaccacgtccatcagcacngcctacagtgganctagagcgagactgacagtcngacacacgctagtttacttactggtcgacgtaggtcgttacggtttacccggtggtccgtttacggtttccttttacgg

SEQ ID NO: 116527 - DNA, 527 bp, Homo sapiens
  misc_feature: GYAE6OF02HRR8R.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctcctagcctgctcttttactgggcctctacccggggagtcccggggtccctgaccgattcagtggcagcgggtctggggcagtatttcactctcaccatcagcagcctgcaggctgagatgtgctagtttatgctgtcagcaatattattatatttcctacgtacctttcggccctagggacctaaaggtcggaattagtactaaacgactggtcggactcggactacctattcg

SEQ ID NO: 116528 - DNA, 493 bp, Homo sapiens
  misc_feature: GYAE6OF02GBH4Q.45.37.D04.1.454.CMB.1.raw
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaacctaacaatggtggcacaaactatgcacagaagtttcagggcagggtcacatgaccagggacacgtccatcagcacagcctacatggagctagagcagactgacatctgacgacacgcattatactgtgcgtagatcggtttaccggtgcgttggttcttttacgg

SEQ ID NO: 116529 - DNA, 499 bp, Homo sapiens
  misc_feature: GYAE6OF02HPNK6.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagcctggggcctcagtgaaggtctcctgcaaggcttctggctacaccttcaccggcgactatctccactgggtgcgacaggcccctggacaagggcttgagtggatgggatggatcaaccctaacaatggtggcacaaactatgcacagaagtttcagggcagggtcacatgacaggacacgtcatcagcacagcctacatggagcgtgagcagactgacatctgacgacacggcctaatttactactgtgacgaggacggcaggtaattacgtagttttacggg

SEQ ID NO: 116530 - DNA, 538 bp, Homo sapiens
  misc_feature: GYAE6OF02HYGE9.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataaagaactacttagcttggtaccagcagaaaccaggtcagcctcctaagctgctcatttactggcatctacccgggaatccggggtccctgaccgattcgagtggcagcgggtctgggacagtatttcactctcaccatcagcagcctgcaggctaggaagagtgtgactagtttatgctgtcagacaattattaattattacttccgttaccgtactttccgggcccttagggaacctaaaggtcggtattacgtacgtaaaaccgtaacgtcggttcggctacgg

SEQ ID NO: 116531 - DNA, 495 bp, Homo sapiens
  misc_feature: GYAE6OF02G3JCG.45.37.D04.1.454.CMB.1.raw
  modified_base (410)..(410): a, c, t, g, unknown or other
  misc_feature (410)..(410): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttactgggcatctacccgggaatcccggggtccctgaccgattcagtggcagcgggtctgggacagatttcactctcaccatcagcagcctgccagctgaagntgtgcagtttatgctgtcagcaattattattatattcctcgatttccggcctggaccaagtcgatatacaaacgactgtgctacg

SEQ ID NO: 116532 - DNA, 515 bp, Homo sapiens
  misc_feature: GYAE6OF02F31VB.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaactggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaaccctaacaatggtggcacaaactatgacacagaagtttcgagggcagggtcaccatgaccagggacacgtccatcagcacagcctacatggagctgagcagactgacatctagaccgacacggcctagtttatactgtcgcgaggtagttcggtttaccggtggtcgttggttccttttacggg

SEQ ID NO: 116533 - DNA, 536 bp, Homo sapiens
  misc_feature: GYAE6OF02G2KYK.45.37.D04.1.454.CMB.1.raw
  modified_base (313)..(313): a, c, t, g, unknown or other
  misc_feature (313)..(313): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttacnggcatctacccgggaatccggggtcctgaccgattcagtgcagcgggtctgggacagtatttcactctacaccatcagcagcctgcaggctagaagatgtgctagtttactactgtcagcaattattaatgaagtactttcctcttccgtacgtttcgggacggtaacgggtaccgtaaggttcgacgtaacgtaccgaaaccggtacgttcggtaggtaccg

SEQ ID NO: 116534 - DNA, 547 bp, Homo sapiens
  misc_feature: GYAE6OF02JKQY3.45.37.D04.1.454.CMB.1.raw
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
tcagacgcgatcgacacgaccggtgctcgatttagtagcatactgttgggtttgggggtcgtacgaacaggcaggcaggggcgagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccagtacagcctcctaagctgctcatttactgggctatcctaccggaatccgggtcctgaccgatttcagtgcagcggtctggacagatttcactcgtcacctntcagcagcctgcgagcgtgaagatgtggctagtttagttncgttcgtcaggacaagttatttagtattacgtccttccgtatttaccggtccctaacgggtactaaacgtcggttaatagtaccaaacggtacccttaggtacggtcgtacgtaacccg

SEQ ID NO: 116535 - DNA, 812 bp, Homo sapiens
  misc_feature: GYAE6OF02IT0DH.45.37.D04.1.454.CMB.1.raw
  modified_base (196)..(196): a, c, t, g, unknown or other
  misc_feature (196)..(196): n is a, c, g, or t
  modified_base (763)..(763): a, c, t, g, unknown or other
  misc_feature (763)..(763): n is a, c, g, or t
tcagacgcgatcgacacgaccggtgctcgatttagtagcatactgttgggtttgggggtaggcgatcacccagcaaccacatctgtcctctagagaatcccctgagagctccgttcctcaccatggactggaccgtggaggatcctcttcttggtggcagcagccacaagagcccactcccaggtcgcagctggtncagtctggggctgaggtgaggagctggggcctcgagtgaaggtctcctgacgaaggcttcgtggactacaccttccgaccggcaacgttactcctaccgactggggttcgccgacaacgggccccccgtagggaaccgaacgggggtctttacggaacgggttgggaacgttggggggactttacggggaactttacccgaaaaaccccccgtttaaagaaaacggtttcgggggttacggggacccgtaaaacgtaaaaaacccgtttaggttaacgggaaccctaaaccggttaaaagggttaaaaacgggttttttccccggaaaaggggggggtccgtaaaccggggggtttaaccctaaacccggtaaacgttaaccgggaaacccggtaacggggaaaccgtaacccggttacccggtaactacccggtaagaccgtaaccgaacggtaacccgtaaccgaacgttacgggaacggtaccttagggacgaccgaacggtaccttacggacctaacgtcgttacgaacgaccgaacggtacctaagtttaactcgttaaggngtaccggaaggttcgtacgtttcggggacgttacgttcggttttaccgg

SEQ ID NO: 116536 - DNA, 505 bp, Homo sapiens
  misc_feature: GYAE6OF02GNBSM.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatggggatggatcaaccctaacaatggtggcacaaactatgcacagaagtttcagggcagggtcaccatgacagggacacgtccatcagcacagcctacatggagctagagcagactgacatctgacgacacggcctaatttactactgtagcggaggtagttggtttaccggtggtcgtttacggg

SEQ ID NO: 116537 - DNA, 499 bp, Homo sapiens
  misc_feature: GYAE6OF02HIGK0.45.37.D04.1.454.CMB.1.raw
  modified_base (313)..(313): a, c, t, g, unknown or other
  misc_feature (313)..(313): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttacngggcatctacccgggaatccggggtccctgaccgattcagtgcagcgggtctgggacagatttcactctcaccatcagcagcctgcaggctgaagatgtggcagtttatgctgtcagcaatattattatattcctccgtactttccggcccttgggtaccaaagtgatatcaaacgactgtgctcg

SEQ ID NO: 116538 - DNA, 551 bp, Homo sapiens
  misc_feature: GYAE6OF02HYTGL.45.37.D04.1.454.CMB.1.raw
  modified_base (416)..(416): a, c, t, g, unknown or other
  misc_feature (416)..(416): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaaccaggtcagcctcctaagctgctcatttactgggcatctacccgggaatccggggtccctgaccgattcagtggcaggcgggtctggggacagtatttccactctcaccatcagcagcctgccagctagaagntgtgctagtttattgctgtcagtactaaagttattaattattactttccctaccgttacttttccgggcccgttagggaaccctaaaggttacggtattacgtacgaaaaccggtaacgttggtacggtctacgg

SEQ ID NO: 116539 - DNA, 514 bp, Homo sapiens
  misc_feature: GYAE6OF02FT1O4.45.37.D04.1.454.CMB.1.raw
  modified_base (510)..(510): a, c, t, g, unknown or other
  misc_feature (510)..(510): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtccctgaccgattcagtggcagcgggtctgggacagatttcactctcaccatcagcagcctgcaggctgaagatgtgctagtttatgctgtcagctaattattattatacttccttaccgtactttccggcccttagggacctaaggttcgaatatacaaacgtactgtcggntacg

SEQ ID NO: 116540 - DNA, 513 bp, Homo sapiens
  misc_feature: GYAE6OF02HR1DL.45.37.D04.1.454.CMB.1.raw
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
  modified_base (493)..(493): a, c, t, g, unknown or other
  misc_feature (493)..(493): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctctgcaaggcttctggctacaccttcaccggcgactatctccactgggtgcgacaggcccctggacaagggcttgagtggatgggatggatcgaaccctaanaatgggtggcaacaaactatgcanagagtttcaggcagggtcacatgacaggacacgtcatcagcacagcctacatggancgtagacgcagactagacatctagacgacaccggctaatttacttactggtcgcgaaggtataggtttaccgggnggttacttggtttttaccgg

SEQ ID NO: 116541 - DNA, 559 bp, Homo sapiens
  misc_feature: GYAE6OF02IW7XZ.45.37.D04.1.454.CMB.1.raw
  modified_base (339)..(339): a, c, t, g, unknown or other
  misc_feature (339)..(339): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagcctggggcctcagtgaaggtctcctgcaggcttctggctacaccttcaccggcgactatctccactgggtgcgacaggcccctgggacaagggcttgagtggatgggatggatcaaaccctaanaagtggtcggacaacaaaactatgacacagaagtttcgagggcagggtcaacatcgacaggacacgtccatcagcaacacgacctacatgggacgcgtaggacgcgaagactagacagtactaggaaccgacgaccggtacctaattttaacttacgttcggtaggacggtaaggtacgtttggtttaacccgggtggttaccggttggtttttacccgg

SEQ ID NO: 116542 - DNA, 534 bp, Homo sapiens
  misc_feature: GYAE6OF02GSR99.45.37.D04.1.454.CMB.1.raw
  modified_base (373)..(373): a, c, t, g, unknown or other
  misc_feature (373)..(373): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaaacaataagaactacttagcttggtaccagcagaaaccaggtcagcctcctaagctgctcatttactgggcatctaccgggaactccgggtcctgaccattcgagtgcaggcggtctgggacagtnttcactctcacatcgagcagccctggcacggctagaagcgttgtggctagtttagtgctgtcagactaaattacttattactacttccctacgtaccgtttcggcccttagggaaccctaagtcggtaatacgtactaaaccggtactggttacgcgtacg

SEQ ID NO: 116543 - DNA, 536 bp, Homo sapiens
  misc_feature: GYAE6OF02IST1Q.45.37.D04.1.454.CMB.1.raw
  modified_base (337)..(337): a, c, t, g, unknown or other
  misc_feature (337)..(337): n is a, c, g, or t
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacaggcccctggacaagggcttgagtggatgggatggatcaaccctaanaatggtggcaacaactatgacacagtaagtttcagggcagggtcacgatgacagggacacgtcatcagcacagcctanatggagcagacgnacgactgaactatcgtagaccgacgaccggtaccaatttttaactacttggtacgagggtacggtagttacggtttaccgggtgggtaccgtttcgggtttttcccgg

SEQ ID NO: 116544 - DNA, 489 bp, Homo sapiens
  misc_feature: GYAE6OF02F1TD4.45.37.D04.1.454.CMB.1.raw
  modified_base (486)..(486): a, c, t, g, unknown or other
  misc_feature (486)..(486): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtccctgaccgattcagtggcagcgggtctgggacagatttcactctcaccatcagcagcctgcaggctgaagatgtgcagtttatgctgtcagcaatattattatattcctcgacttcggcctggaccaagtgatatcaaacgatgtgntcg

SEQ ID NO: 116545 - DNA, 847 bp, Homo sapiens
  misc_feature: GYAE6OF02FEKMB.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtcgccgtacggggacatcgtgactcgacccagtcctaccgacgtacctcccgtggtccttggtcgttccgtcggtgggacggacggaccgggaccaacctactaccgtaacgtcgaccgtaacgtcccgaacgtaccgtaaggttacggtttacggttttaacggaccgtaccggtaccctaaaccctaaaacgtaaacgttaaaccgtaaaccgtttaacgttaacggttaccggtttaaccggtaaccgaacggtaaccgaaaccggtaaacccgtacggtaccgtaccgtacccgtaccgttaacgtcctacgtacttacgttaacgttaccggtacggtaccgtaccgtacccgggtaacccggtaccggttcccggtaccgtacggtaccgtagttacgtacgggtacggtacggtacgggtcggttacggtacggtaaccgttagttacctaccgaccttccgaccactcgacgcgaccgtacgtccgaggacgtaggtacgtaacgagtttacgtcgggtaattcgtttaagtttcgcgacttacgtaacgttaacgtaacttttaacgtacttttaacgttaccgttacccggttacccgttaccggtaccggttacccggaaaccggtaacgtaaacccggttaggttaacctaacgtaaccgtaaccggtaaccgttggtacctaccggtacctaacccg

SEQ ID NO: 116546 - DNA, 544 bp, Homo sapiens
  misc_feature: GYAE6OF02IBSYR.45.37.D04.1.454.CMB.1.raw
  modified_base (314)..(314): a, c, t, g, unknown or other
  misc_feature (314)..(314): n is a, c, g, or t
  modified_base (380)..(380): a, c, t, g, unknown or other
  misc_feature (380)..(380): n is a, c, g, or t
  modified_base (415)..(415): a, c, t, g, unknown or other
  misc_feature (415)..(415): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagctccaaacaataagaactacttagcttggtaccagcagaaaccaggtcagcctcctaagctgctcatttacngggcatccgtacccgggaatcccggggtccctgaccgattcagtggcaggtcgggtctgggacagnttttcactctcaccatcagcagctgcagctgaagntgtgctagtttatgctgctagctaattattattaattacttcctaccgtacgttttccggcccgttagggaaccctaaagggtcgtaagttactaccgtaaaaccggtaccgtgttaccgggctaccgg

SEQ ID NO: 116547 - DNA, 528 bp, Homo sapiens
  misc_feature: GYAE6OF02JAG9D.45.37.D04.1.454.CMB.1.raw
  modified_base (311)..(311): a, c, t, g, unknown or other
  misc_feature (311)..(311): n is a, c, g, or t
  modified_base (442)..(442): a, c, t, g, unknown or other
  misc_feature (442)..(442): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctctaagctgctcatttacngggcatcgtacccgggaatcccggggtccctgaccgtattcagtgcaggcgggtctgggacagtctttcgactctcaccatcagcagcctgcaggcttagaagagtgtggctagtttattgcttgtcagtntaattattattatattcctccgtacttccggtccgtacgggaacctaagtggtaatacgtactaaaccgtactggtacgtctaccg

SEQ ID NO: 116548 - DNA, 514 bp, Homo sapiens
  misc_feature: GYAE6OF02F9LFJ.45.37.D04.1.454.CMB.1.raw
  modified_base (254)..(254): a, c, t, g, unknown or other
  misc_feature (254)..(254): n is a, c, g, or t
  modified_base (334)..(334): a, c, t, g, unknown or other
  misc_feature (334)..(334): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacnccttcaccggcgactatctccactgggtgcgacaggcccctggacaagggcttgagtggatgggatggatcaaccctaanaatggtggcacaaactatgcacagaagtttcagggcagggtcacatgaccagggacacgtccatcagcacagcctacatggagctgagcagactgacactctgacgacgacggcctaagtttattactgtcgcgtaggtattcggtttacccggtggtcgttcgggtttccttttacggg

SEQ ID NO: 116549 - DNA, 505 bp, Homo sapiens
  misc_feature: GYAE6OF02IPXQZ.45.37.D04.1.454.CMB.1.raw
  modified_base (469)..(469): a, c, t, g, unknown or other
  misc_feature (469)..(469): n is a, c, g, or t
tcagacgcgatcgacacgaccggtgctcgatttagtagcatactgttgggtttgggggaggcatcacccagcaaccacatctgtcctctagagaatcccctgagagctccgttcctcaccatggactggacctggaggatcctcttcttggtggcagcagccacaagagcccactcccaggtgcaactggtgcagtctggggctgaggtgaggaagcctggggcctcagtgaaggtctcctgcaaggcttctggctacaccttcaccggcgactatctccatgggtgcgacaggccctggacaagggcttgagtggatgggatggatcaacctaacaatggtggacacaaactatgacacagtaagtttcgagggcagggtcacatgacgagggacacgtcatcagcacacgcctacagtggagctgagcagacgtgacatctagacgacgacggcgtagtacttacgngtcgcgagaggcaggtaattacggtagtttggtagg

SEQ ID NO: 116550 - DNA, 505 bp, Homo sapiens
  misc_feature: GYAE6OF02ITNY0.45.37.D04.1.454.CMB.1.raw
  modified_base (347)..(347): a, c, t, g, unknown or other
  misc_feature (347)..(347): n is a, c, g, or t
  modified_base (502)..(502): a, c, t, g, unknown or other
  misc_feature (502)..(502): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagctccaacaataagaactacttagcttggtaccagcaagaaaccaggtcagcctcctaagctgctcattactgggcatctacccgggaatccggggtcctgaccgnttcagtggcaggcgggtctgggacagtatttcactctcaccatcagcagcctgcaggctagaagatgtgctagtttatgtctgtcagactaattattattattattcctcgtactttccggcctaggtaccaagtgatacacgaaacgactgtgntcg

SEQ ID NO: 116551 - DNA, 554 bp, Homo sapiens
  misc_feature: GYAE6OF02I752F.45.37.D04.1.454.CMB.1.raw
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggcccctggacaagggcttgagtggatgggatggatcaaaccctacaatggtgacaacaaactgtacgcaacagtaagtttcgagggcagggtcacagcgacgagggacacgtccancgagcacagcctacngtaggancgtgacgcgagactcgatactcgtacgaccggacaccggtaccttaagtttacttacgttagtcggtacggtagggttacgttacgggtttaacgggtcggttacgttcggtttttacccgg

SEQ ID NO: 116552 - DNA, 625 bp, Homo sapiens
  misc_feature: GYAE6OF02GP2MZ.45.37.D04.1.454.CMB.1.raw
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggcctcgagtgaaggtctcctgcaaggcttcgtggctacaccttcgaccggcgactactctccacgtgggtcgcgacgacggcccctaggaccaagggtcttaggagtggagtgggagtggataccaaaccctaacgaagtgggtcgacaactaaactacgtcgacactaagtaacggtttacgacggggacgacgggtaccaacgtacgtacggaaccggtaacgggaaccgtaccgtaccaacgtcgacgacgaaccgtacgacccttaacgagttacggagtccgtaggacgacaacgcgtagaactgtacgtagaaccgacgaccggtaccttaagttttactacgttggtacgacggtaggtacgttcggtttaccgggtgtcggttttggttccttttacggg

SEQ ID NO: 116553 - DNA, 495 bp, Homo sapiens
  misc_feature: GYAE6OF02HTOOJ.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaaccctaacaatggtgcacaaactatgcacagaagtttcgagggcagggtcaccatgaccagggacacgtccatcagcacagcctacatggagctgagcagactgacatctgacgacacggctatttatactgtgcggaggattggtttaccggtggtcttcggg

SEQ ID NO: 116554 - DNA, 611 bp, Homo sapiens
  misc_feature: GYAE6OF02JZUOC.45.37.D04.1.454.CMB.1.raw
  modified_base (201)..(201): a, c, t, g, unknown or other
  misc_feature (201)..(201): n is a, c, g, or t
  modified_base (323)..(323): a, c, t, g, unknown or other
  misc_feature (323)..(323): n is a, c, g, or t
  modified_base (436)..(436): a, c, t, g, unknown or other
  misc_feature (436)..(436): n is a, c, g, or t
tcagacgcgatcgacacgaccggtgctcgatttagtagcatactgttgggtttgggggtaggcgtacaacaggcaggcaggggcgagcaagatggtgttgcagacccaggtcttcatttctctgttgctctgatctctggtgcctacggggacatcgtgatgacccagtctccagactcctggctgtgtctctgggcgagnggccacatcaactgcaacgtcacgccagagttgtttagacacgctaccaacaataagaactactagcttaggtaccagacagaaaccaggtcagcctacctaagctcgtctactatttacgnggtacataccgtaaccgggacttcccgggggtaccctcggaaccgtacttacgacgtaggcgtaacggcggtcggtacggacacgtatttccgactcgtacaccctatcgacncacgtcacgcgacgtcgtagaacgactgcggtctaggtttattcgtacttgtacgtacgactaattattaacttattacgttacccgtccgttaactttccgggcccgtttacggaacccgtaaggttacggtacttacgttacaaaccggttactcggtacggtacccttacgg

SEQ ID NO: 116555 - DNA, 577 bp, Homo sapiens
  misc_feature: GYAE6OF02JFQDD.45.37.D04.1.454.CMB.1.raw
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggagccgtggggcctcagtgaaggtctcctgcaaggcttctggctacaccttcaccggcgactatctccactgggtgcgacacggcccctggacaagggcttggagtggatgggatggactcaaccctaacagtggtggcaacaaactntgacanaggtaagtttcgagggcgacgggtcaaccgatacggaccgaagggacaccggtccagtcgacgcacacgacctacgagtcggagcgtagacgacgacgtacgtacgaactagtctacggaccgacgaccggtaccttaagttttactacgtgtacggacggtaacggtacgtttacggtttaccgggtggttccgttggtttttacccgg

SEQ ID NO: 116556 - DNA, 498 bp, Homo sapiens
  misc_feature: GYAE6OF02GRRYF.45.37.D04.1.454.CMB.1.raw
  modified_base (415)..(415): a, c, t, g, unknown or other
  misc_feature (415)..(415): n is a, c, g, or t
  modified_base (438)..(438): a, c, t, g, unknown or other
  misc_feature (438)..(438): n is a, c, g, or t
  modified_base (473)..(473): a, c, t, g, unknown or other
  misc_feature (473)..(473): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaaccctaacaatggtggcacaaactatgcacagaagtttcagggcagggtcacatgaccagggacacgtccatcagcacagcctanatggagctgacgcagactgacanctgacgacacggctattacttactgtcgcgaggtntagtttaccggtgtcgtggtttccg

SEQ ID NO: 116557 - DNA, 538 bp, Homo sapiens
  misc_feature: GYAE6OF02HTYEL.45.37.D04.1.454.CMB.1.raw
  modified_base (313)..(313): a, c, t, g, unknown or other
  misc_feature (313)..(313): n is a, c, g, or t
  modified_base (365)..(365): a, c, t, g, unknown or other
  misc_feature (365)..(365): n is a, c, g, or t
  modified_base (454)..(454): a, c, t, g, unknown or other
  misc_feature (454)..(454): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaaacaataagaactacttagcttggtaccagcaagaaaccaggtcagcctctaagctgctcatttacnggcatcctaccgggaactccggggtcctgaccgtatcagtgcaggcgggtcngggacagtatttcactctcacatcagcagcctgcaggctagaagagttgtcgtctagtttacgtgtctggtacagactaaattattagngtatacttccttcgtactacggtttccgggacggtaacggtaccgtaaggttcgacgtacgtaaccgaaacgtacgtggtacgg

SEQ ID NO: 116558 - DNA, 545 bp, Homo sapiens
  misc_feature: GYAE6OF02H5F29.45.37.D04.1.454.CMB.1.raw
  modified_base (316)..(316): a, c, t, g, unknown or other
  misc_feature (316)..(316): n is a, c, g, or t
  modified_base (541)..(541): a, c, t, g, unknown or other
  misc_feature (541)..(541): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagtgtttagacagctccaacaataaagaactacttagcttaggtaccagcagaaaccaggtccagcctacctaagctgctcattttacngggcagtccgtacccgggaacgtcccgggggtccctacggtaccgtattcaggttcggcgaggtccgggtcgtggggacctagtacttttcactcctccgaccctatcacgctaacgccgtgcgaggcctagaagagtggtggactagtttatgctgtcagactaattattatattattcctcgtctttccggctacggactaagtgatacacaacgtatgtcgntacg

SEQ ID NO: 116559 - DNA, 548 bp, Homo sapiens
  misc_feature: GYAE6OF02IYSN3.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgtttagacagctccaacaataagaactacttagcttggtacccagcagaaaccaggtcagcctcctaagctgctcatttctgggcatcgtacccgggaatcccggggtcctgaccgattcagtggcaggcgggtctgggacagtatttcactcacaccatcagccagcctgccaggctgaagatgtcgtactagtttatggcttgtcaggctaattatttaattatactttccctacgtaccgttttccggcccttacgggaacctaaaggtcggtaattacgtaacgtaaaccggtaactcggttacgcgtacgg

SEQ ID NO: 116560 - DNA, 491 bp, Homo sapiens
  misc_feature: GYAE6OF02FZFDD.45.37.D04.1.454.CMB.1.raw
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctggcgagaggccaccatcaactgcaagtccagccagagtgttttagacagctccaacaataagaactacttagcttggtaccagcagaaaccaggtcagcctcctaagctgctcatttactgggcatctacccgggatccgggtcctgaccgattcagtggcagcgggtctgggacagtatttcactctcacatcagcagcctgcaggctgaagagtgtgctagttatgctgtcagcaatattntatnttcctcctacttcgcctgggaccaagtgaatatacaacgtactgtcgtctgtacc

SEQ ID NO: 116561 - DNA, 597 bp, Homo sapiens
  misc_feature: GYAE6OF02H9YDG.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttagacagctccaaacaataagaactacttagcttggtaccagcaacgaaaccaggtcacgcctacctaagctgctctatttacgtggctactcgtacccgggaatcccggggtccctcggaccgtattcgagtcggcgacggtccggggtctggggacaggtacttttccactctccacctactcagcagcctcgccaggctagaacgagtgtcggctagtttatgtcgttgtacgagactaaatttattaatttaattactttacccttccgttaacccgttttccgggcccgttaacgggaacctaaacgggttacggtaattacgtaaccgtaaacgttaacgtacggtacggctaccgg

SEQ ID NO: 116562 - DNA, 559 bp, Homo sapiens
  misc_feature: GYAE6OF02H7G27.45.37.D04.1.454.CMB.1.raw
  modified_base (316)..(316): a, c, t, g, unknown or other
  misc_feature (316)..(316): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaaacaataaagaactacttagcttggtaccagcagaaaccaggtcagcctcctaagctgctctatttacgnggacatcctacccgggaacgtccggggtccctgaccgtatcaggtggcaggcgggtctgggacagtactttcactctccaccactcacgcagcctgcaggctaggaaagtgtagtgactagtttattcgacgttgtacagacttaaattattaattacttactttcctaccgttacctttccggtcccttacggggaacctaaaggttacgattactaccgaaacgtaacgtgtacggactcg

SEQ ID NO: 116563 - DNA, 622 bp, Homo sapiens
  misc_feature: GYAE6OF02GIOPN.45.37.D04.1.454.CMB.1.raw
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
tcagacgcgatcgacacgaccggtgctcgatttagtagcatactgttggttttgggggtaggctacaacaggcaggcaggggcagcaagatggtgttgcagacccaggtcttcatttctctgttgctctggatctctggtgcctacggggacatcgtgatgaccccagtctccagactccctggctgtgtctctgggcgagagggccaccatcaactgcaagtccagccagagtgttttagacagctccaacaataaagaactaacttagcttaggtaccagacagaaaccagtcagcctacctaanctcgntacatttacnggcatcctaacccggaatcccgggtccctagaccgtattcagtggcagcgggtctagggaccaggtactttcgactcgcaccgatcagtcacgccttagctaggccttagaacgtagtcgtcggtactacggttttaacttggacctttggacctaacggtccgtaaaatttatttaacgtttaatactttcccgtaccgttaccgttttaccgggccccgttacggggaaccttaaaaccggttcggtaacgttaacgtaccgtaaaaaccggtacttacggttacggtcccgttaacg

SEQ ID NO: 116564 - DNA, 556 bp, Homo sapiens
  misc_feature: GYAE6OF02GPH8G.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacacggccctggacgaagggcttggagtggatgggatggatacaaccctaacaagtggtggacaacaaactatcgacacgagaagtttcgagggacgagggtacacatgaccgagggacacgtccatcagcacacgactacagtacggagcgtgacgcaacggtactcgaactacgtcgtacggacgaccgaccggaccttaagtttacgttacgtagtggacggtacgggtagtttcgggttttaccggtcggttcgtttccggg

SEQ ID NO: 116565 - DNA, 586 bp, Homo sapiens
  misc_feature: GYAE6OF02GW4R3.45.37.D04.1.454.CMB.1.raw
  modified_base (340)..(340): a, c, t, g, unknown or other
  misc_feature (340)..(340): n is a, c, g, or t
tcagacgcgatcgacacgaccggtgctcgatttagtagcatactgttgggtttgggggagcatcactcagcaaccacatctgtcctctagagaatcccctgagagctccgttcctcaccatggactggacctggaggatcctcttcttggtggcagcagccacaagagcccactcccaggtgcaactggtgcagtctggggctgaggtgaggaagcctggggcctcagtgaaggtctcctgcaaggcttctggctacaccttcaccggcgactatctccactgggtgcgacacggcccctggacaagggcttgagtggatgggatggatcaaaccctaanaatggtggcaacaaactatgcaacagtaagtttcgagggcacgggtcaccgatgaccgagggacacgtccatacagaccacacgacctaacacgtggacgactacggagaccgaagaccgtagaaccagtacgtacgaaccgaccgaccggtacctaacgttttaacgtttacgtacggttacgtacggtaaggttacgttacgggtttaaccgggttcgggttaccgtttggttttttaccccgg

SEQ ID NO: 116566 - DNA, 557 bp, Homo sapiens
  misc_feature: GYAE6OF02FHIGM.45.37.D04.1.454.CMB.1.raw
  modified_base (282)..(282): a, c, t, g, unknown or other
  misc_feature (282)..(282): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatccaactgcaagtccagccagagtgttttagactagctccaacaataagaacctacttagcttggtgccagcanaaccaggtcagcctctaagctgctcatttactgggcatctacccgggaatcccggggtcctgaccgattcagtcggcaggcgggtcngggacagnttcacttcncnccatcagtagcctgccaggcctagaacgatggtagctacgttttatgtctaggtcaagtcctaaattaactttacttattacttccgtacctaactttccggcccttgggaacccctaaggttcggaacttacggtacctaaaacggtaacctggtacggtactaccgg

SEQ ID NO: 116567 - DNA, 597 bp, Homo sapiens
  misc_feature: GYAE6OF02IVZC9.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaaacaataagaactacttagcttggtaccagcagaaaccaggtcagcctcctaagctgctctatttacgtgggcactccgtacccgggaatcccggggtccctggacccgtattccaggtggcgaggcgggtcgtggggacaggtactttccacttcctccaccatcacgccagcccgtgccgaggtctaggaagagttggtggtactaggttttattcgtcgttgtcaaggtctaatttaatttattaacttactttcccgttaccgttaccgttttcccgggacccgttacgggaacctaaaggttcggtaattaacgtaccgtaaacgtaacgtggtacggtctaccgg

SEQ ID NO: 116568 - DNA, 536 bp, Homo sapiens
  misc_feature: GYAE6OF02HEV4N.45.37.D04.1.454.CMB.1.raw
  modified_base (342)..(342): a, c, t, g, unknown or other
  misc_feature (342)..(342): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctcctgcaaggcttctggctacaccttcaccggcgactatctccactgggtgcgacacggcccctggacaagggcttggagtggatgggatggatcaaccctaanaagtggtggacacaaactatgacacagagtttcagggcagggtcaccgatcgaccgagggacacgtccatcagcacgacgcctacagtggagcgtgagcagactcgactagtctcggaccgacgacggtacctaatttacttacgtgtacgcggtacggtagttcggtttacggtcggttcgttcggttttccg

SEQ ID NO: 116569 - DNA, 541 bp, Homo sapiens
  misc_feature: GYAE6OF02HXT2O.45.37.D04.1.454.CMB.1.raw
  modified_base (313)..(313): a, c, t, g, unknown or other
  misc_feature (313)..(313): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggtcgagagggccaccatcaactgcaagtccagccagagtgttttagacagctccaacaataaagaactacttagcttggtaccagcagaaaccaggtcagcctctaagctgctcatttacgngggcatctacccgggatccggggtccctgaccgattcgagtggcaggcggtctgggacagtattcactctcaccatcagcacgcctgcgaggctagagtagtgtgcttagtttatgtcgtgtcagctaagttattattattacttccttccgtaccgtttccggcccgttagggaaccctaaggttacgaattacgaccgtaaacgtaacgtcggtacggtactacgg

SEQ ID NO: 116570 - DNA, 538 bp, Homo sapiens
  misc_feature: GYAE6OF02G8NBL.45.37.D04.1.454.CMB.1.raw
  modified_base (312)..(312): a, c, t, g, unknown or other
  misc_feature (312)..(312): n is a, c, g, or t
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctctaagctgctcatttacnggcatctacccgggaatccggggtcctgaccgattcagtgcagcgggtcngggacagtactttcactctcaccatcagcacgcctgcaggctagaacgtntggtgctagtttatggtctagtcagtactaattagttaattattactttccctaccgttacgtttccggcccgttagggaacctaagtggtaacttactacgtaaaccgacttggtacggtactcg

SEQ ID NO: 116571 - DNA, 516 bp, Homo sapiens
  misc_feature: GYAE6OF02GT3Z1.45.37.D04.1.454.CMB.1.raw
  modified_base (307)..(307): a, c, t, g, unknown or other
  misc_feature (307)..(307): n is a, c, g, or t
  modified_base (399)..(399): a, c, t, g, unknown or other
  misc_feature (399)..(399): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttttacggcccaatagtaagaactacttagcttggtaccagcagagcaggcagcctcctaagctgctcatttacnggcatcacccgggaatccggggtcctgaccgattcagtgcagcggtctgggacagtattcactctcaccatcagcagcctgcaggctgaagntgtgctagtttatgctgcagctaattattattattacttccgtaccgtatttccggccctagggaacctaaaggtgtaacttataccgtaaacgattggtacgcttcgacctaaccg

SEQ ID NO: 116572 - DNA, 545 bp, Homo sapiens
  misc_feature: GYAE6OF02JUFQQ.45.37.D04.1.454.CMB.1.raw
tcagacgcgatcgacacgaccggtgctcgatttagtagcatactgttgggtttgggggagctacaacaggcaggcaggggcagcgaagatggtgttgcagacccaggtcttcatttctctgttgctctggatctctggtgcctacggggacaatcgtgatgacccagtctccagactccctggctgtgtctctgggtcgagagggccaccatcaactgcaagtccagccagagtgttttagacagctccaacaataagaactacttagcttggtaccagcagaaaccaggtcagtcctcctaagctgctctatttactgggcatcgtacccgggtaactccggggtccctcgaccgattcgagtcggcacggcgggtcgtgggacagtatttcactctacactatcacgctacgcctgccagcctgaagtatcgcgctagtttcactgtcacgtctaattattatgtactacttcctctacgtaccgttcggacggtaacgacccgtaaggttcgacgtactaccgaacgtacgttaggcgtacg

SEQ ID NO: 116573 - DNA, 550 bp, Homo sapiens
  misc_feature: GYAE6OF02F4I8M.45.37.D04.1.454.CMB.1.raw
  modified_base (369)..(369): a, c, t, g, unknown or other
  misc_feature (369)..(369): n is a, c, g, or t
  modified_base (391)..(391): a, c, t, g, unknown or other
  misc_feature (391)..(391): n is a, c, g, or t
  modified_base (414)..(414): a, c, t, g, unknown or other
  misc_feature (414)..(414): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatccgtacccgggaatcccggggtccctgaccgtacttcagtgcgagcgggtcngggacagtatttcactctcacntcagcagcctgcaggctgaagtntgtgctagtttatcgtcgtgtcagactaagttattagttacttacttcctaccgttaccgttccggtaccgttacgggaacctaaaggtcggtaactaacgtaccgtaacgtaacgtcggtacgtccgtagtaccg

SEQ ID NO: 116574 - DNA, 550 bp, Homo sapiens
  misc_feature: GYAE6OF02H684B.45.37.D04.1.454.CMB.1.raw
  modified_base (514)..(514): a, c, t, g, unknown or other
  misc_feature (514)..(514): n is a, c, g, or t
tcagacgcgatcgacacgaccggtgctcgatttagtagcatactgttgggtttgggcatcacccagcaaccacatctgtcctctaaagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttggagtggatgggatggatcaacctacaatggtggacacaaactatggcacagaagtttcagggcagggtcaccatgaccagggacacgtccatcagcacagacctacagtgggacgctgacggcagactgaacatctaggaaccacgaccggacctagttttacttacgttggtcgaccggtaggtacttacgggttttacccgggnggttccggtttggttttcccgttttaggtacccggg

SEQ ID NO: 116575 - DNA, 535 bp, Homo sapiens
  misc_feature: GYAE6OF02FJM1N.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaccaggtcagcctctaagctgctcatttactgggcatccgtacccgggaatcccggggtccctgaccgtattcagtggcagcgggtctggggacagtatttcactctcacctatcagtccagccctgacaggctgaagtatgtgctagtttaatgctgtcagctaattattattatacttcctccgtaccttccggaccctacgggaaccctaaggttcgaactacgtaccaaaaccgtacgtggtaggctacgg

SEQ ID NO: 116576 - DNA, 515 bp, Homo sapiens
  misc_feature: GYAE6OF02F9OOA.45.37.D04.1.454.CMB.1.raw
  modified_base (447)..(447): a, c, t, g, unknown or other
  misc_feature (447)..(447): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttggagtggatggggatggatcaaaccctaacaatggtggacaacaaactatgacacaagtaagtttcgagggcagggtcaacgatcgaccagggacacgtccatcagcaacagcctacagtggagctgagcagacngacatctgacgacacggcctatttactactgtgacggaggtagttggtttaccgggtggtcgtttcgg

SEQ ID NO: 116577 - DNA, 502 bp, Homo sapiens
  misc_feature: GYAE6OF02GIUG7.45.37.D04.1.454.CMB.1.raw
  modified_base (446)..(446): a, c, t, g, unknown or other
  misc_feature (446)..(446): n is a, c, g, or t
  modified_base (499)..(499): a, c, t, g, unknown or other
  misc_feature (499)..(499): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtcctgaccgattcagtggcagcgggtctgggacagatttcgactctcaccatcagcagcctgcagctgaagatgtgctagtttatgcttgtcagactaatattattatnttcctcgtacttcggcccttgggacctaagtgatactacgaaacgagtgtggntcg

SEQ ID NO: 116578 - DNA, 572 bp, Homo sapiens
  misc_feature: GYAE6OF02GTN8J.45.37.D04.1.454.CMB.1.raw
  modified_base (316)..(316): a, c, t, g, unknown or other
  misc_feature (316)..(316): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctaccaacaataagaactacttagcttggtaccagcaagaaaccaggtcagcctcctaagctgctcatttacgnggcactcctacccgggaagtccggggtccctgaccgattcagtcggcaggcgggtctgggacaggtatttcactctacacccatcgacgcacgcctcgacaggccttaggaacgagtcggtgctaaggttttatggcttaggtctaaggtacttaaattaatttagttaattactttccgtacctacgttttccggcccgttaggtaccctaaaggtcggaattacgtaccaaaccgtaacgtcgtacggactacg

SEQ ID NO: 116579 - DNA, 557 bp, Homo sapiens
  misc_feature: GYAE6OF02F7TGH.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggagccgtggggcctcagtgaaggtctccgtgcaaggcttctggctacaccttcaccggcgactatctccacgtgggtgcgacacggccccgtggacgaagggcttggaggtggagtgggatggatcaaccctaacagtggtggacaacaaactatgcacaagaagtttcgagggcgacgggtacaccagcgaccgaggacacgtcatcgagcacgacgacctacagtggacgtcgtagacgacaggactacgacactacgtcgaacgaccgacggaccttaagtttacttacgtcgtgacgtaggtacgttacggttaccgggtcggttcgttcggttttaccgg

SEQ ID NO: 116580 - DNA, 607 bp, Homo sapiens
  misc_feature: GYAE6OF02F3OV2.45.37.D04.1.454.CMB.1.raw
  modified_base (365)..(365): a, c, t, g, unknown or other
  misc_feature (365)..(365): n is a, c, g, or t
  modified_base (458)..(458): a, c, t, g, unknown or other
  misc_feature (458)..(458): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccacatcaactgcaagtccagccagagtgttttagacagctccaacaataagaactacttagcttaggtaccagcagaaaccaggtacacgcctcctaagctcgctacatttactgggcagtccgtaacccgggaatcccggggtccctgaccgtattcagnggcaggcgggtcgtgggacaggtatttcactctcaccatcagcacgcctgcaggctagaagagtgtacgctagtttagtgtacgtgtacgtanacgttaaattactttaaactttacttaacttttacccgttacccgttaccgttttacccgggtaccccgttacgggtaaccccgtaaaggttcggtaacttaacgttaaccgtaaaaccgttaaccgttacggtacggtactaacccgg

SEQ ID NO: 116581 - DNA, 682 bp, Homo sapiens
  misc_feature: GYAE6OF02J2EE5.45.37.D04.1.454.CMB.1.raw
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (625)..(625): a, c, t, g, unknown or other
  misc_feature (625)..(625): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgccgtacgggacatcgtgatcgacccagtcctccagtcctcccgtggtctgtcgtctcgtgggcgagcggcccaccataccaactgacacgtccagccgagtagttgttagcagcctacaaactaataacgacttctagtcgttacggacacgacaacgtaaccgngtccacgtcctacagctgtctctattcgnggtactacgtaccgtaccggtacctcccgggtacctacgtacctacgtacgcggtcggacgtcggggtacgttcggaaggtacctattccgtactccgtccacccgtaacacgttcgaacgcccgtacgccgttagacggaccggttatcggtaaacgtcggttacgtaccgggttattagggtttaccttcgggactttacggacctaaagttacctattttaaagttctttaaacctccggttcccgtcccgttacggttccgttacccgggtagttaaacctaacggggtntttaaactaccccggtaagtaacctacggttcggtaccgtcccgttaataaccccgg

SEQ ID NO: 116582 - DNA, 643 bp, Homo sapiens
  misc_feature: GYAE6OF02I1OUO.45.37.D04.1.454.CMB.1.raw
  modified_base (295)..(295): a, c, t, g, unknown or other
  misc_feature (295)..(295): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtgggctgaggtgaggaagccgtggggcctcgagtgaaggtctccgtgcaaggcttcgtggctacaccttcaccggcgactatctccactggtgcgacncggcccgtggacaagggcttggagtggagtgggatggactaccgaaaccctaagaagttgggtacgacaacgaaactatagacaacaaggtaacgtttcgagggacgacgggtaccaacgagtacgacgacggactaccgtccactaccgacgacacgacgtccctaacgagtacgggacgcgtacgacgacgaagtaccgtacgaacgtacttccgtacggaaccgaccgaccgggtaccttaaacgtttttaaccgttaacgttcggttacggtacgggtaacggttacggtttaccgggttttaacccgggtcgggtttaccggtttcggttttttaaccccggg

SEQ ID NO: 116583 - DNA, 585 bp, Homo sapiens
  misc_feature: GYAE6OF02H49WP.45.37.D04.1.454.CMB.1.raw
  modified_base (456)..(456): a, c, t, g, unknown or other
  misc_feature (456)..(456): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacagtccagccagagttgttttagacagctaccaacaataaacgaactacttaagcttaggtaccagacacgaaaaccaggtaccagcctaccgtaagctagctactatttacgtggctatccgtaccgggtaacgtcccggggtccctgaccgtattcgagtggcacggccgggtacgtaggggactagtacttttccacgttctaccacctatcagcacgcctgacgaggctagaacgngtggtcgtactagtttagtgtacttgtacagtactaatttattaattattacttccctaccgttacgttttccgggcccgttacggaacctaaggtcgacttactaacgaacctagtcgtacggctacg

SEQ ID NO: 116584 - DNA, 504 bp, Homo sapiens
  misc_feature: GYAE6OF02FHA5N.45.37.D04.1.454.CMB.1.raw
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
  modified_base (500)..(500): a, c, t, g, unknown or other
  misc_feature (500)..(500): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactactagcttggtaccagcagaaaccaggtcagcctcctaagctagctcattactgggcatctaccggaatccggggtccctgaccattcagtggcagcggtctggacagatttcactctcaccatcagcagcctgcagctgaagntgngctagtttattcgntgtccagtctaatattattatacttcctacgtacttcggtaccctggaacctaagtgatactacaaacgtactgtaggtntacg

SEQ ID NO: 116585 - DNA, 503 bp, Homo sapiens
  misc_feature: GYAE6OF02HCZ2H.45.37.D04.1.454.CMB.1.raw
  modified_base (412)..(412): a, c, t, g, unknown or other
  misc_feature (412)..(412): n is a, c, g, or t
tcagacgcgatcgacacgaccggtgctcgatttagtagcatactgttgggtttgggggagatacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactacttagcttggtaccagcagaaaccaggtcagcctcctaagctgctcatttactgggcatctacccgggaatccggggtccctgaccgattcagtggcagcggtctgggacagatttcacgtctcaccatcagcagcctgcaggctgaagatgngctagttatgctgtcagacaattagtattatacttcctacgtactttccggcctggacctaagtagatatacaaacgtactaggtgctacg

SEQ ID NO: 116586 - DNA, 539 bp, Homo sapiens
  misc_feature: GYAE6OF02GHNR9.45.37.D04.1.454.CMB.1.raw
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctggcgagagggccaccatcaactgcaagtccagccagagtgtttagacagctccaacaataagaactacttagcttggtgccagcagaaaccaggtcagcctcctaagctgctcatttactgggcatcctaccgggaactcccgggtaccctgaccgattcagtggcagcgggtcngggacagatttcactctcacatcagtagcctgcaggctaggaagtagtgtcggtctagtttatgtctgtcaagtctaattattaattattacttccttccgtacgtttccggtcccgttaggtaacccgtaaagttcgaatacgtaccgtaaacgtacgtacggtacgctacg

SEQ ID NO: 116587 - DNA, 868 bp, Homo sapiens
  misc_feature: GYAE6OF02JK34D.45.37.D04.1.454.CMB.1.raw
tcagacgcgatcgacacgaccggtgctcgatttagtagcatactgttgggtttgggggtaggcgtacgaacaggcaggcagggcgagcaagatggtgttgcagacccaggtcttcattctctgttgctctggatctctggtgcctacggggacatcgtgatgaccagtctccagacctccctggctgtgtctcgtgggcgaggagggccaccgatcaactgcaagtccagccagagtgttttagacagctccaaacaataagaactacttagcgttggtaccagcaacgaacctaggtcagcctacctaagctcgctactactttacgtgggacctagtaccgtaacccggggaacgttaccccgggggtacccttacgggtaacccgtactttaccgtacgggttaccggacgtaacgggtccgggggtttacgtacggggggtaacctaacggggttaacttttacccgtaacccgttacccttaacccgtaacccgtaaaccgttccccgaaacgggtcccgtaaaccgggtcccgttaaccgggtacccggtaacggggtacccttaaggggtaaaaccggtaacggttaccgggttacgggtaccggttttaaacgggtttttaacggtttacgggtacccggtttacggttacccggtaaacggtaccgttaaaacgttttaacgttttaaacgtttaaacgtttaacccgtttaccccgttacccgggtttaacccggttttccccggggaccccggtttttaacggggaaacccgttaaacgggttaaccgggttaacttaaccgttaaccggtaaaacccgttaaccggttaccgggttacggttacccgttaaccggg

SEQ ID NO: 116588 - DNA, 588 bp, Homo sapiens
  misc_feature: GYAE6OF02I0ESM.45.37.D04.1.454.CMB.1.raw
  modified_base (252)..(252): a, c, t, g, unknown or other
  misc_feature (252)..(252): n is a, c, g, or t
  modified_base (296)..(296): a, c, t, g, unknown or other
  misc_feature (296)..(296): n is a, c, g, or t
  modified_base (449)..(449): a, c, t, g, unknown or other
  misc_feature (449)..(449): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctgggctggaggtgaggaagcctggggcctcagtgaaggtctccgtgcaaggcttcnggctacaccttcaccggcgactatctcctacgtgggtcgcgacncggcccctggacaagggctggagtggatgggatggatccaacctaactaatgggtaggacacgtaaaactagtgacactacgtaaagttttcgagggcgaagggtcgaccagtcggaccgaggtacacggtccatcgagactacgacgcctanacgtggacgccgtagacgcaacgacgttacgactacgtactaggaccacgaaccgtacgtaacttttacgtacgtacgttacgacgggtacgtaggtttaccggtttaaccggtcgggttacctaggtttttaccccgg

SEQ ID NO: 116589 - DNA, 663 bp, Homo sapiens
  misc_feature: GYAE6OF02IZX9Q.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactcctgctgtgtctctgggcgagagggccaccatcaactgacaagtccacgccagagttgttttagacagcctaccaacaataagaactacttagcttcggtaccagacaagaaaccaggtacagcctacctaagctgctctatttacgtggctactccgtacccggggaactcccgggggtaccctggaccgtattaccgaggtacggcgaggtccgggtcgtcgggggacagtacttttccgacttccgtaccaccatcgacgcacgacccgtcgaccgacgtcccgtaggtaacgtacgttcgtaccgtccgttaacgttttaaccgtaccgttacgtaccgaacgtacttaatttaacgtttaatcggtaacgttactttccctacttaccgttaccggttttcgggaccggttaaccgggtaaccgtaacgggttacggtaaccggtaccgttaaccgaaacggtaccggttaggtccggtaccg

SEQ ID NO: 116590 - DNA, 518 bp, Homo sapiens
  misc_feature: GYAE6OF02HADUD.45.37.D04.1.454.CMB.1.raw
  modified_base (313)..(313): a, c, t, g, unknown or other
  misc_feature (313)..(313): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttacngggcatccgtacccgggaatccggggtccctgaccgattcagtggcaggcgggtctgggacaggtatttcactctcaccatcagcagcctgcgagctagaagatgtgctagtttatgtctgtcagataattattattatacttcctcgtactttccggcccgtaggaacctaaggtgtatactacgaaacgtactgtcggctacg

SEQ ID NO: 116591 - DNA, 494 bp, Homo sapiens
  misc_feature: GYAE6OF02JJEV4.45.37.D04.1.454.CMB.1.raw
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggagtccggggtccctgaccgtattcagtggcagcgggtctgggacagtatttcactctcaccatcagcagctgcaggctgaantgngctagtttntgctgtacagcaattattattanttccncgtacttcggcctggacctaagtgatagtcaaacgntgngctcg

SEQ ID NO: 116592 - DNA, 563 bp, Homo sapiens
  misc_feature: GYAE6OF02IEL7F.45.37.D04.1.454.CMB.1.raw
  modified_base (420)..(420): a, c, t, g, unknown or other
  misc_feature (420)..(420): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagctccaacaataagaactacttagcttggtaccagcagaaaccaggtcacgcctactaagctgctctatttactgggcatcgtacccgggaatccggggtcctgaccgtatcagtcggcgagcgggtctgggacagatttcactctcaccatcagcagcctgcaggctagaagatgtgntagtttatgtctgtcagtactaattattattaattactttcccgtccgttaacttttcccgggcccgttaacggggaaccctaaaagggttcgtaaacttacgtaaccgtaaaaccggttactacgggttacggcttaaccgg

SEQ ID NO: 116593 - DNA, 549 bp, Homo sapiens
  misc_feature: GYAE6OF02GGTEP.45.37.D04.1.454.CMB.1.raw
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaactggtgcagtctggggctgaggtgaagaagcctggggcctcagtgaaggtctcctgcaaggcttcgtggatacgaccttcaccggtctacctatatacactggtgcgacaggcccctggacagggcttgagtggatgggatggatcaacctanaatggtgcacaactatgcanagaagtttcagggtcagggtcacatgaccgagggacacgtccatcagcacagcctacatggagcgtagagcgaggctacgagtactacgtagacgtacgacggtaccgtaggttaacgttaccgtaggtacgtacggtaaggtacgggtacgaagggtaacgtttacgggtagttttttaggggtaacggg

SEQ ID NO: 116594 - DNA, 799 bp, Homo sapiens
  misc_feature: GYAE6OF02JJTJX.45.37.D04.1.454.CMB.1.raw
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgccgtacggggacatcgtgatgacccagtctccagacctccctggctgtcgtctcgtgggcgaggacggccaccatacaactgacaacgtccagccagtagttagtttacgacacgcctaccaaacaaataacgaacttacttacgtccgttacggtaaccacgacaacgaaacccgacggtaccacgaccctaccgtaacgctcgcctactaacgtttacgcgggtactaacgttaccggtaacccggggtacgtccccggggtacctacggtaccgtattccgaggtcggacgacggtccgggtcgtacggacgtagtactttcgaccttccgtaccaacctagtcccagtacccacgtcccgtaggaccgtacggtacgtaaaggtaacggtgttacgggtcgtaaccgttaaggttttacgcggtaccgtttacggtacctaaacggttacttaaaacgttttagttttaaaccgtttaaacgtttacccgtttacccccggttacccggtttaaccgggttttaccccggggtaaccccggttaaacgggggtaaacccttaaaacggggttaccggtttaaacgttaaaccccggttaaaaccggtaaaacccggttacgggtttaaccgggttaccgggttaacccgtaacccgg

SEQ ID NO: 116595 - DNA, 513 bp, Homo sapiens
  misc_feature: GYAE6OF02FP5QB.45.37.D04.1.454.CMB.1.raw
  modified_base (420)..(420): a, c, t, g, unknown or other
  misc_feature (420)..(420): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcattactggcatctacccgggaatccggggtcctgaccgattcagtggcagcgggtctgggacagtatttcactctcaccatcagcagcctgcaggctgaagatgtgctagtttntgctgtcagctaattattattatattccgtacgtactttcggcccttagggaacctaaaggtgtaatactacaaacggtactggtcggctacg

SEQ ID NO: 116596 - DNA, 736 bp, Homo sapiens
  misc_feature: GYAE6OF02J1LI3.45.37.D04.1.454.CMB.1.raw
  modified_base (201)..(201): a, c, t, g, unknown or other
  misc_feature (201)..(201): n is a, c, g, or t
  modified_base (322)..(322): a, c, t, g, unknown or other
  misc_feature (322)..(322): n is a, c, g, or t
tcagacgcgatcgacacgaccggtgctcgatttagtagcatactgttgggtttgggggtaggctacaacaggcaggcaggggcagcaagatggtgttgcagacccaggtcttcatttctctgttgctctggatctctggtgcctacggggacatcgtgatgacccagtctccagactccctggctgtgtctctgggcgagngggccaccgatcaactgcaagtccagccagagttgttttagacagctccaacaataagaactacttagcttaggtaccagcaagaaaccaggtacagcctacctaagctgctcatttacgngggcactcgtacccgggaagttcccggggaccctcgtaccgtagttacgacggttacggcgtaggcggggttcgtacggggaaccgtacggtacttttacccacgttacccgtacgaacccgtaagttcccgaaggcctaacgtcccgttaggacctacgggtaccgttaaggaaacggtcgttacggtacgggtaccgtttaacggtttttaacgttcgggtaaccgttacggtaccgttaaacggtaaccttaaacggttttaaattttaacgttaacctttaccgtttacccggttacccgttaaaccgtttttccgggacccgggtttaacgggtaaaccttaaacgggttaacggtaacttaaccgttaaccgtaaaacgtaacggttcggtaccggtaccgtaaccgg

SEQ ID NO: 116597 - DNA, 534 bp, Homo sapiens
  misc_feature: GYAE6OF02I4WER.45.37.D04.1.454.CMB.1.raw
  modified_base (265)..(265): a, c, t, g, unknown or other
  misc_feature (265)..(265): n is a, c, g, or t
  modified_base (423)..(423): a, c, t, g, unknown or other
  misc_feature (423)..(423): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttancttggtaccagcagaaaccaggtcagcctcctaagctgctcatttacgtggacactacgtacccgggaatcccggggtccctggaacccgattcaaggtggacaggcgggtctgggacagatttcactctcacatcagcagctgcaggctgaacgtangtgctaagtttntcgntcgtnagtcaattnttattaatacttcctccgtacttcggcccgttaggaccgtaaagtcggtaactagtacgaaactacgtgtacggtctacgg

SEQ ID NO: 116598 - DNA, 622 bp, Homo sapiens
  misc_feature: GYAE6OF02ISLUJ.45.37.D04.1.454.CMB.1.raw
  modified_base (228)..(228): a, c, t, g, unknown or other
  misc_feature (228)..(228): n is a, c, g, or t
tcagacgcgatcgacacgaccggtgctcgatttagtagcatactgttgggtttggggagagcatcacccagcaaccacatctgtcctctagagaatccctgagagctccgttcctcaccatggactggacctggaggatcctcttcttggtggcagcagccacaagagcccactcccaggtgcagctggtgcagtcgtggggctgaggtgaggaagcctggggcctcngtgaaggtctcctgcaggcttctggctacaccttcaccggcgactatctccacgtgggtgcgacacggccctggacaagggcttgagtggagtgggagtggataccgaaacctaaacgaagtggtggacaacaaacgtagtacgacgaacgagtaacgtttacgaggggacgagggttaccaccgtaatacgggaaccgaagggaccgtaaccggtaccctaataccgaacgtaccgaaccgagtaccccgtaagtaggttacgggaacgtcgtaggaacgtacgaacggttaaccgtcgaacctagtaccgtacgacggtaccgaaccggtacctagttttactacgtgtacgacggtagtacgtttacggttaccggttggtcgtttacggg

SEQ ID NO: 116599 - DNA, 706 bp, Homo sapiens
  misc_feature: GYAE6OF02H6VQY.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtcgccgtacggggacatcgtgatgaccagtctccagactccctggctgtgtctcgtgggcgagacggccacatacaactgacaacgtcagccagagttagtttagacagctaccaaacaataaagaacctacttagtcgttacgtaccagacaacgaaaccgaggtcaacgcctacctaagcctgctacgtatttacgtgggctacgtaccgtacccgggtaacgtcccggggtccctacggtaaccgtagttacgaggtcggacgaggtcgggttcgtagggactagtactttcacgttctacccaactacgtaccgacgccgtacggtccgtacggaccgtacgggtacgttacggaaaggtacgttacgggtacgggtacttaaacggttttgttcgtaccgttacggtacgtaagtacttaaatttaactttaagtttaactttacgtttacccgttacccgttaccggtttaccggtcccggttaaccgggtaaccggtaaacggttaacgtaacgttaacgtaaaccgtaaaaccggtaccgttacggttacggcgttacccg

SEQ ID NO: 116600 - DNA, 577 bp, Homo sapiens
  misc_feature: GYAE6OF02HC1ZG.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttagacagctccaacaataagaactacttagcttggtaccagcagaaaccaggtcagcctacctaagctgctctatttactgggcatccgtacccgggaatcccggggtccctgaccgattcgagtggcaggcgggtcgtgggacagtatttccactctccaccatcagcagcctgcaggctgaagtgtgtggctagttttagttgtcgtgtcgatacgtaattaattatttaattactttcccttcccgttaccgtttccggtacccgttacgggtaacctaaaggttcggtaagttacgttaaccgtaaaccgttaacgttcggttacggtacgtaccgg

SEQ ID NO: 116601 - DNA, 632 bp, Homo sapiens
  misc_feature: GYAE6OF02H4P7Q.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcgagtgaaggtctctgcaaggcttcgtggctacaccttcgaccggcgactactcctccacgttgggtcgcgacacggcccctggacaacgggtcttggagtggagtgggatggataccgaaaccctaacaagtggtaggaccaaacgaaacgtagtcgaccaaagtacggtaaacgtttcgaacggggactacggggtacccaacccgtagtcggaacccggagggaacctacccggtaccaagtccgaacgtaccgaacgacgacctaacgagtacggagtcgtagacgtacgagtactagacctatccgacgaccgacgaccggtactacgttttaagtacgtagtacggacggtaggtacgtttacggtttacccgggtgttacccggttggtttttacccgg

SEQ ID NO: 116602 - DNA, 579 bp, Homo sapiens
  misc_feature: GYAE6OF02HRR96.45.37.D04.1.454.CMB.1.raw
  modified_base (314)..(314): a, c, t, g, unknown or other
  misc_feature (314)..(314): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcaagaaaccaggtcacgcctccaagctgctcatttacngggcatcgtacccgggatccggggtcctgaccgattgagtggcaggcggggtcttggggacagtactttcgactctccaccatcgacgcagtcctgacgacggtctagaagattaggtggtcttaagttttgtagtcgttcgtactacgtaactaaatttaattaattattacttcccgttaccgtaccgttttaccggccccgttagggaaaccctaaaggttacggtaataccgttacgaaaaccgtatacggttggctacgg

SEQ ID NO: 116603 - DNA, 541 bp, Homo sapiens
  misc_feature: GYAE6OF02HGL9H.45.37.D04.1.454.CMB.1.raw
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (535)..(535): a, c, t, g, unknown or other
  misc_feature (535)..(535): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactactagcttggtaccagcagaaaccaggtcagcctctaagctgctcatttacgtggcatcgtacccgggaatcccggggtccctgaccgattcagtggcgagcgggtctgggacagtatttcactctccacatcagcacgcctgcgaggctgaagtntggngactagttttatgctgtacagtactaattattataattcttcctaccgtacgtttccggcccgttacggaacctaaaggttcggaattacgtaaccgaaacgtaccgtaggttcggntaccgg

SEQ ID NO: 116604 - DNA, 717 bp, Homo sapiens
  misc_feature: GYAE6OF02IVT7U.45.37.D04.1.454.CMB.1.raw
  modified_base (316)..(316): a, c, t, g, unknown or other
  misc_feature (316)..(316): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagacgtgtttagacagctaccaacaataagaactacttagcttggaccagacagaaaccaggtcacgcctactaagctcgctacatttacngggctagtccgtaccgggaactccggggtaccctgaccgtattccgacggtggccgaggtccgggtcgtacgggactaggtacttttcgacttcctctaaaccgacttacgaacgtaccgtaacggtacccttcggaccgtaacgggtaccttacgggaaaacgtacggttacggtacgggtacctttaagggttttaacgtttgtacctttacgggtacctaaacgggtaacttaaacgtttaaacttttaactttaaacgtttaacccttttccccgtaccgggttaaccgtttttcccgggtacccccggtttaagggtaaacccggttaaacgtttacggaaacgtttacgttaaccggtaaaaacgttaccggtacggttacgggtccttaaccgg

SEQ ID NO: 116605 - DNA, 633 bp, Homo sapiens
  misc_feature: GYAE6OF02HAM53.45.37.D04.1.454.CMB.1.raw
  modified_base (320)..(320): a, c, t, g, unknown or other
  misc_feature (320)..(320): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccaggccagagttgtttagacagctaccaacaataagaacttacttagcttggtaccagcaagaaaccaggtcagcctactaagctgctacattttacgngggcacgtccgtaacccgggaagtcccggggtccctaggaccgtattccgaggtcggcgacggtcgggtcgtaggggacaggtactttacgacttctaccgacctactcgacgcacgtcccgtgccgaggctaaggaagtacgttggtcggtacttaggtttattcggcgttacgtacgaagtacttaaattatttaattaacttaccgttcccgttacggttacccgtttccggaccccggttaacgggaacccgtaaaggtcgttaactaacgttaaccgaaaaccgtacgttcggtacggtctaacccgg

SEQ ID NO: 116606 - DNA, 513 bp, Homo sapiens
  misc_feature: GYAE6OF02ISI99.45.37.D04.1.454.CMB.1.raw
  modified_base (444)..(444): a, c, t, g, unknown or other
  misc_feature (444)..(444): n is a, c, g, or t
  modified_base (493)..(493): a, c, t, g, unknown or other
  misc_feature (493)..(493): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggagcctggggcctcagtgaaggtctcctgcaaggcttctggctacaccttcaccggcgactatctccactgggtgcgacaggcccctggacaagggcttgagtggatgggatggatcaacctaacaagtggtggcaacaaactatgcacagaagtttcagggcgagggtcacagtgaccagggacacgtccatcagcacacgcctacgagtggagctgacgcaagactacgacatcngacgacacgctagtttacttactgtgacgtagtgttacggtttaccggnggtcgttggtttctttacgg

SEQ ID NO: 116607 - DNA, 566 bp, Homo sapiens
  misc_feature: GYAE6OF02IABAT.45.37.D04.1.454.CMB.1.raw
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
  modified_base (424)..(424): a, c, t, g, unknown or other
  misc_feature (424)..(424): n is a, c, g, or t
tcagacgcgatcgacacgaccggtgctcgatttagtagcatactgttgggtttgggggagctacaacaggcaggcaggggcagcaagatggtgttgcagacccaggtcttcattttctctgttgctctggatctctggtgcctacggggacatcgtgatgacccagtctccagactccctggctgtgtctctgggcgagagggccaccatcaactgcaagtccagccagagttgttttagacagctccaacaataagaactacttagcttggtaccagcagaaaccaggtcagcctcctaagctgctcatttcgtgggcagtcctacccgggtaactcccggggtaccctggaccgtnttccgagtggcaggcgggtcngggacagtatttcacttcnccacatcagcagcctgcaggctgaanagtgtcggtactaggtttactgctgtacgtatactaaattattatttattacttccctaccgttacctttaccgggtcccgttaggtaacccgtaaaggtcgtaattaacttacgaaaaccgttagtcggtacggtctacgg

SEQ ID NO: 116608 - DNA, 751 bp, Homo sapiens
  misc_feature: GYAE6OF02H5OLY.45.37.D04.1.454.CMB.1.raw
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (555)..(555): a, c, t, g, unknown or other
  misc_feature (555)..(555): n is a, c, g, or t
tcagacgcgatcgacacgaccggtgctcgatttagtagcatactgttgggtttgggggtaggcgtacaacaggcaggcaggggcgagcaagatggtgttgcagacccaggtcttcattctctgttgctctggatctctggtgccgtacgggacatcgtgatgacccagtctccagacctccctggctgtcgtctcgtcgggcgagacgggccaccatcaatgacaagtcagccagacgtagtttanacgagctaccgaanaactaagaactacgttagcttaggtaccagactaacgaaaaccaggtcacgtccctaccgtaaancgtgcctacgtatttaccgnggtactaacgtcccgtaaccggggaacttccccgggggttccctaggtaccgtacttacgtacgggtacgggtaccgacgggtaccgggtcgtacgggggtaccgtaaggtactttttccgaaccgtcgtacctaacccggtacttacgaacgtaccgtaacgcccgttcgacggaggtccgtaaagggtacgaacgttggtaccgggtntaaccgggttttagtacggtcccttagggttaccacggtaaccttaaagttaacgtttaacttaattaacccgtttaccctacccgggtttaacgttttccccgggtccggttaccggggttaacccaaacgggtttacgacgtttaacgtaaaccggtaaaccggttaccgtttggtacccgggtacttaccggg

SEQ ID NO: 116609 - DNA, 631 bp, Homo sapiens
  misc_feature: GYAE6OF02HBB8V.45.37.D04.1.454.CMB.1.raw
  modified_base (318)..(318): a, c, t, g, unknown or other
  misc_feature (318)..(318): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaaacaataagaactacttagcttggtaccagcaagaaaccaggtcagcctacctaagctgctactattacgnggactactaccgtacccgggacgtcccggggtccctacggaccgtacttcgaggttcggcgtacggtcgggtcgtacgggacgagttacgtttccactcctaccacctactcacgcacgcctggccgaggctaaggaacgtagttggtacgtacgtttaggttttactcggtacgttacgtacaacggtacttaaagtttatttaaactttaacgttacctttcccgttaccgttaccgttttccgggaccccggttaaggtaaccgtaagtcggtaactactaaccgtaaacgtacgtggtacgtactaccg

SEQ ID NO: 116610 - DNA, 616 bp, Homo sapiens
  misc_feature: GYAE6OF02FQ5N5.45.37.D04.1.454.CMB.1.raw
  modified_base (289)..(289): a, c, t, g, unknown or other
  misc_feature (289)..(289): n is a, c, g, or t
  modified_base (345)..(345): a, c, t, g, unknown or other
  misc_feature (345)..(345): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcagtgaacggtctctgcaggcttctggctacaccttcaccggcgactatctccacgtggtgcgacnggccccgtggacgaagggtcttgagtggagtgggagtaggactacaaacccgtaanagtggtgacaacgaaactagtgacaactaagtacgtttcgacgggcgtacgggtaccaacgtagtacgaccgacgggacaccggtaccagtcgacgcacgacgaccgtaacagtcggacgtcgagacgacgacgtacgtcgaacgtactccgtacgaaccgtaccgaccggtaccttacgtttttaacgtacgttcgggtacggaggttacggttacgtttaccgggtttaccgggttacggttcgttttaccggttttcgtttaaccggg

SEQ ID NO: 116611 - DNA, 502 bp, Homo sapiens
  misc_feature: GYAE6OF02HOX7J.45.37.D04.1.454.CMB.1.raw
  modified_base (339)..(339): a, c, t, g, unknown or other
  misc_feature (339)..(339): n is a, c, g, or t
  modified_base (422)..(422): a, c, t, g, unknown or other
  misc_feature (422)..(422): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaaccctaanaatggtggcacaaactatgcacagaagtttcagggcagggtcacatgaccagggacacgtcatcagcacagcctacataggancgtgagcagactcgacagtctagaccgacacggctatttactactgtagcgaggtattggtttaccggtgtcgtttacgg

SEQ ID NO: 116612 - DNA, 592 bp, Homo sapiens
  misc_feature: GYAE6OF02HEOAY.45.37.D04.1.454.CMB.1.raw
  modified_base (254)..(254): a, c, t, g, unknown or other
  misc_feature (254)..(254): n is a, c, g, or t
  modified_base (373)..(373): a, c, t, g, unknown or other
  misc_feature (373)..(373): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctgggggctgaggtgaggaagccgtggggcctcgagtgaaggtctctgcaaggcttcnggctacaccttcaccggcgactatcctccgactgggtgcgacacggcccgtggacgaaggcttgagtgagtggatggataccaaccctaacgtaagtggtagacaacaaactatgacanagtaagtttcgacgggtcgacgggtacaacgtagtacgaccgagggaccacgtccactcgacgaccacgacgacctacgagtggacgtacgtgacgcaacgtacgtagactaagtcgtacggacgtaacgaccggtaaccttaagttttaacgtacgttcggtaggtacggaacggttacgtttaccgggtttaccgggtcggtttacggttttccggg

SEQ ID NO: 116613 - DNA, 822 bp, Homo sapiens
  misc_feature: GYAE6OF02JQSAG.45.37.D04.1.454.CMB.1.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
  modified_base (345)..(345): a, c, t, g, unknown or other
  misc_feature (345)..(345): n is a, c, g, or t
tcagacgcgatcgacacgaccggtgctcgatttagtagcatactgttgggtttgggggaggatacaacaggcaggcaggggcagcaagatggtgttgcagacccaggtcttcatttctctcgttgctctggatctctggtgcctacggggacagtcgtgatgacccagtctccagactccctcggctcgtgtctctgggcgagngggccaccagtcaactgacgaacgtccgacgccaggtacgtgtttagacacgctaccaacaanaacgtaactactacgcttcggtaccagcagaaccgaggtcacgtaccctccgtaagcctcggcttactacgtttacgngggtactactccgtaacccgggaacgttcccgggtacccgtacgtaccggtacttcgacggttcggacgtacgggtccggggttccgtacggggtacctaacgttacgttttaccgaccgttacctaacccggtaaccctaatcccggaacgtacctaaccgggttcccgtaaacggtccccggtaagggttacccgtaaacggttaaaggttcggttaccggggtttaacgggaccttttaaaggggttttttaaccgtccggggtttaacccttgggttttaaaccccgaacggtaaccgttttaaaactttaagtttttaaacggtttaactttacccgttttccccgaccgggttttaacccgtttaccccgggggtacccgtttaaaccgggttaaccgtaaacggttacggtaacttaaccgtttaaccgggaaaaccggttaacgttcggggttacgacccgttaaccgg

SEQ ID NO: 116614 - DNA, 568 bp, Homo sapiens
  misc_feature: GYAE6OF02IDP71.45.37.D04.1.454.CMB.1.raw
  modified_base (321)..(321): a, c, t, g, unknown or other
  misc_feature (321)..(321): n is a, c, g, or t
tcagacgcgatcgacacgaccggtgctcgatttagtagcatactgttgggtttgggggagctacaacaggcaggcaggggcagcaagatggtgttgcagacccaggtcttcattttctctgttgctctggatctctggtgcctacggggacatcgtgatgacccagtctccagactccctggctgtgtctctgggcgagagggccaccatcaactgcaagtccagccagagtgttttagacagctccaaacaaataaagaactacttagcttggtaccagcagaaaccaggtcagcctacctaagctgctctaatttacgngggctactccgtaacccgggaatcccggggtccctggaccgtattcgaagtcggcaggccgggtctaggggactaggtcttttcactctcaccagtcacgtcacgcctgctaggcttagaagtatggtgactagtttatggtctgacacgtctaattattattatacttcctaccgtacgtttccggcccttagggaacctaaaggtgtaattacgtacgtaaaccgtacgtacggtacgtcgtacg

SEQ ID NO: 116615 - DNA, 733 bp, Homo sapiens
  misc_feature: GYAE6OF02IPFVD.45.37.D04.1.454.CMB.1.raw
  modified_base (529)..(529): a, c, t, g, unknown or other
  misc_feature (529)..(529): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtcgccgtacgggacatcgtgatcgaccagtctccgagacctccgtggctgtcgtctcgtggcgagacggccacatacaactgacaacgtccagccagtagttagtttagacacgcctaccaaacaataaacgtaactaacttacgtacgtttacggaacctagacgaaacgaaaccgtacggtccaccgtacccttacgtaacgtctacggtacctactaacgtttacggcggtacctacgttacccgtaaacccggggtaacgttccccggggtaccctcggtaaccgttaacgttccgtagggtcggacgtacgggtacccgggtggtacgggaacgtacgttaccgttctacgtacctaccgaactacgtcgacgtaccgcgtacccgngtacggaccgtgtaacgtaagtgttaccgggtagtacttttaaggtttcgacgttaccgttagtaccgtaagtacctttaaagttacttttactaacgtttaccgtttaccctcgggtaccttttcccggacggtaaccggttaacgaaacggttagtaacgtaaccttaaacgaacgtacgttacgggtacgtacctaaccgg

SEQ ID NO: 116616 - DNA, 715 bp, Homo sapiens
  misc_feature: GYAE6OF02IMERT.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgacaagtccagccagagttgtttagacagcctaccaacaaataagaactactagtcttacgtaccagacaacgaaaccgaggtacacgcctcctaagctgcctctatttacgcggctacgtaccgtaacccgggtaacgtcccggggtccctacggaccgtattccgaggtcggacgtacgggcgggttcgtaggggtactacggttacttttccgactttccgtacccaacctacgtaccgaacgtaccgtaacgtcccgtggacccggtaagggtccgttaagggaaacgttacgttagggtacggtactttaagggttttagttccgtacggtttacgtacgacgtaacttaagtttaaacgtttaaacttacgtttaccgttcccgttacccggttaaccgttttcccgggcccgtttaacgggaacccttaaagggttcgtaaaacgttactaacccggtaaaacggtaaccggttggtacggtacccttacgg

SEQ ID NO: 116617 - DNA, 526 bp, Homo sapiens
  misc_feature: GYAE6OF02F31RL.45.37.D04.1.454.CMB.1.raw
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttagacagctccaacaataagaactatagcttggtaccagcagaaaccaggtcagcctctaagctgctcatttacnggcatccgtaccggagtccgggtcctgaccattcagtggcaggcggtcgtggacagtacgtttcactcgtacacatcagcagcctgcagctagatagtgngactagttatgntgtnagactaattattattagtacttaccgtccgttacgtttacggcccttagggaacctaaggttcgtaagttaactacgtaaacgtacgtcggttacgctacg

SEQ ID NO: 116618 - DNA, 608 bp, Homo sapiens
  misc_feature: GYAE6OF02ITV2D.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagtgttttagacagctccaaacaataaagaactactagcttggtaccagcaagaaaccaggtcagcctactaagctgctctatttacgtggactatcgtaacccgggtaactccggggtcctgaccgattcgagtggacgacgcgggtcgtagggacagtattccgactctaccgacctatcagccacgcctgcgaggtcctaaggaagtgtggtagtaccgttagttttactggctttaggtccaaaggtactaaatttagtttaaatacgtttactacccgttacccgtacgtttcccgggacccgttaggggtaaaccctaaagggtcgtaaccttaagtaaccgtaaacccgtagttacggcggttcacgtaacccg

SEQ ID NO: 116619 - DNA, 568 bp, Homo sapiens
  misc_feature: GYAE6OF02H5CCU.45.37.D04.1.454.CMB.1.raw
  modified_base (288)..(288): a, c, t, g, unknown or other
  misc_feature (288)..(288): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggcctcgagtgaaggtctctgcaaggcttctggctacaccttcaccggcgactactctccactgggtncgacacggcccctggacaaggcttagagtggagtgggatggactcaaaccctaacgaagtggtaggacaacaaacgtatcgacaagagtaagttcgagggcgagggtcaccgagtcgaaccgagggacacgtccatcgacgcacacgacctanagtcggagcgtaggacgacgagacttagaactagtccgtagaccgacgaccggtactagttttacttacgtgttagacgtaggtacgttacggtttaccgggtcgttaccgttcggtttttacccgg

SEQ ID NO: 116620 - DNA, 775 bp, Homo sapiens
  misc_feature: GYAE6OF02GEQA8.45.37.D04.1.454.CMB.1.raw
  modified_base (385)..(385): a, c, t, g, unknown or other
  misc_feature (385)..(385): n is a, c, g, or t
  modified_base (634)..(634): a, c, t, g, unknown or other
  misc_feature (634)..(634): n is a, c, g, or t
  modified_base (670)..(670): a, c, t, g, unknown or other
  misc_feature (670)..(670): n is a, c, g, or t
  modified_base (736)..(736): a, c, t, g, unknown or other
  misc_feature (736)..(736): n is a, c, g, or t
tcagacgcgatcgacacgaccggtgctcgatttagtagcatactgttgggtttgggggtaggcgtacaacaggcgaggcgaggggcgaggcgaagataggtgttggcagacccaggtcttcatttctctgttgctctggtatctctggttgctacggggacatcgtgatggacccagtctccagactccctggcctgtgtctctgggcgagacgggccaccgatccgaaactcgacgtaaagtccgacgaccagacggttacgtttttaaggacgtaacgcgttacccaaccaaataaacggaaacttaacttaacgtaccgtttagggttaacccacggtacaaggtaaaacccacgggtactaaggcccttacccgtaaaacnccgtagtaccgttctaaccgtttaaccttagggggacctaacgggttaccctaaaccccggggtaaagttcccccggggggtttacccttaccggggaacccgtaacggtttacccgtaaggtttccgggacgtacgaccggggtttccgcggggtaaccgtacgggtaacttttaccgactacggtttaacccaccgtactacccgtaaacgccgaacgtacctcggacgaacgtcgtacgacgtaangggttgaccgtagttagtagttcgagttccgacgtnaacgttattagttatacgtttcctacgtctttaccggccggttaaccgtccgtaaagtacggttanaagtttaccgaaacgtactacggttacggaccttaccgg

SEQ ID NO: 116621 - DNA, 675 bp, Homo sapiens
  misc_feature: GYAE6OF02H2N8H.45.37.D04.1.454.CMB.1.raw
  modified_base (328)..(328): a, c, t, g, unknown or other
  misc_feature (328)..(328): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgccgtacggggacatcgtgatgacccagtctccagactccctgactgtgtctcgtgggcgagagggccaccatcaactgcaggtccagccagtagttcggtttttaccggacccctaagtaagtaagaaaccttacttaagcttggtaccagcagaagccagggcagccctcctagcctgcttcttttacncgggtccttccgtacccgggtaggtcccgggtccctcgaccgattcgagtggcgaggtcgggtcgtggggcagtatttccgactctcacctatcacgtccacggtccctgaccgacggtccctaggaaacgtagtcggtaccgtacgtttaacgttttaacccttacgtcgtaccgtaaggtaaccttaaattaagtttaacgttggaacgtttaacctttacccgttacctttaaccgtaccggttttaccggggaccggggtaacgggtaaccggtaaaggttcggaccgtaacgttaaccgaaacggttaccgtgggtacggtaccgtacgtccaccgttaacg

SEQ ID NO: 116622 - DNA, 564 bp, Homo sapiens
  misc_feature: GYAE6OF02JPWYS.45.37.D04.1.454.CMB.1.raw
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagngtgttttagacagctaccgaacaataagaactacttagcttaggtaccagcagaaaccaggtcacgcctactaagctagcctctatttacgngggtcatccgtaacccggagtcccggggtccctgaccgattcagtcggcaggcgggtctgggacagtactttcacttccgtactaccagtcgagtacacgctgccaggtctaggtaagtgtcggtagtcgtagtttatcgtacgtgtacgagtctaaattattattacgtcgttccgtccgtacgttccggtccgtacggtacgaagttgtactactacggaacctggtagtcggtactacg

SEQ ID NO: 116623 - DNA, 502 bp, Homo sapiens
  misc_feature: GYAE6OF02HGGF9.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactggcatctacccgggaatccggggtcctgaccgattcagtgcagcgggtctgggacagattcactctcacatcagcagcctgcaggctgaagatgtgctagtttattgctgtcagctaattattattatattcctccgtacttcggcccgtggaacctaagtggatactacgaacgtactggtgtctagtac

SEQ ID NO: 116624 - DNA, 681 bp, Homo sapiens
  misc_feature: GYAE6OF02IS5K9.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagaggccaccatcaactgcaagtccagccagagttgttttagacgagctaccaacaaataagaaacctacgttagcttcgtaccagcaacgaaaacccgaggtaccacgccctacctaagcctgactctaatttaccgtgggtacctagtccgtaacccgggaacgttcccgggggtcccttgaacccgtactttacgacggttcggcgaggccgggttcgtaggggacagtacgttttccgactaccgttcaacccgtataccgaacggacctaacggtccctagaccggtacggtaccgtaggtaaagtcgttaggtacgggtccttaacggttttattcggcttacggtcaggtacttaaacgtttatttaaagttacttacgtttacccttccgttaaccgtttccgggtacccgttaacgggaaccctaaggttacgtaattacgtaacgttaaacgacggttacgtcggtcctaccgg

SEQ ID NO: 116625 - DNA, 674 bp, Homo sapiens
  misc_feature: GYAE6OF02H9ULP.45.37.D04.1.454.CMB.1.raw
  modified_base (230)..(230): a, c, t, g, unknown or other
  misc_feature (230)..(230): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatacaactgcagtcagccagngtgtttagacagctaccaacaataagaactacttagcttaggtaccagaccaagaaaaccaggtcacgcccttacctaagctcgcctacgtaacttttacgtcggggactacgtaccgtacccggggaacgttcccggggtaccctcggaccgtattcgaggttcggcgacggcggggttcgtcggggacaggtactttacccgaccgtcctacgaccctacttacacggcctacgcccttcggccgtaggtccgttagaaaggttagtagggtcggttacgtaggtttacgttggtccttgtacgtaacgtacttaaacgtttgttaatttaacgttacttaccccttaccggttaccgttttcccgggtaccgttacgggaaccgttaaacggtacgtaacttacgtaaccggaaaccgttacgtggttaccggtctaccgg

SEQ ID NO: 116626 - DNA, 566 bp, Homo sapiens
  misc_feature: GYAE6OF02FO27O.45.37.D04.1.454.CMB.1.raw
  modified_base (291)..(291): a, c, t, g, unknown or other
  misc_feature (291)..(291): n is a, c, g, or t
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaccccagtctccagactcccctggctgtgtctctgggcgagagggccaccatccaactgcaagtccagccagagtgttttagacagctaccaacaataaagaacttacttagcttggtaccagcagaaaccnggtcagcctctaagctgctcatttacgnggcagtccgtacccgggaactcccggggtcccngaccgatctaggtggcgaggcgggtcgtgggacagtatttcactctcaccatcagcacgcctcgccaggcctagaacgtatgtggctagtttaattgcttgtaccagactaataattattattacttaccgtcccgtacgtttccggtcccgtacgggtaacctaacgttagtaacttactaccgtaaaccgtacgtacggttaggtccgtacg

SEQ ID NO: 116627 - DNA, 665 bp, Homo sapiens
  misc_feature: GYAE6OF02IDTBM.45.37.D04.1.454.CMB.1.raw
  modified_base (257)..(257): a, c, t, g, unknown or other
  misc_feature (257)..(257): n is a, c, g, or t
  modified_base (392)..(392): a, c, t, g, unknown or other
  misc_feature (392)..(392): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctgaggtgaggaagccgtggggcctcgagtgaaggtctcctgcaggtcttcgnggctacaccttcgaccggcgactatcctccacgtggggtcgcgacgacggccccgtaggaccgaacgggtcttaggaggtggagtggggtagtcgggatacctaacccgtaagaagtggtcgactaacaaactancgacacgagtaacgtttcgagggtacgacgggtaccaccgtagtacggacgaacgggaccaacggtacctacgtaccgtacgaccgtaacgacgtacccgtaacaggttacggacggtaccgttacggaacgtaccgaaggtaaccgttacgaaccttaacgtaccgtacggacccggtaaccgtaccgggtacctttaagttttaaccgttacggttagtaccggtacggtacggtagtttccggggttacggttcggtacgtttttccggg

SEQ ID NO: 116628 - DNA, 635 bp, Homo sapiens
  misc_feature: GYAE6OF02FZ7YC.45.37.D04.1.454.CMB.1.raw
  modified_base (469)..(469): a, c, t, g, unknown or other
  misc_feature (469)..(469): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggcccaccatcaactgcaacgtccacgccagagttgttttagacagctccaacaataagaactacttagtcttaggtaccagcaacgaaaccaggtacacgcctacctaagctgcctacatttacgtggactactaccgtaacccgggaagtcccggggtccctcggaaccgtattcgagtcggctaggcggggtctaggggacctagtactttcactcctaccacctactcacgcacgtcccgtgaccgaggaccttaggaacgtntacggtggtacgttaggttttacttggtacgttggtacgtagaccttaaattattttaacgttaattcgtttaccctcgtttaccggtttcccggtcccgttaacgggtaacctaaacggttacggtaacttacgtacctaaaacgtcgttacggtcgtacgtccg

SEQ ID NO: 116629 - DNA, 621 bp, Homo sapiens
  misc_feature: GYAE6OF02H9Z33.45.37.D04.1.454.CMB.1.raw
  modified_base (323)..(323): a, c, t, g, unknown or other
  misc_feature (323)..(323): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttagacagctaccaaacaataaagaactacttagcttaggtaccagcaagaaaaccaggtacagcctacctaagctgctctatttacngggcaactccgtaacccgggaacgtccgggggtaccctaggaccgtattcgaggtggacacggcgggtactggggacaggtatttccgactctacaccgatccgagcagccctgcgaggctaggaagatggtggactagtttattcgacttgtacagacctaaattacgtttaatatttaacgttccctaccggttaaccgttttccgggccccgttaaggggaaacccgtaaaaggttacggtaagttaacgtaaccgtaaaaccggttaaccttacgggttacgggccttaaccgg

SEQ ID NO: 116630 - DNA, 704 bp, Homo sapiens
  misc_feature: GYAE6OF02J0Q6M.45.37.D04.1.454.CMB.1.raw
  modified_base (333)..(333): a, c, t, g, unknown or other
  misc_feature (333)..(333): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaacgtccagccagtagttgtttagacacgcctaccaacaataacgaaactacttagccgttgtaccagacaacgaaacctaggtcacgtccctactaagcctgcttactactttacgngggtaccacgtaccgtaacccgggtaacgtcccggggtccctagaccgtattcgaggtcggacgtacggtcgggtacgtagggactagtacgtttcacctctaccacctagtaccgtacgcctaacggtcccttggaaccgtcgggacttacggaaggtacttacgggtcgggtaactttaggttttaaccgttggttcccgttacggttacgaacgttaacttaacttttaacgtttaacgttacttaacccgttttccccgtaccggtttacccttttacccggggtacccttacgggtaaaccgtaaaccggtttgtaacttaccgttaacgtaaacccggttagttacgggttacgtacttaaccgg

SEQ ID NO: 116631 - DNA, 731 bp, Homo sapiens
  misc_feature: GYAE6OF02H90EH.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggccaaccatacaactcgacaacgtccagccagagttagtttagacagcctaccaaacaaataaacgaaactaacttagtcgttacggtaaccaacgacaacgaaaacccgtaggtaccacgtcccttacctaagctcgactactaagtttacgtcggactactaccgtaacccgggaacgtcccggggtacctcggtaccgtacgttacgacggttcggacgacggtcgggttacgtacggggtacaggtacttttacaaccgtttctaccgtaaccctaacgttacaacggtacgtaaccggtacccgtacgggacgtaacgggtccgttaagggaaacggtaacgttcgggttaacgggactttaaaccggttttaacgttaccgttagggtactaaacggtacttaaagtttaattacgtacgtagttaactttccctacgtacgtttacgttcgggaacggtacgggtaacccttaaggtacgtacggtacaaccgtaaaccggtacgttacggcgtaccg

SEQ ID NO: 116632 - DNA, 610 bp, Homo sapiens
  misc_feature: GYAE6OF02F3FS3.45.37.D04.1.454.CMB.1.raw
  modified_base (336)..(336): a, c, t, g, unknown or other
  misc_feature (336)..(336): n is a, c, g, or t
  modified_base (439)..(439): a, c, t, g, unknown or other
  misc_feature (439)..(439): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacgacacgctaccaaacaaataaacgaacttaacttagtcttggtacccagacaagaaacccgaggtacacgtcctacctaagctcgctactatttacgnggactacgtacccgtacccggggaacgttcccggggtccctacggaccgtagttccgaggtcgcgacggcgggtcgtagggacagtactttcacttcaccacntcagacacgtcctgcacgctaaggactgtaggtcgtacgttagtttatcgacgttcgagacgtagtaaactttattaactttattaccttccttaccgttaccgtttccggccgttaggaaccctaagtcggtaactacgttaaccaaacggtcttacggtcgtactaccg

SEQ ID NO: 116633 - DNA, 632 bp, Homo sapiens
  misc_feature: GYAE6OF02HDFS4.45.37.D04.1.454.CMB.1.raw
  modified_base (356)..(356): a, c, t, g, unknown or other
  misc_feature (356)..(356): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaggtctctgcaaggcttctggctacattccttcgacggcgactatctccacgtgggtgcgacacggcccctggacaagggcttgagtggagtgggatggatcaacctaacagtggtcgacaagaaactntacgcacagtaacgttacgacgggtacagggtaccaccgagtacggaaccaacggggtaacccacggttacccaacgtaccgaacgaccgaaccgtacgaccctaacgtagtacgggaacgtacgtacggacggacaacgggtaactaccggtactacgttacctacgggacgtacccgaaccggtaccttaatttaacccgttacggttagtacggtaggtaacggtacggttaccggtttaccggttacggttccggtttcggtttttacccgg

SEQ ID NO: 116634 - DNA, 735 bp, Homo sapiens
  misc_feature: GYAE6OF02JLWYU.45.37.D04.1.454.CMB.1.raw
  modified_base (164)..(164): a, c, t, g, unknown or other
  misc_feature (164)..(164): n is a, c, g, or t
  modified_base (307)..(307): a, c, t, g, unknown or other
  misc_feature (307)..(307): n is a, c, g, or t
  modified_base (532)..(532): a, c, t, g, unknown or other
  misc_feature (532)..(532): n is a, c, g, or t
tcagacgcgatcgacacgaccggtgctcgatttagtagcatactgttggggtttgggggagctacaacaggcaggcagggcagcaagatggtgttgcagacccaggtcttcatttctctgttgctctggatctctggtgcctacgggacatcgtgatcgacccngtctccagacctcctggtctgtgtctctcgggcgacgacggcccacatcgaactgactaacgtccacgaccagtacgttcgtttacgacgtacgcctaaccaaacaaataacgaacctacttacgtacgtacggtacccgaanccgaagtaaaccccgtaggttaccaccggtacccttaccgtaacgccgtcgtaccttactaacgtttaccgtcgggactaccggttaccccggtaacccggggttaccggtcccggggttacccgtacggtacccgttacgttaaccggtggttaccggcggtaccgggtccgggttaccgtacggggacctaggttaccttttacgaccttcgtaccctaaccncgttacgacgtcgtaccgtccgtacgcgtaacgccgtagtaacgtcgttaggtcgtacgttggtttaacgttcggtacgtcgaccgtaagtaccgttaattacgtttaatacttcgttaacccgttcgtccgttaccggtaccggtaaccgtagtaaccgttcggtaattaccgaagtaaccctagtcgttacgcccttaagg

SEQ ID NO: 116635 - DNA, 778 bp, Homo sapiens
  misc_feature: GYAE6OF02ITMCC.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatcgacccagtctccagactccctggctgtgtctcgtgggcgaggacgggccaccatcaactgacaacgtccagccagtagttgtttagacacgcctaccaaactaaataaacgtaacttaacttaacgcgtttaggtaacccagacgaaacgaaaacccgtaggtaccacgtaccctaccgtaacgcctggtaccttactaacgttttaacgtcggggtacctaacgttacccggtaaccccggggtaacggtccccgggggttaccctacggtaaccgtacttccggaaggtcggtaccgtacgggtccgggtcgtacggggtactaggttaccttttccgtaccttcctacccgtaaacctactaccacggtaccacgtccgtcggaccgacggtcgtaagaacgtagtcggttagtctttaagtttactcgtcgtacgtcgtaaacgtaaccgttaaattttagttttaacttaaagttcccttttaccccgtacccggtttaacgtttaccccggggtcccgtttaacggggaaaaccgttaaacgggttacggttaaacttaaaccggtaaccgttaaaacgggtacctttacgggttacgggtaccttaaccggg

SEQ ID NO: 116636 - DNA, 673 bp, Homo sapiens
  misc_feature: GYAE6OF02JH916.45.37.D04.1.454.CMB.1.raw
  modified_base (196)..(196): a, c, t, g, unknown or other
  misc_feature (196)..(196): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgngacgggccaccatcaactgcaagtccagccagagtgttttagacagctccaacaataagaactacttagcttggtaccagcagaaaccaggtcagcctctaagctgactctattactgggcatccgtaacccggatccgggtccctgaccgtattcaggtgcgagtcgggtctagggactagtactttcacctctaccacctatccgagtcacgtccctagccgaaggtccttagaaacgtgttacgtcggaccgttaaggttttacgttcggacctttggttaccgacgtaacgttaaactttaacgtttacttttaaactttaccgtttccccgtttaccggttacccgtttttacccggggtacccccctttacgggggtaaaaccccttaaagggtttacgggttaaacttaaccgttaaacccgtaaaacggtaaacccgtttacggggtttacggacccggtttaacccgg

SEQ ID NO: 116637 - DNA, 682 bp, Homo sapiens
  misc_feature: GYAE6OF02JR20E.45.37.D04.1.454.CMB.1.raw
  modified_base (320)..(320): a, c, t, g, unknown or other
  misc_feature (320)..(320): n is a, c, g, or t
  modified_base (546)..(546): a, c, t, g, unknown or other
  misc_feature (546)..(546): n is a, c, g, or t
tcagacgcgatcgacacgaccggtgctcgatttagtagcatactgttgggtttggggtaggagcatcacccagcaaccacatctgtcctctagagaatcccctgagagctccgttcctcaccatggactggacctggaggatcctcttcttggttggcagcgagccacaagagcccactcccaggtgcagctggtgcagtcgtggggctggaggtaggaggaagccgtggggcctcgaggtgaaggttcctcctgcgaacggtcttcgtggcctacgtaccttccgaccggacgtactactcctcctacgttggggtacnccggacgaccggccccgtaggaccgaaagggtcttacggtagtgggtacgtggggatgggactaacctaacccgtaacgtagtggtagccaaagtaaactagtcacgaacgtagtaacgtttcgagggaccgaggtcaaccgtagcggtaaccggagggacctacggtaccagtacaaggttacccaaggaccgtaaccactagggtaagacgtccgtaagggtanaaccgtacgtaacctgacctaacgtagtacccggactaacggtcccgtaaagttactttttagtaaccggttgtaaccggtgggtaaacggttttccgttaccgggttttaaccgggtcggtttaccggtttacgg

SEQ ID NO: 116638 - DNA, 770 bp, Homo sapiens
  misc_feature: GYAE6OF02JTHWX.45.37.D04.1.454.CMB.1.raw
  modified_base (168)..(168): a, c, t, g, unknown or other
  misc_feature (168)..(168): n is a, c, g, or t
  modified_base (199)..(199): a, c, t, g, unknown or other
  misc_feature (199)..(199): n is a, c, g, or t
  modified_base (217)..(217): a, c, t, g, unknown or other
  misc_feature (217)..(217): n is a, c, g, or t
  modified_base (547)..(547): a, c, t, g, unknown or other
  misc_feature (547)..(547): n is a, c, g, or t
tcagacgcgatcgacacgaccggtgctcgatttagtagcatactgttgggtttgggggaggagcatcacccagcaaccacatctgtcctctagagaatccctgagagctccgttcctcaccatggactcggacctgggaggatcctcttcgttggtggcagcagccanaagagcccactcccgaggtgcagtcgtggtncgtagtcgtggggctggnggtggacggaacgccgtggggacctcgagtggacggtctcgtgacgaggtcttcgcgtctacctccgttacgaccggtacgacttactccgtaccacggttcggggtcgaccggtaccgaccgggtccccgtaggaacggacgggtacttgggtaacggtgggaagtacggggatacgggtctaaaccgaacccgttaacgaaggttccgggaacgtaccgtaaacaagtttacgacggtacacgggttaacgtaaccggtcggtaacggggtacgaacgggttactaacggtacgtaggaaccgggtacggaaccgtacgtactaacgnggtaaaccgtaggaacccgtacgtacgttaaacgcgggtaacgggtccaccggttacgggtactaaccggtaaggtaccgtaacgtaaaccgttcggtaaccgggtaaccgtacggtaacccggtaacggttcccggtttaaactttaacgtccgggttaaacggcggtaaccggttacgggaaccgttaacgggttacgttaacggttttaacgtttacggg

SEQ ID NO: 116639 - DNA, 581 bp, Homo sapiens
  misc_feature: GYAE6OF02GPS8M.45.37.D04.1.454.CMB.1.raw
  modified_base (387)..(387): a, c, t, g, unknown or other
  misc_feature (387)..(387): n is a, c, g, or t
  modified_base (441)..(441): a, c, t, g, unknown or other
  misc_feature (441)..(441): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctgctgtgtctctgggcgagagggccaccatcaactgcaagtccagccagagtgttttagacagctccaacaataagaactacttagcttggtaccagcacgaaaccgaggtacagcctctaagctgctctatttacgtggacacgtaccgtacccgggtaacgtccggggtccctagaccgtacttcgagttggacgaggtacgggtcngggacagtactttacactctacaccatcgagtcagcctgacagcttaggaagtntagtgactagtttacgtcgacttcgacgtcgagtaaacttatttacgttaacttacttccgttacccgtaccgttttccggcccgttacggtaacctaaagtcggtaattactacgtaaaccgactggtacggactacgg

SEQ ID NO: 116640 - DNA, 695 bp, Homo sapiens
  misc_feature: GYAE6OF02GF9CF.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggagggccaccatacaactgcaacgtccagccagagttgtttagacagctaccaaactaaataacgtaactaacttagtctttacggaaccacgacaacgaaaccgaggtaccacgcctacctaagctgactactacttacgtggacacgtaccgtaaccggtacgtcccgggtaccctacggaccgtacgtcgtaggtcggcgacgggtcgggtacgtacgggacctaggttcttaccgtacctctacacctaagaccgacgacgtacgtccgtacggaccgtaacgggctaaggtaacgtacgttcgggtaacgtcgtttaagtttacttcggacgttcggtaacaggtaaccttaaagtttacttaaacgtttacttaacccgttaccggttaaccctttccggttaccgggtaccccgttacggggaaacccttaaggtacggtaacttaacggtaacctaaacggtcgttacggcggtacctaccgtaacccg

SEQ ID NO: 116641 - DNA, 561 bp, Homo sapiens
  misc_feature: GYAE6OF02F77IL.45.37.D04.1.454.CMB.1.raw
  modified_base (341)..(341): a, c, t, g, unknown or other
  misc_feature (341)..(341): n is a, c, g, or t
  modified_base (366)..(366): a, c, t, g, unknown or other
  misc_feature (366)..(366): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaactggtgcagtctggggctgaggtgaggaagcctggggcctcagtgaaggtctcctgcaaggcttctggctacaccttcgaccggcgactatctccactgggtcgcgacacggcccctggacaagggcttgagtggatgggatggactcaacctaanaagtggtaggcacaaactatgacanagtaagtttcgagggcagggtcacatgacagggacacgtaccatcagcacagcctacagtgagctagacggcagacgtggacctagtacgtcgaccgaaccgacggtacctaagttttacgttacttggtcgacggtaacggtagtttcggttttaccggtggttaccgttttcgggtttacccgtttttacggg

SEQ ID NO: 116642 - DNA, 794 bp, Homo sapiens
  misc_feature: GYAE6OF02H03TX.45.37.D04.1.454.CMB.1.raw
  modified_base (344)..(344): a, c, t, g, unknown or other
  misc_feature (344)..(344): n is a, c, g, or t
tcagacgcgatcgacacgaccggtgctcgatttagtagcatactgttggggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtggggcgaggacgggccaccatcaactgacaagtccagccagagttagtttacgacagcctaccaaacaaataaagaacttacttagcttaggaccaggacaacgaaaccgagtacacgcccttacgtaacgctcgacctactatttacgnggactaacgtaccgtaacccgggaacgtcccggggtaccctacggaccgtagttaccgaggtacggacgtacgggtaccgggttcgtacgggggtaactacgggttaactttttaccgaacctttaccgtacccgtaaacctaacgttaccgaacggtaccgacgggttaccctgggaacccggtacgggaccgttaacgggaaacggtacgtttacggggttacggggtaccttttaaagggtttttaacgttcgggtaccttacggtaccgtaaagggttacctaaaaatttttaaacgtttaatttaacgtttaaccgtttaccccgttaaccgggtttacccggtttttaccgggaaccccgggttacggggtaaaacccttaaaagggtcggttaaaacgtacgttaaccgaaaacggttaccgttacgggtaccggtctaccgg

SEQ ID NO: 116643 - DNA, 669 bp, Homo sapiens
  misc_feature: GYAE6OF02FFCUN.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatccaactgcaacgtccagccagagttgttttagacagctaccaacaataagaactactagtcttggtaccagcagaaccaggtcacgcctcctaagctgctctatttactgggacagtaccgtacccgggaacgtcccgggggttccctcggacccgtattcgtaggtcgacgaggtcgggtcgtgggacagtattttccactcctacacctatcgtacgcacgtcctgacgaggtctagaacgtagtggtacggtcttaaggttttacgttcgtcgttacgtactacgtacttaaagttaactttaacgtttaactaccgttttaccccgtttaccggttaaccttttaccccggggtaccccggttaaccgggtaaacccggttaaaggttaccggttaacttaaccgttaacccgtaaaacggtaacccgtttaggggttaccggtaccgtaacccgg

SEQ ID NO: 116644 - DNA, 640 bp, Homo sapiens
  misc_feature: GYAE6OF02GBIHX.45.37.D04.1.454.CMB.1.raw
  modified_base (388)..(388): a, c, t, g, unknown or other
  misc_feature (388)..(388): n is a, c, g, or t
tcagacgcgatcgacacgaccggtgctcgatttagtagcatactgttgggtttgggggagcatcacccagcaacccacatcctgtcctctacgagaatcccctgagagctccgttcctcaccatggactggacctggaggatcctctttcttggtggcagcacgccacaagacgcccactcccaggtcgcaactggtgcagtcgtgggctggaggtgaggaagccgtgggcctcgagtgaaggtcctcctgcaaggcttcgcgctacctccttccgaccggcactactcctccgacgtggcgacgaccgaccggcccgtaggacgaggtcgttaggaggtggagtggagtagactaccaaacctaagagtggtacgacaactaactanacgacaagtaacgtaacgttcggacgggtacgtacggtaccaacgtacgacgaccgtaacggacctaccgtaccacgtaccgacgaccaacgacgtaccgtaacgtagtacggacgacgtagacgacgacgtacgtacgacgtacgtacgaacgaccgaccgtaccgtaccttaagtttacgtacgtacgtcggtacgtacggttacgtttacggtttccggttcggttcggttttacggtttcgtttacgg

SEQ ID NO: 116645 - DNA, 638 bp, Homo sapiens
  misc_feature: GYAE6OF02I6HQP.45.37.D04.1.454.CMB.1.raw
  modified_base (289)..(289): a, c, t, g, unknown or other
  misc_feature (289)..(289): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttcgtggatacaccttcaccggctactatatacactgggtncgactacggcccctggacagggcttgagtggagtgggatggataccaaccctaacaagtggtaggacacgaaaactatagacaacaggtaacgtttacgagggcgagggtacacgagtcgacgtaggaccacgtaccataccgagccacgacgaccctaacgacgtagggacgtccgtacgaggtacaacggtacgtacgaaacctacgtaccgacggtaacccgaccggaaccggtacccgttaaagttttacgtttaaccgttaggttaccggtacgggttaacggtacggtttaaccgggttttacccgggtacggtttccggtttaccgggtttttttacccggg

SEQ ID NO: 116646 - DNA, 554 bp, Homo sapiens
  misc_feature: GYAE6OF02IPTI2.45.37.D04.1.454.CMB.1.raw
  modified_base (464)..(464): a, c, t, g, unknown or other
  misc_feature (464)..(464): n is a, c, g, or t
tcagacgcgatcgacacgaccggtgctcgatttagtagcatactgttgggtttgggggagcatcacccagcaaccacatctgtcctctagagaatcccctgagagctcccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgacgacgacggcccctggacaagggcttgagtggagtgggatggatacaaccctaacaagtggtggcaacaaactatagcacaagaagtttcgaggacgagggtacaacgatcgaaccgaggaccacgtccatcagacacacgcctaacagtggagctagacgacgacgagtcganacgtcacgacgaccgacgtacctaagttttactacgttgtcgtacgaggtacgtttcggtttaccgggtcggtacgttggttttacccgg

SEQ ID NO: 116647 - DNA, 709 bp, Homo sapiens
  misc_feature: GYAE6OF02G5A76.45.37.D04.1.454.CMB.1.raw
  modified_base (406)..(406): a, c, t, g, unknown or other
  misc_feature (406)..(406): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtggaggacgccgtggggcctcgaggtgaaggtcctccgtgcaaggtcttcgtcggcctacctacccttccgaaccggcgtaactacttcctcccgacggttgggggtcgaccggtaaccgacccggtccccgtagggaacgtaacgggtcttagggagtgggtagtggggagtacggactaccgaaacccgtaanaaggtgggtacgaccaaactaaaccgtacgtcgaacacgtaggttaacgtttcggaacgggtaccgtaacgggtcccaacgtacgtacggaacccgtaacggaacccgccgtaccacgtacgacgacgaaccgtcgaacccgttaacgagggttacggacggtaccgtacgacgtaaccgaacgtcgtaacggtactaaccgagtaccgacggtaaccgtaccgtacgtttaactttacggttacgtggtacgtacggtaggttaccggttacgggttttaccgggtagtttccggtttacgg

SEQ ID NO: 116648 - DNA, 682 bp, Homo sapiens
  misc_feature: GYAE6OF02GZNZ2.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgagggaagccgtggggcctcgagtgaaggtctccgtgcaaggtcttcgtggctacctaccttcgaccggcgtactactcctccacgtgggtcgcgacgacggtcccccgtggaaccgaagggtccgttggaggtagggacgtgggataggactaccgaaacccgtaaacgaagttcgggtacggaccaaactaaaacgttacgtacgaccgtaacgtaaggtaacggttttacgacggggtaccgtacgggtaccctaaccgtaacggtaccggaaccggtacgggaaccaccggtaccaacgtaccgagtaccaacgacggtaccctaagtacgtacgggactacgtacggagacgtaagtaccgtagtaacctacgtacgacgaacgaccgtacgtaccgttaatttactagtcgtagtacggtaggttacgtttaccggttacggttcggttcgtttccgttttaccgg

SEQ ID NO: 116649 - DNA, 583 bp, Homo sapiens
  misc_feature: GYAE6OF02FHLIN.45.37.D04.1.454.CMB.1.raw
  modified_base (288)..(288): a, c, t, g, unknown or other
  misc_feature (288)..(288): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtncgacaggcccctggacaagggctgagtggatggggatgggatcaaccctaacaatggtggcacaaactatgcacagtaagtttcgaggggcagggtcacctagtcgaccgagggaccacgtccagtcagcacncgcctacntagggacnctaggagtcgagtactagactatcgtagaccgtaaccgaccgggtaccctaattttaacgttaccgttacggttaggtacccgggtaagggtaaccgttttcggggttttaacccggggttcggggttaccgtttttacccggggg

SEQ ID NO: 116650 - DNA, 743 bp, Homo sapiens
  misc_feature: GYAE6OF02GQH2K.45.37.D04.1.454.CMB.1.raw
  modified_base (332)..(332): a, c, t, g, unknown or other
  misc_feature (332)..(332): n is a, c, g, or t
  modified_base (518)..(518): a, c, t, g, unknown or other
  misc_feature (518)..(518): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgccgtacggggacatcgtgatgacccagtctccagacctcctggctgtgtctcgtgggcgaggacgggccaccatcgaactcgacaagtccagccaaggacgtttggttttacgacacggcctacccaaagaaataaaggaaaccttaacgttacggacctttacgggtaacccaaggtcctaaacggaaaccgnggtaccacggtccctacgtaacgctcggacttactaacgtttacgacgggactacgttacccggtaaccggggtaacgttcccggggtaccctaggtaccgtattacgaggtcggacgtacgggcggtacgtacgggactaggtacttcacgtctaccgactagacgacgacgacgtctagaccgngactacgagtgtggtgtactttagttacgtcggcgttacgtacgtaacgttaacgtaaatttacgtttaattaacgttaccgtttaccccgttaccgggtttacccgttttaacccggggacccggttaaccgggtaaacccggtaaacgggtttacgggttaaacctttaaccggtaaaccggtaaaccgggttaccgttggggttacccggaccgttaacccg

SEQ ID NO: 116651 - DNA, 554 bp, Homo sapiens
  misc_feature: GYAE6OF02GTU1Z.45.37.D04.1.454.CMB.1.raw
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcgagtgaaggtctcctgcaggcttctggctacaccttcgaccggcgactatcctccacgtgggtgcgacgacggcccctaggacgaacgggtcttgaggtggagtggggatggataccaacctaacagtggagacaacaaactatgacacgagtaagtttcgagggcgacgggtacaccagtacggaccgagggacctacgtaccatcgacgcacacgcctangtggancgtagacgnagactagaccacgngacgacgacggtcctaagtttactacgtgtgacggtacgtagttcggtttacggtggttccgttggttttccgg

SEQ ID NO: 116652 - DNA, 856 bp, Homo sapiens
  misc_feature: GYAE6OF02JUC7T.45.37.D04.1.454.CMB.1.raw
tcagacgcgatcgacacgaccggtgctcgatttagtagcatactgtgggtttgggggtaggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactcgacaagtccagccagagttgtttagacagcctaccaacaataacgaactactagcgttagtaccagtacaacgaaaccaggtacacggtacctacctaaacgctacgaccttacacgttttacgtcgggcctaagttacccgtaacccggggtaaccgttcccgggggtcccctacggtaacccggtacttacggaacggtcgggtacacgggtcggggtaccttagggggacctaacggtacttttaccgaacgttccctacccgaacctaggttacccgaacggtcccgtaaacggtcccgttacggtaccggacggggtccttaacgggaaaccggttaggttacccgggttcgggtaaccgttaccgggttttttaacgtcgggttaaccttgggtttaaccgacggtacccgttttaaaagtaccgtttttaaacgttttaacggtttaaacccgttttcccccggttaccggtttttacccggtttttaccccgggggtccccggttttaaaccgggggtaaacccgttaaaacgggtttaaccggggtaaaccgttttacccggttaaaaccggtaaaaccccggtttaacggttaaccggggtttaaccgggggtttcccttaaacccgggg

SEQ ID NO: 116653 - DNA, 652 bp, Homo sapiens
  misc_feature: GYAE6OF02HZOFS.45.37.D04.1.454.CMB.1.raw
  modified_base (393)..(393): a, c, t, g, unknown or other
  misc_feature (393)..(393): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccaacaagagcccactcccaggtgcagctggtgcagtcgtggggctggaggtgaggaacgccgtggggcctcgagtgaaggtctctgacaaggctctggcactacctcacggcgactatctccagtgggtcgcgacgacggcccgtaggacgaacgggtcttaggacgtaggagtggggtatggtactaccaacccgtaaagaacgtgggtaggaccaaacgtaaaacgttanacgtaccaaacgaaggttaacgtttacgaggggtaccgtaggggtaccaaccgacgtacgggaaccgtaacgggaaccaccggtaccgtaatacgacgccgaacacgtaccctaacagtacggacgtcgtacggacgaccagacctacggaaactgttccgaggaccgtacgaaccggtaacccttagtttaacgttacgtcggtagaccgggttaggttaccgtttaacgggtttacggttccggtgttttaccgggg

SEQ ID NO: 116654 - DNA, 662 bp, Homo sapiens
  misc_feature: GYAE6OF02III5K.45.37.D04.1.454.CMB.1.raw
  modified_base (259)..(259): a, c, t, g, unknown or other
  misc_feature (259)..(259): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgaggaagccgtggggcctcgagtgaaggtctctgcaggcttctggctacnccttcgaccggcgactatctccacgtggtcgcgacgacggtcccctggacaacgggtcttaggagtggagtgggatggactaccaacccgtaacgaagtgggtacggacaactaaaacgttagtacgaccaacgtaaggtaacgttttacgaacggggtacgtaacggggtaccaaaccgacgtacggaacccggaaggggtaaccaccggtacctacgtacgaacgaccaacgacgtaccctaacgagtcgggacgtctaggacgacgaacgacttacgaacctagttccgtaacgaaccggtaccgtaaccggtaccttaaagttttaccttacgtggttacgacggtaacgttacgttttaccgggttaccggtcggttccgttttacggttttacccgg

SEQ ID NO: 116655 - DNA, 826 bp, Homo sapiens
  misc_feature: GYAE6OF02JHC63.45.37.D04.1.454.CMB.1.raw
tcagacgcgatcgacacgaccggtgctcgatttagtagcatactgttgggtttgggggaggcgatcacccagcaaccacatctgtcctctagagaatcccctgagagctccgttcctcaccatggactggacctggaggatcctcttcttggtggcagcagccacaagagcccactcccaggtgcagctggtgcagtctggggctggaggtgagggagccgtggggcctcgacgtggaaggtctccgtgaccgaaggctttcgtagggctaccacctttaccaccgggtcgaccttaattcctacccacgttgggtcgcggactaggcccccgtgggaccaaggggccttggacggttgacgttggggagtgggacttaccgaaaccctaaagaacggtggtggtaccgaataaaacgttacgttagacccgtaagtaacggtaacggttttaccggaagggtccggtaaggggtcccaaaccggtacgttaacggaccgggtaaacgggtacccgtaaccgggtcccaacgtccgtaagacccgacgaaacccggtccgaaacttaaccggtacgggtaacgtaacccggttaggaaccggaccgtaacgggtacccgaagtaacccgtaaacgttacccgtaggggtaacccccgtacgaaccccgggggttaaccctttaacggtttttttaaacctaacccggtttaggggtaacccgggttaccggtaaaacggggtttcggtttttaaaccccgggggtttttaaccggggtacggggttttaccccggttttaacgggggttttttttttcccccgggg

SEQ ID NO: 116656 - DNA, 646 bp, Homo sapiens
  misc_feature: GYAE6OF02JHL5S.45.37.D04.1.454.CMB.1.raw
  modified_base (168)..(168): a, c, t, g, unknown or other
  misc_feature (168)..(168): n is a, c, g, or t
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (553)..(553): a, c, t, g, unknown or other
  misc_feature (553)..(553): n is a, c, g, or t
tcagacgcgatcgacacgaccggtgctcgatttagtagcatactgttggggtttgggagagcatcacccagcaaccacatctgtcctctagagactccctgagagctccgttcctcaccatcggactggacctggaggatcctcttcttggtggcagcagcacaacgngtcccactcccaggtncagctggtncagtcgngggctggaggtgaggacgccgtggggcctacgagtaggaacggttctccgtagacgaaggtccttacgtggtacctacgtaccgttcgaccggtgaaccttacgccctaaccgcgttacggggcaccgaccgaccggtccccgttaggaaccgtaacgggtctttaggacggttacgagggttagggaacgtcggtaacctaccgaaaacctaagtacggttcgggacgtaacgaactaaacgtgtacgaccaagtacggtaagttcgacggtacgacggtacacgtacgtacgacgtacggtacaccgtctagacgaactacactacgtaactagtcgtaggacttcgacgngactacgactcgactcgtcgaccgacgacgtacgtaactattacgtaacgcggtgacggtacgtaggtttccgtagggtccttgtttaaccgg

SEQ ID NO: 116657 - DNA, 729 bp, Homo sapiens
  misc_feature: GYAE6OF02G9HUY.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctgagtgaaggtcctcctgacgaaggcttcgtggctacaccttcaccggcgactatctccacgtgggtgcgacgacggcccctggacgaagggcttggagtggagtgggagtgggactaccaaacccgtaacgaagtgggtcggacaactaaacttagtacgacaacgaaggtaacgttttaccggaagggtcggacgggtcaacccgagttaccggaaccggaacgggaacctaccggtaccctaacgtaccgaacggcccaacgtacgtacccttacgaaggttacgggaacggacgttagggaacgaccgtaacggtaaccgtacgtaaccgtaacgttaccgttacgggaacccggtaccggtacccggtaaccccgtttaagtttttaaacccgtttaaccggttcggttaccgggtacggttaacgggttacggttttaaccggggttttacccggggtacgggtttccggtttttaccggggtttttttaccccgg

SEQ ID NO: 116658 - DNA, 558 bp, Homo sapiens
  misc_feature: GYAE6OF02F0QS1.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggcctcagtgaaggtctcctgcaaggcttctggctacaccttcaccggcgactatctccactgggtgcgacacggccccgtggacaagggcttgagtggagtgggatggatccaaaccctaacaagtgggtggacaacaaactatgacacagtaagtttcgagggacgagggtcacatcgacgaggacacgtaccatcagcacagacctacagtggacgctaggagacgagactagactagtcagacgacgacggaccttaagtttacttacgttggtacgacggtaggttacgtttacgggtttaccgggtgggttccgtttcggtttttacccgg

SEQ ID NO: 116659 - DNA, 638 bp, Homo sapiens
  misc_feature: GYAE6OF02H4PAM.45.37.D04.1.454.CMB.1.raw
  modified_base (346)..(346): a, c, t, g, unknown or other
  misc_feature (346)..(346): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtcgtggggctggaggtgaggaagccgtggggcctcgagtgaaggtctcctgcgaggcttcgtggctacaccttcaccggcgactatcctccacgtgggtgcgaccacggcccgtaggacagggtctggagtgagtggatggactaccaaacctaanagtggtggcaacgtaaactagtgacaacaaggtaacgtttacggaggggaccgacggggtcaaccgtagtaccggaaccggaacggggaccacggttacccaacgtaccgagaccaacgacggtaccctaacgacgtcgggaacgtcgtcggaacgcaacggtactacggaacctacgtaccgaacggaccgaccgtaccggtcccttaagttttaacgttacttggtacgacggtaggttacgtttacgggttaccgggttggtaccggttttcggtttcgttttaccggg

SEQ ID NO: 116660 - DNA, 742 bp, Homo sapiens
  misc_feature: GYAE6OF02J1P3I.45.37.D04.1.454.CMB.1.raw
  modified_base (302)..(302): a, c, t, g, unknown or other
  misc_feature (302)..(302): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagtacctccctggctgtgtctctgggcgagcggccacatcaactgcaagtcacgccagagttgtttagacagcctaccaaacaataaacggaacttactagtcgttacggtaccaggtcaacggaaaacccngggttacacgtccctaccgtaagtcctcgtccttactaacgtttaccgcgggtacctacgttacccggtaacccggggtaacgttccccgggggttccctacggaacccggttacttacggtacgggtacgggaccgtacgggtaccgggggttccgtacggggaacctacggtacttttacccaccgttcctacctaactacgttacaacggtccgtaactcccgacggtacgacggtacttagaacgttacgtgggtacgtacgttaggttttatcgtaccgtgtaccgaagtacttaaagtttctttaaacttactttaaccgtttcccgttaccgttaccggttttacccggcccggttacggtaaaccgtaacgtttacggtaacgttaacgttaaccgtaaaccggttaagttccgggttagtaccgttaaccg

SEQ ID NO: 116661 - DNA, 714 bp, Homo sapiens
  misc_feature: GYAE6OF02ISVY7.45.37.D04.1.454.CMB.1.raw
tcagacgcgatcgacacgaccggtgctcgatttagtagcatactgttgggtttgggggagctacaacaggcaggcagggggcagcaagatggtgttgcagacccaggtcttcatttctctgttgctctggatctctggtgccgtacggggacatcgtgatgacccagtctccagactccctggctgtgtctcgtgggcgagagggccaccatcaactgacaacgtccagccagagttgttttagacagcctaccaaacaaataaacgtaacttacttagtcgttacggtaccagacaacgaaaccgacggtacgacgaccctaccgtaacgctcgtcttactaatttaccgtagggtactacgtacccggtaacccgggtaacggttccccgggggtacccctacggaccgtacttaccgagtcggcgacggtcgggtcgtagggacgtagtactttacacgttcctaccaacctatccgacgcaccgtccgtcgacggacgggtacgtaagtaaggtacgttgggttacggtacttaaggtttttacgttcgtcgtttgtacgtaacgacttaaagtttaatttaagtttaacttaccgtttacccttacccggttaccgttttcccgggtacccgtaacgggtaaacccgtaaaggttaccggtaattaaccgttaacggtaaaccgttacggttggtaccggtactaccgg

SEQ ID NO: 116662 - DNA, 661 bp, Homo sapiens
  misc_feature: GYAE6OF02GQXWJ.45.37.D04.1.454.CMB.1.raw
  modified_base (252)..(252): a, c, t, g, unknown or other
  misc_feature (252)..(252): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaacgtggtgcagtcgtgggctggaggtgaggaagccgtgggcctcgagtgaggtctcgtgcagtcttcngctacgtccttcgccggcgactatctccacgtgggtcgcgacgtacggccccgtagggaacgaagggtcttggaacggtggagtgggatggactaccaacctaaacgaagtgggtacggactaacgtaaactagtcgacgaacaagttaacggtttcggaacggggtcgtaacggggtaccaaccgtaaggtacgaacccggtaagggaaccctaccggtacccacgtaccaacgaccgaacacggtaccctaacgagtcggaacgtcgtagacggacgacgtaacctaggactaacgtcgacgaaccgaccgacgtactacgttttaacgttaccgtcggtacggtacggtaggttacgttcgggttttaaccgggtggttacccggtttggtttcccgtttaacggg

SEQ ID NO: 116663 - DNA, 791 bp, Homo sapiens
  misc_feature: GYAE6OF02G16AA.45.37.D04.1.454.CMB.1.raw
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactcccgaggtgcagtctggtgcagtcggtgggggctggagggtgaagggaacggccgtcgggggtcctacgaggtggaacggtccgtccgtgaccgtaagggtcttcgtggacctacacctttcgaccgggntacctntcctcctacgtggtcgcgacaccggccctgggaacgtaagggtccttaggagggttacggaggtggggtagtcgggtatacccgaaccctaacgtaatcgggttagccaaaacgtaaacctaggttacgactaaccgtaaagggttaaacgtttccgggaggggtaccgacggtacgtaaccgacggtacgtaaccggaacggggtaaccctacggttacctaacgttaccgaacgtaccgaacccgaacgtacccgttactaacgggtacgggtaccggtacgttaccgggaacggtaaccgtaacgggtacgttaaaccgtaacgtaaccgttaccggttaaccggaacccggtacccggaacccggtttacccgttaacgtttttaacggtaacccggttggttaacgggaaccggttaacggtacggtttaccggggtttttaacccgggacggttttcgttttaaccccggggg

SEQ ID NO: 116664 - DNA, 684 bp, Homo sapiens
  misc_feature: GYAE6OF02IKSD9.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtgaggagccgtgggcctcaggtgaacggtctccgtgcgaaggtccttcgtcggctacctaccttaccgaccggacgtactacgtcctcccgtacgtcgggtcgaccgaccgacggaccccgttggaaccgaagggtcttcgaggtcggagtggggagtggtactaccaaccctaagagtcggtacggacaacgaaactagagacagagtaacgtttggacggagtacggtaccacgagtacggtaccgacgggtaaccgtccggtaccacgtacgaacgtaccgaaccgtacgaacccttaacacggtaaggtaccggtaccgttcggaacgtacgtaaccggtaacgacggtaacgaccgttacgaacgacccggaaccgaccggttaacccgttaagttttaccttaacgttcggtaggacggtaacggtagtttaccgggttttaccggtcgggttccgtttttaccggg

SEQ ID NO: 116665 - DNA, 525 bp, Homo sapiens
  misc_feature: GYAE6OF02GD8R4.45.37.D04.1.454.CMB.1.raw
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttcggtaccagcagaaaccaggtcagcctctaagctgctacatttacnggcactcgtacccgggaatcccggggtcctcggacctnttcagtcggcaggtcggcgtgggacagtactttcactctacaccatcagcagtcctgcaggctaganagtgngctagtttntgnttgactatactaatattatattattcctacgtacgtttccggccttaggacgtaagtagaacttactacaaaccgtatggtcgtctacg

SEQ ID NO: 116666 - DNA, 727 bp, Homo sapiens
  misc_feature: GYAE6OF02HV1V6.45.37.D04.1.454.CMB.1.raw
  modified_base (347)..(347): a, c, t, g, unknown or other
  misc_feature (347)..(347): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcaagtccaagccagtagtacgttttagacagtctaccaaacaataaacgtaactacttagcttacggtaccagacgaacgaaaaccgtaggtacacgtcctaccgtaagccttgcctactaattttacgngggactacgttacccgtaacccggggtaacgttcccgggggtacccttcggtaacccgtacgttaccgagggtcggtacgacgggtcggggtcgttacggggacgtaggtacgttttcgaccttccgaccctacctaagttccgacgtccgaacgtccgtacgacgtacggtcgtaaggaacggtcgtaggtcgggtacttaacgtttagttaccggattacggtactaagtaccgtaaagttttaacttacgtttaacttaccttccccgttacccgttaacgtttaccccgggtaacccggttaacggtaaaccggtaaacggttcgaaacgtttaccgaacgttaaaaccgtcggtttacgtaccgggattacccgg

SEQ ID NO: 116667 - DNA, 759 bp, Homo sapiens
  misc_feature: GYAE6OF02I5DYY.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtggggctggaggtggaggaagccgtcggggcctcgaggtcggaaggtcctctgcgaacggtcttacgtggacctactaccccttacgacccggacgtacttactcctcctacggtcgggtcggccggaccgacgggtccccgtagggaccggaacgggtcttacggaggttcggtagtcggggtattcggacgtaaccgtaaaccctaaacgtaacggtggggtacggaacaaacgtaaaccgttagtaccggaacctaacgtaaacggtaaacggtttacggacggggtaccgtaacgggtaccgaaccctaggtaaccggaaccggaaacgggacccgtaacccggtaccctacggtaaccgtacgaacgaacccgtaccgtaacctacgaacgggttacgggacgtacgacgggacggtacgacggttaccgtaggtaacgtacgttaccgtaacgggaccgaacccgggtaccggtacccggttaagttaaccggttaccgtagggcggttaacgacgggtacggtaccggtaaggtttacgttaacggtttaggg

SEQ ID NO: 116668 - DNA, 760 bp, Homo sapiens
  misc_feature: GYAE6OF02GXKYH.45.37.D04.1.454.CMB.1.raw
  modified_base (325)..(325): a, c, t, g, unknown or other
  misc_feature (325)..(325): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagacgggccaccatcaactgcaagtccagccagagttgtttagacagctaccaacaataagaacttagtagcttggacctagctaacgaaacctggtacacgcctacctaagctgcctactatttacgngggactagtaccgtaacccgggtaacgtcccggggtccctcgaccgtagttccgaaggtcggacgtaggtccggggtacgtacggggactaggtacttttaccgacttcctaccgtacctagtaccgtcgtaccgacgtaccgtggacccgtacgggtacgttaaggaaacggtacgttcgggtacgggtacgttaggtttttaacgttcggtacgttacggtaccgtaacggtacctttaaagttttaacgtttaacgtttaaaccgtttaccgtttaccccgttacccggtttacccggttttacccgggtccccggttttaaacggggtaaaccccgttaaagggttacccgggttaaacgtttaaccgttaaacccgggttaaaacccgggtaaccggtttaacgggttcccgggtacccgttaacccggg

SEQ ID NO: 116669 - DNA, 564 bp, Homo sapiens
  misc_feature: GYAE6OF02FGCUB.45.37.D04.1.454.CMB.1.raw
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (432)..(432): a, c, t, g, unknown or other
  misc_feature (432)..(432): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatccaactgcaagtccagccagagtgttttagacagctccaacaataagaactactagcttggtaccagcagaaaccaggtcagcctcctaagctgctntatttacngggcatccgtacccgggaatccggggtccctgaccgtattcgagtcggcacggcgggtcgtgggacagtactttcgacttctacacctatcagtcagcctgcgaggcctagagatggnggtactagtttatgcttgtcaagtactaaattatttaattattacttccttacccgtactttccggaaccctcgggaaccctaaaggtcgtaacttacgtaccgtaaaaccgtacgttggtacggtactccg

SEQ ID NO: 116670 - DNA, 572 bp, Homo sapiens
  misc_feature: GYAE6OF02H6F6M.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtgggcctcagtgaaggtctcctgcaaggcttctggctacaccttcaccggcgactatctccacgtggtcgcgacacggcccctggacgaaggcttgacgttggatgggatggatcaaccctaacaagtggtcgacaactaaactatgacacgagtaagtttcgagggtcagggtccacgatcggaccgagggaccacgtaccagtacacgaccacacgcctacagtcggagcgtagagacgaagaccgttagacctagtacgtacgaccgtacgacggtaccttaagttttaccttagtcgttacgacggtaggtcgttacggtttaccgggtggttccgttggttttacccgg

SEQ ID NO: 116671 - DNA, 601 bp, Homo sapiens
  misc_feature: GYAE6OF02HROOI.45.37.D04.1.454.CMB.1.raw
  modified_base (563)..(563): a, c, t, g, unknown or other
  misc_feature (563)..(563): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggaacgccgtggggcctcgagtggaacgtctcctgacaaggtcttcgtggctactaccttcaccggcgactatctccacgtgggtcgccgacgacggcccctggaaccgaagggtcttgaaggtggagtcggggatcgggataccgaaacctaactaagtcggtacggacaacaaaactatcgacaactagaaacgtttcgagggtcaacgggtacaaccgagacgaccgaggtaccacgtcaactcgacgacacgtacgacccttagacgttggacgactaggagacaggtaactcgacaacgtccgtagacgtaacgccgggaccttacgttagttaccgtgtcgaacggnggtaacgtttacgggttaaccggtggtccgttttacgg

SEQ ID NO: 116672 - DNA, 640 bp, Homo sapiens
  misc_feature: GYAE6OF02JRMDP.45.37.D04.1.454.CMB.1.raw
  modified_base (222)..(222): a, c, t, g, unknown or other
  misc_feature (222)..(222): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagccgtggggccncgagtgaaggtctcctgcaaggcttcgtggcctacaccttcaccggcgactactcctccacgtgggtcgacgacgacggccccgtcggaacgaacgggcctttaggaggtggagtcgggagtcggactaccgaaaccgtaactaagtcgggtacgacctaacaaacgtagtacgacaacgtaaggtaaagtttcggacgggacgtacgggtccaacgtagtacggaccgagggtaccacgtaccgactacgacgacacgacgacctacgagtacggacgcgtagacgacgagtaccgtgaacgtctacgacgaacgtacccgacggtcttaacgttttcaacgttcggtacggacggtaaggttacggtttacggttaccgggtggtttaccgtttaccggttttccgtttaacgggg

SEQ ID NO: 116673 - DNA, 687 bp, Homo sapiens
  misc_feature: GYAE6OF02JJVUZ.45.37.D04.1.454.CMB.1.raw
  modified_base (196)..(196): a, c, t, g, unknown or other
  misc_feature (196)..(196): n is a, c, g, or t
tcagacgcgatcgacacgaccggtgctcgatttagtagcatactgttgggtttgggggagctacaacaggcaggcaggggcagcaagatggtgttgcagacccaggtcttcattctctgttgctctggatctctggtgcctacggggacatcgtgatcgacccagtctccagactccctggctgtgtctctggcgngacggccaccatacactgcaacgtccacgccagtacgttgttttacgactacgcctaccaacaaataacgaaacttactagtacttcggtaaccagacaacgaaaccaggtacacgtcctaccgtaacgctacggccttactacgtttagtcggtacgtaactaccggtaacccgggtaaccggttcccggggttaccctcggtacccgtaacgttcgtacggttcggcgacgggtccgggtagtacgggtactaggtactttcgtactccttaccgactactcgtacgacgagtacctgacgttggaccgtttagaacgtcgttaggccgttaagtccgttttaagtcgtacgtcgagttacaacttatttaaccttaagttttactacttcccggttaccgtttcgtcccggttaccggttacggtaacgtaacgggttactaacggtaactaccgtaaacgttacggcggtttaaccggcttaaccgg

SEQ ID NO: 116674 - DNA, 670 bp, Homo sapiens
  misc_feature: GYAE6OF02F6IHP.45.37.D04.1.454.CMB.1.raw
  modified_base (348)..(348): a, c, t, g, unknown or other
  misc_feature (348)..(348): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactcccgtggctgtgtctcgtgggcgagacgggccaccactcaactgcaagtccagccagtagttgttttagatacgcctaccaaactaataaagtaacctacttagtctttacgggtaacccagacaacgaaaccgaggtacacgaccctacctaagctcgctactagtttacgngggactacgttaccgtaacccgggtacgttcccggggtacctcgaaccgtatcgagtggacgacggtcgggtcgtagggacagtacttcactcctacaccactcacgtcacgcctacgtccacggtacgtacgtaagtagttggtaggtacgtttagtttacgttgtacgttggtactacggtaacttaaacgtttaatttaagttttaaacgttaccgtttacccgttacccgtttaaccgtttcccggtaaccggttacgggtaaaccgtaaggtacgtaattacgtaaccgtaaacgtcggtacggtacggtacgtacg

SEQ ID NO: 116675 - DNA, 944 bp, Homo sapiens
  misc_feature: GYAE6OF02IOXV9.45.37.D04.1.454.CMB.1.raw
tcagacgcgatcgacacgaccggtgctcgatttagtagcatactgttgggtttgggggagcatcacccagcaaccacatctgtcctctagagaatcccctgagagctcccgttcctcaccatggactggacctggaggactccttcttcttggtggcagcagccaacaaacgacgacccctacctcccgagggtcgcacgtcgtgggtcgcgaggtcggtcgggggcgtgggaggtaggaagggaacggccggtcggggtcccgtgtaggtaggtaacggttcctccgtggacgtaacggtccgtttcgtcggtaaccttacccgtacccgtttacccgacccgggtaccgtaaccttaccgtccctacccgtacggttcggggtcgaccggaccgtaccgggtccccgtagggaaccggtaacggtccgtttagggtagggtacgggtaaggttacggggtaagttacgggtaaccgttaaacccgtaaaccccgttaaaacgtaaagggtttcggggtaacggaaccctaaaaccgtaaaaacgtttaacgtaccggtaaccctaaacggtaaacggttaaacggttttaccgggaacgggggtacccggtaaacggggttaaccccaaaccgtaacggttaacccggaaaccgggaacgggtaaaccctaacccggttaacctcgtaaccgaacggaacccaacccgtaccgtaacccctaacggtacgtacgggtaaccgtacggtacggaacgtaaccgtaacgtaaccgttaacaaccgtcgttaaacccggtaccggaacccggtaaccgtaaccccggtaactttttaacggttttaaaccgttaccgttagggtaccggtaacgggttaacggttacgggtttacccgggtttacggggttacgtttacccgggttttacggtttttaacccggg

SEQ ID NO: 116676 - DNA, 709 bp, Homo sapiens
  misc_feature: GYAE6OF02GLHV0.45.37.D04.1.454.CMB.1.raw
tcagacgcgatcgacacgaccggtgctcgatttagtagcatactgttggggtttcgggggagctacaacaggcaggcaggggcaggcaagatggtgttcgcagacccaggtcttcatttctctgttgctctggatctcgtggtgccgtacgggacatcggtgatcgaccagtctccagactcctggctgtgtctcgtgggacgagacggccacctatcaactgacgaacgtcgacgccagtagttgtttacgactacgccttaccaactaataacgacttagttagaccgttcggtaacagaccaaacgaaccgacggtacacggtccctacgttaacgctcgaccttactaacgtttcggtacggcctaacgttacccggtacccggggtaaaccgttccccgggggtcctaaggtacccggttattaccgtacgggttggaccgaacgggtcgggttaccggttacgggggaccttaacggttactttaccgaccgttacctaccggtacctacgtcgtacgacgtaccgcgttacggacgtacggtactacgggaagttacgtcgggtacgtcgtttaacgtttcgtacgtcgtcgtacgtacgtaataacgtttattaacgttcttaaccgttcttaccgtcgttacccggcggttaaccggaacgttacgaggttacctatacgtaacgtagtgtacgagtacg

SEQ ID NO: 116677 - DNA, 665 bp, Homo sapiens
  misc_feature: GYAE6OF02JDESO.45.37.D04.1.454.CMB.1.raw
  modified_base (606)..(606): a, c, t, g, unknown or other
  misc_feature (606)..(606): n is a, c, g, or t
  modified_base (639)..(639): a, c, t, g, unknown or other
  misc_feature (639)..(639): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaacgtggtgcagtcgtggggctggaggtgaggaacgccgtggggcctacgagtgaaggtcctccgtgcgaaggtccttcgtggactacctaccgttccgaccggtacgactactcctccacgtgggtcgaccgacgacggtccccgtaggaacgaacgggtcttggaggtcggagtgggataggactaccgaaaccctaacgtaacgtgggtacgactaacctaagtagtcggtacaacgtaagtaacggtttcgagggacgtacgggtaccaacgtagtaccgtaaccgagggaacctacgtaccagtccgaagcccaacgtacgtacccgtaagtacggtacggacctcgtagggaccaccggaagtacgacgtaactacgttacggacgaaccgtaccgacgtacctagtttcttaacgngtacgacggtagttacgttcggtttaaccgggngtttcggttacgtttaccgttacggg

SEQ ID NO: 116678 - DNA, 870 bp, Homo sapiens
  misc_feature: GYAE6OF02I40ZU.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctcccgtggctggtgtcctcgtgggcgaggacgggccaccataccaactgactaacgtccacgccgagtacgttagttttacgacacgcctaccaaacaataaacgaacttacttagtcgttacggtacccagacgaacgaaacctaggtacacgtcctacgtaagctcgctcgttaatttacgtggactacgtaccgtacccggggtaacgttccccggggtacctacggtaccgtacgttaccgaggtcgggacgtaacgggtccggggtcgtacggggaacgttaacggttacttttacccgaaccgtttccctaacccgtaaaccgtacgttaacccggacgacccggtaacgtaccccgggtacgtaccggtaacgggtccggttaagtaaacgggtagtttaccggggtaaccggttaacgtttaacggtttttaacggtcggttaccggtttaggtaacccgggttaactaaccgtttaaaaacgttttaacgttttaaaccgttttaaaacgttcccctttttcccggttaaccccggttttacccgttttaccccggggggtaccccgtttaaaccgggggaaaaccccggtttaaaggggtttaccggttaaacccgttaaacgttaaaccccggtaaaaccgggtttaccgggtttacgggttaacccgggtccgttaaccccgg

SEQ ID NO: 116679 - DNA, 611 bp, Homo sapiens
  misc_feature: GYAE6OF02FSW0W.45.37.D04.1.454.CMB.1.raw
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (374)..(374): a, c, t, g, unknown or other
  misc_feature (374)..(374): n is a, c, g, or t
  modified_base (427)..(427): a, c, t, g, unknown or other
  misc_feature (427)..(427): n is a, c, g, or t
  modified_base (589)..(589): a, c, t, g, unknown or other
  misc_feature (589)..(589): n is a, c, g, or t
tcagacgcgatcgacacgaccggtgctcgatttagtagcatactgttgggtttgggggagctacaacaggcaggcaggggcagcaagatggtgttgcagaccccaggtcttcattttctctgttgctctggatctctggtgcctacggggacatcgtgatgacccagtctccagactccctggctgtgtctctgggcgaggagggccacccatcgaactgcaacgtccagccagagtgttttagacagctcccaacaactaaagaactaacttagctttggtacccagcagaaaccngtcagcctcctaagctgcttcactttaccgggnatctaccccggggaatcccggggtcctgaccattccagttcggnaggcggtcgtggggacagtattcaacgtctaccaccatcagtccaagcccgtnccgaggtctagaaggtagtcggtagctaggttttattggtcttacgtgacgtctaagttaattatttaacttacgttacccgttaccgttaccgtttaccgggccccgtaggggtaacccctaaagggtccgtaattaacgtaccgtaaaccgtaacggttntacgggtacctaggtaacccgg

SEQ ID NO: 116680 - DNA, 699 bp, Homo sapiens
  misc_feature: GYAE6OF02JW2WY.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactcccaggtgcagctgtgcagtctagggctgaggtgaggaagccgtggggcctcgagtgaaggtctccgtgcgaggtcttcgtggactactaccttcgaccggtcgactacgttcctccacgtgggtgaccgtacgaccggccccgtagggaccgaacggggtccttaggaggtacggtacgtgggggaacttggtaacgtaccctaaacccgttaaacgtaagtcggttacggaaccgtaacgtaaacctagtagacaacggtacgtaacggtttacggaacgggtacgtacgggtaccaccgtaagtcggaacgtacgggacctacgtccgaacgtcacgtcacgacctacctacgacgttacggacgacgtacgacgaacgtacgtaaccgtcgtaacctaaccgttcgtaccgacccggttacgaaccccggtctttaaacttttccggtaacgttcggtggttaccggtaagggttaaccgtttccggtttaccgggttacggttaccggtttttccggg

SEQ ID NO: 116681 - DNA, 739 bp, Homo sapiens
  misc_feature: GYAE6OF02IMW0T.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaatgacagtccagaccagagttgtttagacagtctaccaaacaaagtaacgaaacttaaccttagacgtttacggtaacccagaccaacgaaaacccaggtaccacgtcccttacctaaaggcctagccttcaacttttacgtacgggactaacgttaccccggtaacccggggtaaccgttcccgggggttacccctacggtaacccgtattacccgagttacgggccgtacgggtcggggtcgtacggggaaccgtacggtaatttttcccgaccttacttacccgaaacctaacttaccgagcccgaacgtcccgttaggacccggtaaggtacccgtaagggtaaaagtacgttacgggtacgggttaccttaaggtttttaacgtcgtacggttacgtccaaggtactaaatttaacgtttaatttaaactttaccttaccgttacccttaccggtttaccggacccgttaacgggaactaaacggttggtaactactaacgaaaccgtatacggtcgacgtacg

SEQ ID NO: 116682 - DNA, 644 bp, Homo sapiens
  misc_feature: GYAE6OF02G9KB6.45.37.D04.1.454.CMB.1.raw
  modified_base (252)..(252): a, c, t, g, unknown or other
  misc_feature (252)..(252): n is a, c, g, or t
  modified_base (426)..(426): a, c, t, g, unknown or other
  misc_feature (426)..(426): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaacgtccagccagagttgtttagacagcctaccaaanaataagaactaacttagcttacggtaccagacacgaaaccaggtcacgccctacctaagctcgcctctatttacgtggctacgtaccgtacccgggaagtcccggggtacctcggaccgtattcgaggtcggcgtacggtcgggtacgtggggactacgtactttcgacttccnccgtacctagtaccacgcctacgccctaggccgtagggtctaaggaacgtcgttggtcgggtactaaggtttttacgtcggtaccgttgtaccgaagtaccttaattacgttttactacgtttaccgtcccttacggtaccgtttcccggaaccgttacgggtaacctaaggttcggtaacttacgtaacaaacgggtaccttaggtaccgtcgtacg

SEQ ID NO: 116683 - DNA, 765 bp, Homo sapiens
  misc_feature: GYAE6OF02JTQZY.45.37.D04.1.454.CMB.1.raw
  modified_base (169)..(169): a, c, t, g, unknown or other
  misc_feature (169)..(169): n is a, c, g, or t
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (419)..(419): a, c, t, g, unknown or other
  misc_feature (419)..(419): n is a, c, g, or t
  modified_base (588)..(588): a, c, t, g, unknown or other
  misc_feature (588)..(588): n is a, c, g, or t
  modified_base (629)..(629): a, c, t, g, unknown or other
  misc_feature (629)..(629): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggagatcctcttcgttggtggacagcagccacgaangccctactcccgaggtncagcctggtnacngtctgggctgaagtgagagccgtgggacctnagtcgaagtctctgacgaggcttntggctacaccgttcacggtcactagtctacccagtgaagtccgcgaccgacggtcccctagggactaacggggcctttacgaaggtggggtaaacttgggggactttaggaaccgtaccgtaaacccctttaagaactttggggaacggacaacgtaaaacgttnccggaactaaccgaggttaaccttttcggaaggggtcccgaagggttacctacccgtaagtaacgggtaccctaaacgggggacctaacccggtttacaaacgtttccccggaagtacccggttttaacgaaccggttaccccgtaagtaaccggtttaaaggggaccncccgggtttaaggaacgggtacctaaaccgggttttaaacncggggtaaacttccgggttaccgtttaccggaacgaaaccggtcccggggttaacttaacgggttttaccctaagtaacggttcggaaacccgttaggaaccgtttttaccgggtacgggtttcctttaaccgggg

SEQ ID NO: 116684 - DNA, 772 bp, Homo sapiens
  misc_feature: GYAE6OF02GLA1N.45.37.D04.1.454.CMB.1.raw
  modified_base (344)..(344): a, c, t, g, unknown or other
  misc_feature (344)..(344): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggacgggccaccatcaactgactaacgtccagccagtagttagttttagacacgcctaccaaacaataacgaactacttaagtacttacggtaccagacaacgaaacctaggtacacgcctaccgtaagctcgctactactttacgnggactacgtaccgtaacccgggaacgtcccggggtaccctacgaccgtattacgacggtcggacgaggtccgggtacgtacgggtactaggttacctttaccgaccttaccgtaccgaacctagtaccgaacgtccgtacggtaccccttaggccgtaacgggtacctaagggtaaacgtacgttaggggttacggtactttaaacgggttttttacttcgggtacgtttaccggtaacgtaacgttacgttaaactttaagttttaaaccgttaacttttaacccgtttccccgttacccgggtttacccgttttaccccggggtccccggttaacggggtaaacccttaaaggggttaccgttaaacttaaccgttaaacccggtaaaaccggttaccggtacgggttaccggtaccgttacccgg

SEQ ID NO: 116685 - DNA, 715 bp, Homo sapiens
  misc_feature: GYAE6OF02G1HOV.45.37.D04.1.454.CMB.1.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagcccacaagacgccccactcccaggtgcagctggtgcagtcgtgggctgaggtgaggaagcgtgggcctcgagtgagtctcngcaggcttcgngctacnccttcgaccggcactatctccactgggngcgacgacggcccctaggaccgaagggccttagnggtggngtgggatggactacgaaaccctaacgaagtcggtagaccaactaaacgtatacggacaacgtaagtaacgtttacggagggtacgtacgggtaccaaccagtacgaccgaaggaccaccgtccataccgtacggaccaacgacgtacccgtagtacggttacggacggaccttgggaacgtaccgaacggtaccgtaacgtaaccgtagttacccggttaaacgaccgggtaaccccgtacccgggttaccctttaaacggtttttcccgtttaaacgttcggttaacgggtaccgggttaaaggtttacgggtttacccggggttttttaaccggggtacccggttttacccggggtttttaccgggtttttacccgttttttaacccggggg

SEQ ID NO: 116686 - DNA, 740 bp, Homo sapiens
  misc_feature: GYAE6OF02GGQ0K.45.37.D04.1.454.CMB.1.raw
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
tcagacgcgatcgacacgaccggtgctcgatttagtagcatactgttgggtttggggtaggaggcatcacccacgcaaccaccatctgtcctctagagaatccctcgagagctcccgttcctcaccatcggactggacctggaggatcctcttcttggtcggcagcagccacaagacgcccacctcccacggtcgcgagcgtcggtgcacgtcgtgggctgaggtgaggaagccgtgggacctcgngtgaaggtcctctcggnaacggtcttcgtcggctacacccttcgaccgggcgtacatcctacctactggggttacgcgtaaccacggccccgtaaggaccgtaagggcctttggaagtgggaacttggggacgttggacttaccgaaaacccgtacgtaaggttcggtacggacaaaacggtaatcgtacgacgaacgaaacggttcgttagggacgggcgtaacgggttacaccgtataacgggtaccgaacggttacgcccgtaaactccgtaagaccgtaccaaccggtaacgtaccggttaaactaacggtcggtaacgccgttacgggaactaccggtaatacccggttaccaaacgtgttaccgtaaccggaccgtaacgacccccggtttagttaaaccttttaaggttacctaagggtccggaaacgggtaggtttaaacggtttacccgggttcccgggggttttaagccggttttttaacccgg

SEQ ID NO: 116687 - DNA, 666 bp, Homo sapiens
  misc_feature: GYAE6OF02GCPAR.45.37.D04.1.454.CMB.1.raw
  modified_base (327)..(327): a, c, t, g, unknown or other
  misc_feature (327)..(327): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgtttagacagactccaacaataacgaactacttagtcttaggtaccagacaacgaaaccaggtacagccctactaagctgcctctaatttaccgnggacataccgtaacccgggaacgtcccggggtccctacgaacccgtattcgacggtcggactaggtccgggtcgtacggggactaggtactttaccgacttcctacaaccctatccgagaccacgccctaggccaccgtccgttaggaacgtcgtacggtccgtacgttaacgtttacctacgtacgtacctaacgtactaaatttaacttagtacggtaacttaccgttccttaccgttacgtaccgttttccggggaaccgggtaaccggggtaccgttaacgggttcggacgttaccttaaccggaaacggttaccggttacggtacggtacccgg

SEQ ID NO: 116688 - DNA, 554 bp, Homo sapiens
  misc_feature: GYAE6OF02FTWI6.45.37.D04.1.454.CMB.1.raw
  modified_base (397)..(397): a, c, t, g, unknown or other
  misc_feature (397)..(397): n is a, c, g, or t
  modified_base (549)..(549): a, c, t, g, unknown or other
  misc_feature (549)..(549): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagttagttttagacagctccaacaataagaactacttagtcttggtaccagcaagaaacccaggtcacgcctacctaagcctgcctctatttacgtgggcatccgtaacccgggaatcccggggtccctgaccgtattcagtggcgaggcgggtctggacagtattcnctctcaccatcgagcacgctagcgaggctagaacgtagtggtgacgttagtttatcgcttgcagtactaattattattacttacttccttaccgtctttaccggcccgttaggacctaaaggtgtatacgtaacaaaccgtacgtaggtcgngtacg

SEQ ID NO: 116689 - DNA, 762 bp, Homo sapiens
  misc_feature: GYAE6OF02ILCPX.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcaactgcagtccagccaggtagttgtttagacagcctccaaacaaataagaaacttaccgttaagtctttaggacctagccaagaaacccgaggtcacggcctacctaacgctcgctactatttaacgtgggctagtaccgtacccgggtaacgtccccgggggtcccttcggaccgtattccgagtcggcacgggtcgggtcgtcggggacacggttattttccgaaccgttcctaccgaacctaacgttaccgaacgacgtacggtcccgtacggaccggaagggtaccgttaacggaaaggttacgttacgggttaccgggtacgtttaagtttttacgttggtcccgttacgggttacaaggtacttaaacggtttaactttaaagtttttaaccttaaccgtttttccccgtacccgggtttacccgttttcccggggtaccccggtttaacggggtaaacccggttaaagggttacggttaacgttaacttaacccgggtaaacccgttaacggtttaccgggttacgggtacccttaacccggg

SEQ ID NO: 116690 - DNA, 743 bp, Homo sapiens
  misc_feature: GYAE6OF02I7TF8.45.37.D04.1.454.CMB.1.raw
  modified_base (459)..(459): a, c, t, g, unknown or other
  misc_feature (459)..(459): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatcgacccagtctccagacctccctggctgtgtctctgggcgaggacgggccaccatcaactgcaagtccagccagagttgtttagacagctaccaacaaataagaacttacttagcttaggtaccagaccaacgaaaccgaggtacagccctaccgtaagcctcgctactatttaccgtgggtcacgttaccgtaacccgggtaacgtcccggggtccctaggaccgtacttacgaggtcggacacgggtcgggtcgaggggactaggttactttcgaccgttcctaccacctactacggtnaccgtaacgtcctacgccgagggtcctaaggaaggttacgtcggtcgggtaacttacggttttagtcgtacggttcggtacaaacggttacctaaaagtttttagtttaaacgtttacgttttaaccgttttaccccgtttacccggtttacccgttttaccccgggttaaccccgggttaacggggttaaacccttaaaaggggtttccggttaaaccgttttaaaccgtaaaccgttaaaaccgggtttaccggttacggttacccggggtcttaaacccgg

SEQ ID NO: 116691 - DNA, 692 bp, Homo sapiens
  misc_feature: GYAE6OF02HP83Z.45.37.D04.1.454.CMB.1.raw
tcagacgcgatcgacacgaccggtgctcgatttagtagcatactgttgggtttgggggagagcatcacccagcaaccacatctgtcctctagagaatcccctgagagctccgttcctcaccatggactggacctggaggatcctcttcttggtggcagcagccacaagacgcccactcccaggtgcagctggtgcagtcgtgggctgaggtgaggaagccgtggggcctcaggtagaaggtctccgtgcgaaggtccttgtcggctacaccttaccgaccggcgtactactcctaccgtacgtgggtcgcggtaccgacgggcccctggaacggaacgggtcttaggaggtaggaggtgggagtggaactaaccgtaaccctaaagaaggttgggtacggactaaacgaaacgttatagacaacgtaagtaacgtttacggagggtacgacgggtaccaacgtagtacggaaccggaacgggtaccgtaccgtaccgaacttaccgaacgtaccaaccgtaccgtaccgtaaccgaggtacggacgtacgtacggacgtacgtaacgtactaacgactacgtacgtacggaccgtaaccggtacgtaaccttaatttaaccgtacgttacggtcggacggttacggtacgggtttaccgggtttacgggttcggttaccggttttacccggg

SEQ ID NO: 116692 - DNA, 708 bp, Homo sapiens
  misc_feature: GYAE6OF02G2903.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagcctggggcctcaggtgaaggtctccgtgcaaggcttcgtggctacaccttcgaccggcgactatcctccacgtgggtcgcgacacggcccctggacgagggtcttgaggtggagtgggatggactaccaaacccgtaacgaagttcgggtaggtaccaaacgtaaaacgttagtacgaccaacgtaaggtaacgttttaccggaacggggtacgtaacggggtaccctaaacccgaacgtaccggtaacccggaacggggaaccctaccgggttacccgaacgttaccgaacggcccgaaaccgaccgtacccgttaacgaggttacgggacggtacgtacggacgtaccgaagtaccgtaggaacctacgttaccgtacggacccgaccggtaaccgtaccgttaacgttttacttaaccggttggtacggtaccggtaagggttacgtttaccgggtttaaccgggttcggttaccgtttttaccgggg

SEQ ID NO: 116693 - DNA, 572 bp, Homo sapiens
  misc_feature: GYAE6OF02HDBBV.45.37.D04.1.454.CMB.1.raw
  modified_base (323)..(323): a, c, t, g, unknown or other
  misc_feature (323)..(323): n is a, c, g, or t
  modified_base (391)..(391): a, c, t, g, unknown or other
  misc_feature (391)..(391): n is a, c, g, or t
  modified_base (420)..(420): a, c, t, g, unknown or other
  misc_feature (420)..(420): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaacgtccagccagagtgttttagacagcctcaacaataacgaactacttagcttcggacctagcagaaaccaggtcagccctcctaagcttgcctactatttacgngggctactccgttaacccgggacgtcccggggtccctaggacccgtattcgagtggcaggcgggtcgngggcaggtactttcgacgtctacacctanccagccagcctgccagcctagacgtatggtcactagtttactacgtcgtacctaagacctaagtattagtagacgtacttccgtcttactacggtttccggaggttaccggaactaggttcgacgtactacgaaacgtacgtggtcgtacgg

SEQ ID NO: 116694 - DNA, 822 bp, Homo sapiens
  misc_feature: GYAE6OF02HHBTC.45.37.D04.1.454.CMB.1.raw
  modified_base (167)..(167): a, c, t, g, unknown or other
  misc_feature (167)..(167): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagngcccactcccaggtgcagctggtgcagtcgtggggctggaggtgaggaagccgtgggcctcgagtggagtctcgngcgaggcttncggctacaccttacgccggcgactacttctccgacgtcggggtcgcggaccgtaccggcccccgtagggaaccgacggggtcgttacggacggtggtacgtggggtagttagggactaaccgtaaaacccgtaacgtaaggttcgggtacggaaccaaacgtaaacgttcgttacggacctaaacggtaaggttaaacgttttaccgggaaggggtacgtaacgggggttacccaacccgtaacgggttacccggaaacccggtaaacgggggtaccttaacccgggttaacccgtaaccgttaacggaaccgtaaaccggtaacccggtaaacccggttccccgttaaaacgtaacgggttaccgggaaccggttacgtaacgggttacggacctaaagggtaacccgttaacgaaccgttaaccgtacgttaccggaaaccggaccgtaacccggtacgttttaaacgtttaccgtttaaggttaccggtacgggtacggttaacggttacggtttaccgggttttaacccggggtcggtttaccggtttttcgggttttaccccggg

SEQ ID NO: 116695 - DNA, 684 bp, Homo sapiens
  misc_feature: GYAE6OF02GVEG5.45.37.D04.1.454.CMB.1.raw
tcagacgcgatcgacacgaccggtgctcgatttagtagcatactgttgggtttggggagagcatcacccagcaaccacatctgtcctctagagaatcccctgagacgctccgttcctcaccatcggactggacctggaggatcctcttcttggtggcagcagccacaagagcccatcccaggtgcagctggtgcagtctgggctgaggtgaggagccgtggggcctcgagtgaaggtctcctgcaaggcttctggctaccacctttccgaccggcgtactactcctctacgtgggtcgacgtacacggccccgtggacgaacgggtcttaggtacggtgggacgtggggtagtaggtacgtacctaaaccccgttaaacgaagttgggtacgaccgtaaactaaactagtacgacaacgtaacggttaacgttttacggacggggacgtacgggtccaaccgtagtaccggaaccggacgggaccctaccgtacccactaccgaggacccaacgacgtacccgtactaggtacggacgacgtagacgaacgacggtaacgtacggaactgtaccgtacgaccggacccgtaaccggtacctttaagttttacgttacgttcgtcggttacggtacggttaccgggtttacggtttaccgggttacggttacggtttttcccggg

SEQ ID NO: 116696 - DNA, 609 bp, Homo sapiens
  misc_feature: GYAE6OF02JFMP6.45.37.D04.1.454.CMB.1.raw
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagacgcgatcgacacgaccggtgctcgatttagtagcatactgttgggtttgggggagctacaacaggcaggcaggggcagcaagatggtgtgcagacccaggtcttcatttctctgttgctctggatctctggtgcctaggggacatcgtgatggacccagtcctccgagacctcccgtggctgtcgtctcgtgggcaggacgggccaccatcaactgacaagtcccagccaagagttgtttaacgacagcctaccaactaaataacgaacttacttagccgtttaggaccagacaaggaaccaggtcagcctactaagcngctactatttacgnggacactccggaacccggagtccggggcctacgactagtcgagtcggacctggcggtcgtagggactagtactttcgactcgtccacgtatcgagcanctgcgagntagaagactggtcgtcttaagttacgtgtacgtgtacgaagaccgttaatttaagttactttaattaccttaccgtccgtacgtttacccggaaccggttaggtaaaccgtaaagttcgaagttaacgttaaccgaaacggtaccttaagggtccgacgttaccg

SEQ ID NO: 116697 - DNA, 736 bp, Homo sapiens
  misc_feature: GYAE6OF02JDVTT.45.37.D04.1.454.CMB.1.raw
  modified_base (729)..(729): a, c, t, g, unknown or other
  misc_feature (729)..(729): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgccgtacggggacatcgtgatcgaccagtctccagactccctggctgtcgtctcgtcgggcgagacgggccaccatcaactgcaacgtccacgccagtagtacgttttagacagtcctaccgaacaataacgaactacgttacgacgttacggtaccagtacgaacgtaaaaccgacggttaccaacggtaccctacctaaggtacctcggcctactacgttttacgtcgggactaacgttcccgtaaccccggggtaacgttccccggggtacccctacggaacccgtacttacgacggtcggaccgtacggtccgggttcgtacgggacctaggtacgtttccgaccttccgtaccaaccattcgaacgacacgccgtaggtacgacggtacctaggaacgtgttcggtcgtacgttacgttttagttacgtccgttaggtacctaacggtacttaaacgtttaatttaactttacttaaccttttccccgtacgttacccgttttccgggaccccgttaacgggtaaccgttaaaggtacggttaacttaaccgtaacgtaaaccgttacgtgggttacgtacccgttanaaccccg

SEQ ID NO: 116698 - DNA, 734 bp, Homo sapiens
  misc_feature: GYAE6OF02GUXIO.45.37.D04.1.454.CMB.1.raw
  modified_base (250)..(250): a, c, t, g, unknown or other
  misc_feature (250)..(250): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaatgacaagtccagccagagttgttttagacagctaccaaanaataaagaactaacttagtcttacggtaaccagactaacgaaaaccaggtacacgtccctacctaagcctcgcctactatttacgtggactagtaccgtaacccggggtaacgtccccggggtccctacggaacccgtattacgaggttacggacgacgggtcgggtcgtacgggaacagggttactttcgacttccgtaccacctataccgaagtccgaacggtccgtcgtaccgaggtccgttaaggaagttagtacgggtccgtacgttaaggttttagtcggtaccttaggtaccgtaacgtaacgttaattttaaaccgtttagtttaaacctttaaccgttaccccgttaccggttaccggttttcccgggaaccccggtttaacggggtaaacccgttaaacggttacggtaaaccgttaacgttaaacccggaaacggttaccgttaagggtccgggttaacctacggtaaccccg

SEQ ID NO: 116699 - DNA, 754 bp, Homo sapiens
  misc_feature: GYAE6OF02H6GWJ.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgacaagtccagccagagtgtttagacagcctccaaacaataagaactacttagcttaggtaccagacaagaaacccaggtcagccctacctaaagctagcctacgtatttaccgtgggccactaccgtaacccgggaaacgttcccgggggtacccttagggaacccgtaactttcgaacggttcgggaccgaacggggtccggggttaccggttacggggaaaccgacgggttaaccttttccgtaacctttacccgttaacccgaacccgtaacttaccggaaacggtcccaacggtcccgttaacgcgttaaacgggccgttaagggaaactgttacgggtggtaccgttaaggttttaattcggtacctggtaccaaggtactaaattaagtttaacttaacttaccgtttcccgtaccggttaccgtttttacccgggaaccccgtttacggggaaaccccgttaaaaggttacggttaagttaaaccttaccggaaaaaccgttaacccggttacggttcggaccgttaaccgg

SEQ ID NO: 116700 - DNA, 835 bp, Homo sapiens
  misc_feature: GYAE6OF02HTEZH.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacagtcgtgatcgaccagtctccagactcccgtgctgtcgtctcgtgggcgaggacgggccaccatacaacgtgactacgtccacgccagtagttagtttagacacgcctaaccaaaataataaacggaacttacttaacgcgttacggtaaccagtacgaaacgaaaccgtacggtaccaacgtaccgtacctaaacggtcctacgtaccttacgttaacgttttaccggtacgggtaaccttaaccgttaccccgggttaaacccgggggtaaaccggttccccggggggttaccccttacggggtaaaccccgtttacggtttaccggaacggggtttaccgggaaccggtaccggggttaccgggggtttacccgtacgggggtaaactacggtttaactttttccgaaccgttacctaacccgtaacctaacgttccgaaacggtcctaaacggttcccgaggtaaccgtacggtaccggtaaaggtaaacgtcgtcgggttaagtccgtttaaggtttacgttcggtacttacgtacggaagtaacttaaacgttttaatttaaccttatttaacccgtttccttacccgtttaccgttcccggtaccgttaacgggtaacgtaaacggttcgtaaacttactaaccggtaaagttaccggttcggtacgtacctaccgg

SEQ ID NO: 116701 - DNA, 762 bp, Homo sapiens
  misc_feature: GYAE6OF02GBEAF.45.37.D04.1.454.CMB.1.raw
  modified_base (180)..(180): a, c, t, g, unknown or other
  misc_feature (180)..(180): n is a, c, g, or t
tcagacgcgatcgacacgaccggtgctcgatttagtagcatactgttgggtttgggggaggctacaacaggcaggcaggggcagcaagatgtgttgcagacccaggtcttcatttctctgttgctctggatctctggtgcctacggggacagtcgtgatgacccagtctccagactcccnggctgtgtctctggcgagagggccaccatcaactgacagtccacgccagagtagtttagacagctaccaacaataagaactactagcttacggtacagactaacgaaaccgtaggtacacgacctacgaacgtcctagacctacgtatttaccgtaggacacgtaccgtaacccggaacggttcccgggtaccctagtaccgaacttcgaaggtcggacgtacggtacgggtcgtacggggaactacggttactttaccgtacctacgtacccaccgtaacttccggaacggtccaaccgtaccgtaccggacgtacgggtacttaacggtaacgtaccgttaggtaccgggtacgtttacgtttaacggttccgtaacggttccgtaaaccgtacggtaaaccttaaaggtttaattttacgttaaacgttttacccgttaccccgtttacccgggttaaccttttaccccggggtaccccgtaacggggttaaacccgtaaccggttaaggggttaacttaacccggtaaccgttaaaacccggttaggttaaacccgttcggggacctttaacccgggg

SEQ ID NO: 116702 - DNA, 736 bp, Homo sapiens
  misc_feature: GYAE6OF02GYGZW.45.37.D04.1.454.CMB.1.raw
  modified_base (727)..(727): a, c, t, g, unknown or other
  misc_feature (727)..(727): n is a, c, g, or t
tcagacgcgatcgacacgaccggtgctcgatttagtagcatactgttgggtttgggggagctacaacaggcaggcgagggggcagcaagatcggtgttgcagacccaggtcttcatttctctgttgctctggatctctggtgcctacggggacatcgtgatgacccagtctccagactccctggctgtgtctcgtgggcgaggaggccacatcaactgacacgtccagccagagttgtttagacagcctaccaaactaaataagtaacctaacttacgcgttagggtacccagtacaacgaaaccaggtaccaggtcccttacctaaggcctcgacctatactttaccgtgggctacgtacccggtaacccggggaagttccccgggggtacccgtgaaccggtattcgagggtcggacgagggtccgggtctacggggaactaggttactttaccaccttaccgtacccgtaacctaacttaccggacgtccgtaacggtccccttaagggacccgagggtaccgttaaggaagttacgttacgggtgtaccgtttagttttacttcgggtcgttacgtacgaaagtacctttaaagtttaactttatttaaccgttacttttaccccgtacggttacccgttttccggggaacccggttaaccggaaagttaaccgggttagtaccttaaaccgttaacgaaacccggttaggtacggtacggtnttaacccgg

SEQ ID NO: 116703 - DNA, 679 bp, Homo sapiens
  misc_feature: GYAE6OF02HYUT8.45.37.D04.1.454.CMB.1.raw
tcagacgcgatcgacacgaccggtgctcgatttagtagcatactgttggggtttgggggctacaacaggcaggcaggggcagcaagatggtgttgcagacccaggtcttcatttctctgttgctctggatctctggtgcctacggggacatcgtgatgacccagtctccagacctcctggctgtgtctctgggcgaggacggccaccatacgaactgcaagtccagccaagagttgttttaagactagctaccaaacaaataaagaaccttacttagcgttggtaaccagacagaaaaccagggttacacgccttacctaaagcctgtcctactatttaccgtgggacacgttccgtacccggggtaacgtcccggggtccctaggacccgtaatttccgaaggtcgggtacgacgggtccgggtcgtacggggtaccaaggtttaccgttttaccgaccttccctaacgaaccccgtagtacccgtaaggcctacggtccccgtaggcctacggggtacctaggtaacgtagtttcggagttacgttagtttacgttgccgttaggctacgtataattatttataacgttactcgtcccgtagtttccgaccggttaggaaccgtaaggtcgtaagttaactaaccgtaacggtacgttacggacggtcgttagaccc

SEQ ID NO: 116704 - DNA, 714 bp, Homo sapiens
  misc_feature: GYAE6OF02IQW8C.45.37.D04.1.454.CMB.1.raw
  modified_base (87)..(87): a, c, t, g, unknown or other
  misc_feature (87)..(87): n is a, c, g, or t
  modified_base (155)..(155): a, c, t, g, unknown or other
  misc_feature (155)..(155): n is a, c, g, or t
  modified_base (164)..(164): a, c, t, g, unknown or other
  misc_feature (164)..(164): n is a, c, g, or t
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (268)..(268): a, c, t, g, unknown or other
  misc_feature (268)..(268): n is a, c, g, or t
  modified_base (315)..(315): a, c, t, g, unknown or other
  misc_feature (315)..(315): n is a, c, g, or t
  modified_base (660)..(660): a, c, t, g, unknown or other
  misc_feature (660)..(660): n is a, c, g, or t
  modified_base (694)..(694): a, c, t, g, unknown or other
  misc_feature (694)..(694): n is a, c, g, or t
tcagacgcgatcgacacgaccggtgctcgatttagtagcatactgttgggtttgggggagcatcacccagcaaccacatctgtcctntagagaatcccctgagagctccgttcctcaccagtggactggaccgtggagactcctcttctggtggnagcagccanagacgcccactccgaggtcgcagtcgtggngtcgaggtcgtggggcnggaggtaggaggacgccggtgggccttgagtgaacggtcctcgtgacaggtcttcgnggtctacgtaacccttcgaccggcgtaatcgtccgtcagggttcggngaccggaccgtaccggtaccggtacggacgtaacgggtcttacggacgggttggaggtacggtagtcggtaacttacccaaaaccgtagaacggtgggtaccgaaccgaagttaacgtcgtaacggacttaaaccgtaagggttaaaccgtttcgggaacgggtaccgttaacggtccgtaaacgttacggtaacggacccggttaaacgggaaccttaccggttaaccaagtaccggactaccggtactacgaaccgtacgtaggtccgtagaccgtagctaaccgattacggactaccgtcgtacgacgtacggacgttacctagttaatttacgacggtttnacggtagttacggtaagttccggttaaccgggtnttacccgtttagtttaccgg

SEQ ID NO: 116705 - DNA, 803 bp, Homo sapiens
  misc_feature: GYAE6OF02HT2ES.45.37.D04.1.454.CMB.1.raw
  modified_base (231)..(231): a, c, t, g, unknown or other
  misc_feature (231)..(231): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagcgcccactcccgaggtcgcagctggtgcagtcgtggggctggaggtgaggagccgtgggcctcgngtgagtctctgcaagtcttctcggctaccaccttcgaccggcgtactactcctaccgtacgtgggtcgaccggaccgacgggtccccgttagggaaccgtaaggggtccgtttacggtaggttacgggtaggtacggggtaaggttacgggtaacctaacccgtaaaacccggtaaacgtaaacggtttagggtaccgggaacctaaaaccgtaaaaacgttaccgtacggaacccgtaacggtaaacggttaaacggttttccgggaaagggggtacccgtaaagggggtacccctaaaccggtaacgttaaaccgggaacccgggtaaagggtaacccgtaaacccggtaccgtaacccgttacgaaccggttaccgaaaccgttaaccgggacccttaaacggtacgtaacgggtacgtacggttacgacggacgtacgtaccgtagaactacgtacgaccggtaacgtacccggtacgtaaccgttactttaccggtacgtcggtaacggtcggtaacggttcggttaccggttaccggttcggttaccggttttcggtttaaccggg

SEQ ID NO: 116706 - DNA, 793 bp, Homo sapiens
  misc_feature: GYAE6OF02GDHE4.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtgcagcagccaacaagagcccactcccaggtcgcagctggtgcgtagtcgtggggctgagggtgaggaacgccgtggggcctcgaggtgaaggtcctccgtgcgaaggccttcgtggtcctactaccttccgaccggccgaacttacgtcctcccgaacgtggggtcgccggacaccgggccccctagggaaccgtaacgggtcctttggacggttaggacgtagggggtacgttacgggacttaacccgaaaaccccgtaacgtaacgggttcggggtacggtaacccgtaaaccgtaaaacgtacgttaacggaacccgtaaacgtaacgggtttaaacgtttaccgggaggggtaccgtaacggggtacctaaaccgtaacgtacccggaaacccggaaccggggtaaccgtaaccggttacccgaagtaccgaccgtacaaccgtaccgaccctaacgtaagtcgggaacgtaccggttagaaccgacgtaacgtacgtaacggtactaaccggttactaccggaccggaacccgtaacggtaccttaacgtttttacgtaacgttcggttaacggtaccggttacgggtaacggttttcccgggttaaccgggttcgggttaccggtttttaccggg

SEQ ID NO: 116707 - DNA, 872 bp, Homo sapiens
  misc_feature: GYAE6OF02I0BYI.45.37.D04.1.454.CMB.1.raw
tcagacgcgatcgacacgaccggtgctcgatttagtagcatactgttgggtttggggagagcatcacccagcaaccacatctgtcctctagagaactcccctgagagctccgttcctcaccatggactggactggagatcctcttcttggtggcagcacgccacaagacgcccactcccgaggtgcgacgcgtggtgaccagtcggtggggctggacggtggacggaacgccggtcgggggtccctcgacgggttaggaacggttccgttacccgtcggaccgtaaacgggttccgtttccgtcgggtacccttaaccgtaacccgtttccgaccccgggtacgtaaccttaacctccgttacccggtaccgttcggggggttaccggaccggtaaccggaccgggtcccccggttaggaaaccggtacggggttaccgttagggtaacgggttgggtaacggttagggggtaacgttacggggtaaccttaacccggtaaaacccgttaaacgtaacgggttcggggtacggtacccgtaaaacgttaaacgtaacggtcgaaacccgttaacgggtaacggttaacgggtttaccgggacggggtaaccgtaacgggggtaaccctaacggttaacccggtacggaacccgggtaaaccggtaaccgtacccgttaaacccggtaactcccgggaaacgttaaccaaccgggaacttaacccgtaacggtaggtacgggtacccagttacgaacggacgttaacgtaacgaggttacctacgtagaccggtacgaccggtaccgtaaccttacgtttaccgtgttaccgcggtacggacgttacgttacggtcggtcgttaccgtttcgg

SEQ ID NO: 116708 - DNA, 674 bp, Homo sapiens
  misc_feature: GYAE6OF02JL1EC.45.37.D04.1.454.CMB.1.raw
  modified_base (513)..(513): a, c, t, g, unknown or other
  misc_feature (513)..(513): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagcgtggtgcagtcgtgggggctggacggtggaggaaggcccgtgggggcctacgaggtaggaacggttcctccgtgacgaacggtctttacgtggtactaccgtaccttacgaccggcgaactactcctccacgtggtcgacgacacggcccgtaggacgtaacgggtcttaggaggtcggtaagtcgggaagtcggtactaccgtaaaccctaagaccgttgggacgacaactaaaccgtagtcgacaacgtaggtaacgttcgagggacgtaggtacctaacgacgtacaacgggtacggacgtacgacgacgtcgacgtacgaacncgacctactaggtacggaacgtctaaggactacgacgtacgtaacgactacgtaccgtagtacgaccgtaccggtaccttaagtttaacgtacgttagaccggtacggtaaggttaccggttaccggtttaccgggtcggttccggtttacgttttaccgg

SEQ ID NO: 116709 - DNA, 601 bp, Homo sapiens
  misc_feature: GYAE6OF02G153A.45.37.D04.1.454.CMB.1.raw
  modified_base (481)..(481): a, c, t, g, unknown or other
  misc_feature (481)..(481): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactgggacctggaggatcctcttcttggtggcagcagccacaagagcccactcccaggtgcagctggtgcagtctgggggctggaggtgaggaagtccgtggggccctcgagtgaacggtctccgtgcaaggcttctggctaccaccttcaccggcgactatctccacgtgggtcgcgacacggccccgtggacaaggggtcttcggagtaggatgggatcgggatccaaacccgtaagaagttcgggtacgaccaacgaaacgtatcgaccacgaacgtaaggtttcgacgggtacgtacgggtacacgatcggaaccgagggacacgtccagtcagacacacgcctacagtcggancgtagcgactacgactacgaactctcgtagaccgacgaccgacctaagtttacttacgtggttacggcggtaacggtagtttccggtttaacggccggttacgtttcggtttttacccgg

SEQ ID NO: 116710 - DNA, 730 bp, Homo sapiens
  misc_feature: GYAE6OF02I3917.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcgttggtggcagcagccacaagacgcccactcccaggtgcagcgtggtgcagtcgtgggctggaggtgaggagccgtcgggcctcaggtgaacggtcctcctgcgaaggtccttgtcggctacctaccttccgaccggtccgtaactactcctccacgtgggtcgcgacgacggccccgtggaacgtagggcgtgacggtaggagtggagtaggactaccgaaaccgtaaacaggtacggtacggacaaacgtaaacgtacgtagacctaagaacggtaagtttacggaacggcgtaacgggtacccacgtaacgtacgaaccggacgggaacctaccgtacgactacgacgtaccgaaccgtaacgaccctaagtacgtacgggacgtaccgagtacgacgaacggtaaccgtacgtaaacgtacgttaccgtaacgggtacccgtaccgggaacccgttaacgttaaaccgtttttaacgtaccggttacggtacgggttaacgggtaacggtttaacgggttttacccgggttacccggggtttacgggtttacccggtttacgggtttttttaaccccggg

SEQ ID NO: 116711 - DNA, 858 bp, Homo sapiens
  misc_feature: GYAE6OF02GMDBP.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggaccgtggaggactcctcttcttggtggcagcagcccaacaacgacgcccacctacccgaggtcgcagcgtggtgcagtcgtggggtctggtaggtggaggaacgccggtcggggtcctcgaaggtggaacggtctccgtgacgaacggtctcgtggtacctacctaccgtccgaccggccgaacgttactcccgtacctcggtcgggtcgaccggtaccgaccggtaccccgtagggaaccggtaacgggttcggttacggtaggtacgggttaaggttaggggaacggttcggtaacctaaaccccgtaaacccgtaaaacggtaacggttcgggtaaccggaactaaaacccgtaaaacgtacgtacgaaccgaaacggtaaaggttaacggttacgggaacgggtacggtaaacggtaccgaacaccggtaacggtaacccggaaacggttaccgaacccggttacctaacgtaccggaacggaaccctaaccgaacccgggtaaaccttaccggaaacgtacgggaacggttccgaacggtacgaaccgtaaccgttaacgtaaccggtactaaaccctcggtaaccggaaaccggtaccccgtaacgggttaacctttaacgtttaaacggtttaccggtaggttaaccccggtagggtaaccggtttaccggtttaaccggtttaccggggttcggttttaccggtttccggtttttaacccgg

SEQ ID NO: 116712 - DNA, 762 bp, Homo sapiens
  misc_feature: GYAE6OF02G0KIK.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagccccactcccaggtgcagctggtgcagtcgtgggctggaggtgaggaacgccgtcggggcctcgaggtgaaggtcctccgtgcgaaggtcgttctcggtctaacctaccttccgaccggacgaccttacgtcctaccctaccgtggggtcgaccgtaccgaccgggtcccctacgggaacgaacggggtcttaggacggtcggaaggtacggggattcgggaactaccgtaaaaccctaacgtaaacggttgggtacggtaccaaaccgtaaacttaagtaccggtaacaaccgttaacggttaaacggttttaccgaacgggggtacgtaaccgggtaccgtaacccgtaaggtaccgggaacccgtaacggggtaaacccgtaacccggttacccgaaccgttaaccgacgaccaaccgaacgtacccgtaacgaggtacggagtacgaacggtcgaacgacggtacgtaagaccgtattaccgacgaccggtaccgaaccggtaccgttaacttttacgttaacgtacggtacgacggttaacggttacggtttaccgggtttacgggttcggttacggtttttacccgg

SEQ ID NO: 116713 - DNA, 782 bp, Homo sapiens
  misc_feature: GYAE6OF02IC6LW.45.37.D04.1.454.CMB.1.raw
  modified_base (182)..(182): a, c, t, g, unknown or other
  misc_feature (182)..(182): n is a, c, g, or t
  modified_base (201)..(201): a, c, t, g, unknown or other
  misc_feature (201)..(201): n is a, c, g, or t
  modified_base (730)..(730): a, c, t, g, unknown or other
  misc_feature (730)..(730): n is a, c, g, or t
tcagacgcgatcgacacgaccggtgctcgatttagtagcatactggttgggtttgggcatcacccagcaaccacatctgtaccctctagagaatcccctgagagctccgttcctcaccatcggactggacctggaggatcctcttcttggtgcagcagccacaagcgcccactcccaggtcncgagctggtgcgaggtcgnggggctaggaggtgaggacgccgtggggcctcgagtaggaacggtctccgtgacgtaaggtccttcgtacggtccttacctacctttaccggacccggtacgtaacttacgttccgtaccgtacggttcggggttcgacccggaacgaccgggtaccccgtaggggaccgaaacggggtttccgttagggtacgggtacgggtaccgggttagggtaacgtttcgggaaccgttaaaccctaaaacccgtaaaggtacggttaggggttaaccggaccctaaaacgtaaaccgttcggaccgtaaccgaactaaacgggttacggtttacggacgggtaccggttaacgggacctaaccgtacggtaaccggaaccgtaacgggaacccgtaccgtaccgtaaactacgaaccgtaccgtaacgtaaccggtaccgtaacgtacggtacggaactccggtaaggtaccgtcgaacgtaccgtacgtaaacgttccacgtcgaaccgacgtacgaacgttattcgtacgngtaccgtagtacgtacgttacggttcggtacgttcgtttcggttcttacggg

SEQ ID NO: 116714 - DNA, 837 bp, Homo sapiens
  misc_feature: GYAE6OF02GCPNG.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaccagtctcagactccctgactgtgtctcgtggcgagacgggccaccatcaactgacacggtccacgccgagtaggttagttttacgactacgcctaaccaaactaaactaaacggtaaaccttaacgttaacgtccgtttacggtaaccctaaggaccgaaacgtaaaacccgtagggtaccaacggtccccttaaccgtaaacgtaccgttcggaccttacctaacgtttaaccggtgggaaccgtacttacccggtaacccggggtaaacggttccccgggggtcccgtaacggtacccgtaacgttaccgtaacgggtcggtaccgtaacgggtcggtacggtacggggaacctacggtactttaccgtacctccgttaccgaactacgtacgacggtaccgacgtacccgtcggtaaccggacggtacgtaaggaaaacggttcggttacggtacgggtaccgttttaaggtttacgtcggttaaccgttcgggtaaaccgtacgtaaccgttaaaattacttttaaacggtttaacttacccgtttaccccgttacgggttaaccccttttccggggtaacccgttaaccggggttaaccttaaacgggttacggaaacttaacccggtaacgaaaccggttaaaccgtcggttaccgggaccttaacccgg

SEQ ID NO: 116715 - DNA, 629 bp, Homo sapiens
  misc_feature: GYAE6OF02FKQKU.45.37.D04.1.454.CMB.1.raw
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
  modified_base (470)..(470): a, c, t, g, unknown or other
  misc_feature (470)..(470): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtcgtggggctgaggtgaggaagccgtggggcctcaggtgaaggtcctctgcaaggcttcgtggctacaccttcgaccggcgactactcctccacgtgggtcgcgacgacggcccctggacgaagggcttggagtggagtgggatggactaccaacctaacgagtggtgacgaactaaactacgtancaacgtagtaacgtttcgacgggngtacgggtaccaacgtgtacggaccgtacgggacctacgtaccagtcgagaccacacgcctaacngtacgggactcgtagacgtcggaggtaccgagaacggtacttcgaacggtaccgaccgggaccggttaccggttacggtttaacgttaaccgttcgggtacggtacgggtaagggtaccgggaccgggttaaggtaacggttttaccggttttaagggg

SEQ ID NO: 116716 - DNA, 791 bp, Homo sapiens
  misc_feature: GYAE6OF02JM7HO.45.37.D04.1.454.CMB.1.raw
  modified_base (194)..(194): a, c, t, g, unknown or other
  misc_feature (194)..(194): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctgatctctgtcgcctacgggactatcgtgatgacccagtctccagactcctggctgtgtctcgtgggngagacggccaccactcaactgcaacgtccacgccagtcgttagtttacgcacgcctaccaacaataacgaacttacttagtccgttacggtacccagacaaccggtaaaccacggtaccgaacgtcccttaaccgtaagcgtagacgttactaatttaccggtcgggtactaccgttacccggaaccccgggttaacgttccccgggggttacccttacgggtaccgttactacccgtagggttccgaccgtaacgggtcccgggttccgggtaacggtaacctaccggtttagtttaaccccgttacgttacccgtaccctaaacccttacggttacccgaaacggtccgtaaaccgtccgttacggtaccgaccggtaccgtttaacggaacgttacggtacgggtttacggaccggttttacgttttacgtaggttcctttccggtaacgtaacgttaacgttaacgtttactttaaacggttactttaccggtaccgtttaccccggttacgtttcccggtacggttaccgtaacggtacgttaacgtaccgtaacgttacgtaaccgtaacgttcggtaccgttgtaaccgg

SEQ ID NO: 116717 - DNA, 777 bp, Homo sapiens
  misc_feature: GYAE6OF02IVG1U.45.37.D04.1.454.CMB.1.raw
tcagacgcgatcgacacgaccggtgctcgatttagtagcatactgttggggtttgggggagctacaacaggcaggcaggggcagcaagatggtgttgcagacccaggtcttcatttctctgttgctctggatctctggtgcctacggggacatcgtgatgacccagtcctccagacctccctggctgtgtctcgtgggcgaggacggccaccgatcaacgtgacaacgtccacgccagtacgttaggtttagactagcctaccaaactaaataacgaacttacgttagtcgttacggtacccagtaccaacggaaaccgaggtacacgtacccttaccgtaacgtccgtcgacttaccgttactttacggtcggactacgtacccggtaacccgggtaacggttcccggggttaccctacgaaccgtacgttcgaggtcggacgtacgggtcgggtcgtgggaacacgttactttccgtaccgtcctaccgtacctagtccgacgtcgtacgtccgttgaccggtacggtactaacggaagttcggttcggtagggtaccttttaagggtttagttcggccgtttaggtaccgtaacggtaactttaaagttttaacgttttactttaaacttacccgtttaccccgttacccgggttacccttttccccggggtaacccgttaaccggggtaaacccgttaaagggtcccggttaaacttaacccgttaaaccgtaaaccggttaccgtttacgggttaccgtcccgttaacccgg

SEQ ID NO: 116718 - DNA, 624 bp, Homo sapiens
  misc_feature: GYAE6OF02HTRB0.45.37.D04.1.454.CMB.1.raw
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
tcagacgcgatcgacacgaccggtgctcgatttagtagcatactgttgggtttgggcatcacccagcaaccacatctgtcctctagagaatcccctgagagctccgttctcaccatggactggacctggaggatcctcttcgttggtggcagcagccacaagagcccactcccaggtgcagctggtgcagtcgtggggctggagggtgaggaagccgtggggcctcgagtcgaaggttcctccgtgcaaggtcttcgtggctacncttcaccggcgactatcctcactgggtncganacggccctaggacaaggcttggacgtggatgggatggataccaacctaaacgaagttggacgggtacaaccgtaaactagttcgaactaacgaagtaacgtttcgaacgggcgtaggtaccacagtacgacgaggactacgacancgancacngacacagtcggatcgtagacgcgtacgtagtacgtaacgtacgtacgacggaccgaaccggaccgttacccggttaagttttaacgtttaaccggtggttacgacgggttaaggtcgttaaccgggtttaccggttacgggttaccgtttcgggttttaccgttttaacccggg

SEQ ID NO: 116719 - DNA, 741 bp, Homo sapiens
  misc_feature: GYAE6OF02I4E7M.45.37.D04.1.454.CMB.1.raw
  modified_base (344)..(344): a, c, t, g, unknown or other
  misc_feature (344)..(344): n is a, c, g, or t
  modified_base (392)..(392): a, c, t, g, unknown or other
  misc_feature (392)..(392): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgacaacgtcccacgaccagtagttaggttttagaccgagcctacccaaactaaagtaacgaaccttacttagcttggtaacccagcaaagaaaccaggtcacggcctacgtaagcctgctctatttacngggtcagtccgtacccgggatcccggggtcctgaccgtatcagtgacngtcggtctggggacagtcgtttccacttccgtccaacctagtaccgacggccaacggtcccgtagacccggacgggtaccttagggaaacgtacgtttgggaccgggttacttaaacgggtttttacttcgggtaccgtttacgtaccgtaaggtaacccttaaagttttaacgtttaaccttttaacgttttccggttaccccgtttacccggtttaacccgtttttacccggggccccccggtttaaagggggtaaaccccctaaaaggggtttcccggaaagttttaaccctaacccgggttaaaacccgacccgggttttgggttacccgttaccgggtaacccg

SEQ ID NO: 116720 - DNA, 679 bp, Homo sapiens
  misc_feature: GYAE6OF02G3LKS.45.37.D04.1.454.CMB.1.raw
  modified_base (670)..(670): a, c, t, g, unknown or other
  misc_feature (670)..(670): n is a, c, g, or t
tcagacgcgatcgacacgaccggtgctcgatttagtagcatactgttgggtttgggggagctacaacaggcaggcaggggcagcaagatggtgttgcagacccaggtcttcattttctctgttgctctggatctctggtcgaccgtacggggacatcgtgatcgacccagtctccagacctcctggctgtcgtctcgtgggcgagacgggcctacagtcaactgacaacgtccagccaagtacgttgtttagacagcctaccaaacaataacgaacttatagtcttacggtacagacaacgaaaccgaggtcagtcctacgtaacgctgactctaatttacggcggtactacgtaccggtaacccgggacgttcccgggtaccctagtaaccgtattccgaggtcgacgacggtcgggtcgtacgggaactagtactttacctacgtcgacctacacgtcgacgtcacgtcgtagacgtagaccgtaaggagttacgtgtacggtacttagtttagtcgtcgttacgtaaacctgtaaccttaaagtttacgtttaattaacgtttacccgttaccttacccggtttacgtttcccgggaaccggttaacggttaacctaagggtacgttaaacgttacgttaaccgaaccggttacgtggttacccggnttaacccgg

SEQ ID NO: 116721 - DNA, 742 bp, Homo sapiens
  misc_feature: GYAE6OF02F4RR4.45.37.D04.1.454.CMB.1.raw
  modified_base (327)..(327): a, c, t, g, unknown or other
  misc_feature (327)..(327): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaacgtccagccagagttgttttaagacagctaccaaacaataaagaactacttagcttaggtaccagcaagaaaccaggtcagccctacctaacgctgctactatttacgngggtcactccgtaacccggggtaacgtcccgggtccctacggaccgtacttacgacggtcggacgacggtccgggtcgtacgggacgtacgtagtttccgacctcgttaccactactaccgacgacacgccttcgcgacggtgtacggaaagtcgttaacgggtcgaccgtttaaggttttattcgggttcgttacggtaccgtacgtaaccgttaaagtttaactttttaaacgttacttttaacccgtttaccccttacccggttttacccgtttaccccgggttaaccccggggttaaccgggggtaaaacccttaaacgggtttaaccgggttaaacgtttaaccggttaaacccggtaaaaaccggttcccgggtttaacggtaacgggttaccctaccggttaaacccc

SEQ ID NO: 116722 - DNA, 667 bp, Homo sapiens
  misc_feature: GYAE6OF02GBQE1.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcaactggtgcagtcgtgggctggaggtgaggagccgtgggcctcgagtgaaggtcctccgtgacacggtcttcgtggcctacctaccttccgaccggcgactactctaccacgtgggtgacgacgaccggccccgtaggacgaggtcgttagaggtggagtagggagtcggactaccgtaaacccgtaagtacgttcgggtaggaccaaactaaactcgtacgaactaagtaacgtaaggtttcgaacgggtacgacgggtaccaaccgtagtaccggaaccggaggtaacccaccgtaccacgtaccgaacgccaacgaccgacccttacgacgtggtacgacgtaggaacgcgaacgtacgttaacgactacgtggacgacccgacggtacccgtctttaatttacgttacgtaggtaccgtagtaggtttcggtttacgggttcgggttaggttccggttttaccggttttgtttaaccggg

SEQ ID NO: 116723 - DNA, 685 bp, Homo sapiens
  misc_feature: GYAE6OF02I4Z9K.45.37.D04.1.454.CMB.1.raw
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
tcagacgcgatcgacacgaccggtgctcgatttagtagcatactgttgggtttgggggagctacaacaggcaggcagggggcagcaagatggtgttgcagacccaggtcttcatttctctgttgctctggatctctggtgcctacggggacatcggtgatgacccagtctccagacctccctggctgtgtctctgggcgagagggccaccatcaactgacaagtccagccagtagttgtttagacagctaccaacaataagaacttactagtcttcggtaccagacaagaaaccgagtcagcctacgtanctgctctatttacgnggnactccgtaccgggaacgtcccggggtcctacgaccgtattaccgaggtcggacgtaggccgggttgtacgggacgtagtactttccacttctacacctatccgacgctacgcctgcgaacgtcgtaagaagtagtggtacggcgtttaaggttttacgttcgtccgttacggactaacggtacttaaactttaagttttaaactttaaacgttttcctttaccccggttaccgttaacccggttttcccgggaaccccggttaacggggtaaacccggtaaaaggttcgggtaaaccctttaacggttaaaccgtaaaccggtttaaccggttggttaccgggtacgtaaccccggg

SEQ ID NO: 116724 - DNA, 751 bp, Homo sapiens
  misc_feature: GYAE6OF02JHMYF.45.37.D04.1.454.CMB.1.raw
  modified_base (340)..(340): a, c, t, g, unknown or other
  misc_feature (340)..(340): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgacaagtccagccagagttgtttacgactagctaccaaataataagaactacttaagcgttacggtaaccagtacaacggaaaccaggtcaagcctacccgtaagtctacgctactaacttttacgngggtacacgttaccggtacccggtaaacggttcccggggtaccctcgaaccggtattaccgacggtggacgacgggtccggggttacgtacggggaaactacggttacttttaccgaacccgtttcctaacccgtaacctactttacccggaaccgtacccggaccggtaacccgttcgaccggtaaccgggttacccgtaacggtaaagtacgttcccggggttggttaacccgttaaggtttttaacgttcggtacttaccgggtaccgtaagtaaccttaaagtttaattttaaccttaacgtttaacccgtttcccgttaccgtaccgtttcccgggtaaccccggttacggtaacgttaaaggtcggtaattacggtaactaaccgtagtacggttacgcgtaccg

SEQ ID NO: 116725 - DNA, 674 bp, Homo sapiens
  misc_feature: GYAE6OF02GROXE.45.37.D04.1.454.CMB.1.raw
  modified_base (233)..(233): a, c, t, g, unknown or other
  misc_feature (233)..(233): n is a, c, g, or t
  modified_base (280)..(280): a, c, t, g, unknown or other
  misc_feature (280)..(280): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagccccactcccaggtgcagctggtgcagtcgtggggctgaggtgaggaagccgtggggcctacgngtgaaggtctctgcaaggcttcgtggctacaccttcaccggcgactntcctccacgtgggtcgcgacgacggccccgtggacgaagggcttagaggtggagtgggagtggataccaacctaacaagtggtaggcaaacaactatacgacacaggtaacgtttcgacgggacgtacgggtaccgaaaccgtagtacggaaacccggaaggggaaccgaccggttaacccgacgtaccgaacggacccaaacgacgacccgtacctagtacgggacggcgtacggaacggtccgaacggtaccgtacgtaacccgtaagttccgtacggacccggaccgtaaccgggtaaccgttaacgttttaactttaacgttaccggttggtaccgggtaggttacggttttaccgggtttaccgggttgggttccgtttttacccgggg

SEQ ID NO: 116726 - DNA, 744 bp, Homo sapiens
  misc_feature: GYAE6OF02GVART.45.37.D04.1.454.CMB.1.raw
  modified_base (266)..(266): a, c, t, g, unknown or other
  misc_feature (266)..(266): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgccccactcccgaggtgcagctggtgcagtcgtcgggctggaggtgaggagccgtcggggcctcgagtggaaggtcctccgtgacaaggtccttcgnggtactaccaccttccgaccggtccgaactactccgtaccacgttcgggtgtaccgaaccacgggccccgtaggaaccgaggggtccttaggaggtggtacgtggggtatcggaactacccgaacccgtaaagagttgggtacgacgtaaacaaacgtagtacgacgaacgtaacggtaacggttttcggaacgggtcgtaacggggtacccaacgtacgtaacggaaccggtaacgggaacctaccgtcccaacgtcgaacggaccaccgaacgtacccgaacgtaacggcgaaaccggtgtaccggaagaccggaacgtccgtaacggaaccttacgtacgtaccggaacgtaacccggtaacggttacccgtttaacgtttttaaacgtaccgggttacgtacgggttaacggttaacgggtttaacccggttttagggtttacccgggttaccgggttacttttttacccgggg

SEQ ID NO: 116727 - DNA, 579 bp, Homo sapiens
  misc_feature: GYAE6OF02FM4OQ.45.37.D04.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
  modified_base (326)..(326): a, c, t, g, unknown or other
  misc_feature (326)..(326): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (451)..(451): a, c, t, g, unknown or other
  misc_feature (451)..(451): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactcctggctgtgtctctgggcgagngggccaccatccaactgacaacgtccacgccagagttgtttagacacgctaccaanaataacgaactactagacgttgtaccagacagaaaccagtcacgcctacctaagctcgactctactttacgnggactactccggtaacccgggagtcccggggtcctagtaccgtacttcgaggtcggcgacggcgggtcgtagggacagtacttcgactccncacctntcgacgcacgtcctgaccaggctagagngttgtcgtacttaggtttatcgtctagctagacttaatattattacttactccgttacctcgtttaccggaccgtacggaaccgtaagtcgaacttacgtaacgaaccttacgtgggtacgtataccg

SEQ ID NO: 116728 - DNA, 829 bp, Homo sapiens
  misc_feature: GYAE6OF02JWYS1.45.37.D04.1.454.CMB.1.raw
tcagacgcgatcgacacgaccggtgctcgatttagtagcatactgtgggtttgggggagctacaacaggcaggcaggggcagcaagatggtgttgcagacccaggtcttcatttctctgtgctctgatcgtctggtcgtccgtacgggactagtcgtgataccgaccgtactcctacgaccgtccctccgtgtcgttggttccttcgtgggcgaggacggggccaccgatcaacttaggccaagtccagaccacgtaagtcgttttaggacctacgactacctaacaattaaacgtaactacttaggtaccttagggtaacccctacggtaccaggtaaaccaacggttcaacggacgtccctaaagtcgtgaccgttacctacggttacctgggtaccctaacggtacgtacccccggggtaactcccggggtacccttaacggaccgttaacgtcgtacggtccggtacggtacggttaccggtacggtacgtaacgtaacgttcccgttacgtaccgtaccgtaccgtaacgtcccgtaacggaccctacggtaccgtaccgggtaccctaaggggtaaccgttacggtaaacgggttacgtaccgttaggggtttaaccttaaccgggtttaccgttttacggttaccccgttaagggttaaccctaacggttaacgttaaaccgttaattttaaaccggtttaaccctaacgtttaccccgttaccgggtacccgtttacgggaacccctttaaggggtcccgtaacccggtacgtaaaccgtaacgttcgtaacgaccgttacgaacgtctacgtctaacccg

SEQ ID NO: 116729 - DNA, 871 bp, Homo sapiens
  misc_feature: GYAE6OF02IRIVU.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtcgtctctgggcgaggacggccacatcaacgtgcaacgtccacgccagtacgttgtttacgactacgcctaccaaacaaataacggaaccttaacgttacgtcgtttacggtaacccagtaccgaacggaaaacccgtacggtaccgacgtcccgttaccgtaacgtccgttcggacctttacctaacgtttttaccgacggggtacctaaccgtttaccggtaaacccccggggtaacggttccccgggggttaccccttacgggtaacccgttaagtttaccggtaacggttacggggtaccctaacggggttccggggtttacggtacgggggtaacctaacggtttaccgtttttaccacccgtttccgtaacccctaaccgtaacgtttaccgaacggttaccggtaaccgtcccttaccgggaccgtaacgggtaccgttaacgggaacggtttaacgttcggggttaccggttaccgtttaagggtttttacgttcggtaccgtttacggtactaacggtaaccttaaaaggtttttacttaaactttttaaccgtacctttacccggtttacccgttaaccgttttcccccgggacgtttaacccgggaaacctttaagggtacgttaaacgtacgttaaaccggttaacgtaccggttcggtacggtaccttaaccgg

SEQ ID NO: 116730 - DNA, 778 bp, Homo sapiens
  misc_feature: GYAE6OF02JX5LZ.45.37.D04.1.454.CMB.1.raw
  modified_base (324)..(324): a, c, t, g, unknown or other
  misc_feature (324)..(324): n is a, c, g, or t
  modified_base (771)..(771): a, c, t, g, unknown or other
  misc_feature (771)..(771): n is a, c, g, or t
tcagacgcgatcgacacgaccggtgctcgatttagtagcatactgttgggtttgggggagctacaacaggcaggcagggcagcaagatggtgttgcagacccaggtcttcatttctctgttgctctggatctctggtgcctagggacatcgtgatgacccagtctccagactccctggctgtgtctcgtggcgagagggccacatcaactcgcaagtcacgcagagttacgtttagacagctacaacaataacgaacttacgttactcgttacggtacagtacaacgttaaacccgaggtaccgacgtaccttaaccgttaacncggtacgtaccttctaactttttaacggcgggactaacgttacccgggtaaccgggtaaaccgtcccgggggttcccttacggtaacccggtatttaccggaacgggtttccgacggtaaacggttccggggttaacggtacggggtaaaccgtaacggtttaacgttttccaaccgggttcccttacccgtaacgtaccttacggaacggttaaccgaacgggtccgttacggaccggtaaacgtccgtaaggtaaaacccgtaggtttcgggtaccgtaacgttaaaggttttcttcgtacggtacgtaacgtacggtaacttaagtttactttacgttaacgtacgtttccccttacgttacgttttacccgggccggttttaaaccggaactaaggttaccggtaattaacgtaccggtaaaccgttaggttcgaccggtttntaaccgg

SEQ ID NO: 116731 - DNA, 814 bp, Homo sapiens
  misc_feature: GYAE6OF02GZZTN.45.37.D04.1.454.CMB.1.raw
tcagacgcgatcgacacgaccggtgctcgatttagtagcatactgtgggtttgggggagctacaacaggcaggcaggggcagcaagatggtgttgcagacccaggtcttcatttctctgttgctcgtggatctctggtagccgtacggggacatcgtgatcgaccagtctcagtacctccgtggctgtgtctcgtgggcgaggacggtccacataccaactgacaacgtccaacgccgagtaggttagtttagacctacgacctaccaaaacgtaaacgtaaacgtaaccttaacgttaacgtccgtttacggtaacccaagaccgtaaacggaaacccgtaggtaccacgtaccctaccgtaacgcttacgtaccttacgtactttaccggcggtaccgtacgtaaccgggtaccccgggtacggttaccccggggtcctaccggtaaccgttataccggtaggtcggacgtacgggtacgggttaccgtagggtaaccgtaacgtttacgttaaccgtctacccgtaccgaaccttacgtcgaaccgacccgtagaccgtcgggtaaccggcggtactaacggtaagtacgttccgggacgttaacctttaggttcctaacgggttcctacggttaaccgaggttaaactttaacgtttaaccgttactttttactaaccccggttttaccggttaccccgtttacgttttaacccgggggaccctttaacggggtaaacccttaacgggttaacggttaacttaaacggtacccggttaaaaacgtcccggttaaggtaccggttagaccc

SEQ ID NO: 116732 - DNA, 848 bp, Homo sapiens
  misc_feature: GYAE6OF02ILN2L.45.37.D04.1.454.CMB.1.raw
  modified_base (129)..(129): a, c, t, g, unknown or other
  misc_feature (129)..(129): n is a, c, g, or t
tcagacgcgatcgacacgaccggtgctcgatttagtagcatactgttgggtttgggggagctacaacaggcaggcagggcagcaagatggtgtgcagacccaggtcttcatttctctgttgctcgtggntctcgtggtcgccgtacgggactagtcgtagatcgacctagtcctccgacgcctccgtggctgtgtctcgtgggacgagacggaccacataccaacgtcgactaacgtccgaaggaccgtaaggtagtttacgttacgacgtacgtccttaaccgaaaactaaagtaaacgtaaaccgttacgttacggtacgttaaccgggtacacggtaaaccgaacggaaacccgtaggtccaccggtaccctaacgtaagccgttcgtaccgttacgttaacgtttacggtacggaaccgtttccgtaaccccggggtaaaccccgggtacgggttaccccggggtaccctaacggtacccgttagttccggaacgggtccggtaaccggtacgggttcccgggtaacggtacgggtaactacggtttaccgttaccgtactaaccgttcctaacccgtaacgtccggacgtaccgtaccgccggttagaacccggtagaccggtagtaacggttccggtgtaacgttaccgtttaggttttcgtacccgggtattaaccggtacgtaacgtaacttttaaacgggttacttttaaccgaccgttttaacgttaccccggttaacggttcccggtttacccggaacggggttaaccgtaacgtaaagggttacctagttaaacccgtaacgggtaaccttacggtggtacccgtaccgttaaccg

SEQ ID NO: 116733 - DNA, 873 bp, Homo sapiens
  misc_feature: GYAE6OF02HUR9O.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatcgacccagtcctccagacctccctggctgtcgtctgtcgggcgaggacgggcccaaccataccaactgacaacgtccagccagagttgtttagacagctaccaacaaagtaagaaacttacgttagtacttaggtaaccagacaacgaaaaccgtacggtacacgccctaccgtaacgccttagcctactaacgttttacgtcgggacctaacgttacccgggtaaccccggggtacgggttccccggggttaccctacggtaacccggtattttaccggaggttacgggcccgaaggggtccggggttccgggtacgggggtaacctaacgggtttactttaccgtaaacccgtttcccgtaaccaaacccgtacgttaacccgggaaccgacccgttaaccgggttcccctaacgggtaccccgtacgggttaccccgtaaagggtaaacgttccgttaacgggttccccgtaacgtttaaaccggttttaacccgttacgtttaaccggtaccgtaaagtaaacccgtttaaagtttaacgtttaacgtacgggtaaaccttaccgtttttaccctacggtttaaccccgtttaccggggttttacccggggaacgggttaaacccggggtaaccggtttaacggtttaaccggacgttaacggttaacccggaaacggttaaccggtttcggttacgggtaccttaaccccgg

SEQ ID NO: 116734 - DNA, 814 bp, Homo sapiens
  misc_feature: GYAE6OF02GWWZ9.45.37.D04.1.454.CMB.1.raw
  modified_base (169)..(169): a, c, t, g, unknown or other
  misc_feature (169)..(169): n is a, c, g, or t
  modified_base (179)..(179): a, c, t, g, unknown or other
  misc_feature (179)..(179): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacgggacatcgtgatagacccagtcncagacctccngactgtgtctcgtgggcgacgaggaccacagtacaacgtggacgtacggtacctacggaccgtaacggttacggtttaccggtttttaaccggaaccccgtaaagttaacggttaaaagtaaaaccttacgttaacggtacgttacggtaacctacgacgaaacggaacgaccggacgggtacaccggtacctaccgtaacggcctacggtacctttacgtttaaccgtcgggtaccgttacccggtaacccgggggtacggttccccggggtacccgtacgtaccgtacgttacggtaaggtaccggacgtacgggacggggtttccgtacggggtacgtacgggtaactttccgaacgttccctaccggaaacctgtttaacccggagaaccgtaccgtacccgtagacgtactacccgtaaggtaacacggtttgacctaacgttacggtttaccgagtttcggaaccgtagtaacttaagttacgtactaacggtaactaacgttccctaaacggttaccgtacgggttaccggacgggtaaccggtaacccggtaaggttaccgaacgttaactaaaccggtaaacgttcggtaacgtttccggaacgtcggtaaccgtaccgttaacgg

SEQ ID NO: 116735 - DNA, 739 bp, Homo sapiens
  misc_feature: GYAE6OF02FS5D5.45.37.D04.1.454.CMB.1.raw
  modified_base (337)..(337): a, c, t, g, unknown or other
  misc_feature (337)..(337): n is a, c, g, or t
tcagacgcgatcgacacgaccggtgctcgatttagtagcatactgttgggtttgggggagctacaacaggcaggcaggggcagcaagatggtgttgcagaccccaggtcttcatttctctgttgctctggatctctggtgcctacggggacatcgtgatgacccagtcctccagactccctggctgtgtctcgtgggcgagagggccaccatcaactgcaagtccacgccagagttgtttagacagctaccaacaataacgaactacgtagtcttacggtaccagacaagtaaccgagtacacgtacctaccgtaagctcggacttcgtacttacgngggacctagtacccgtaacccggggtaagttccccggggtacctacggtaaccgacgtttaccgaggtacggccgtacggtccggggttacgtaggggtaacgttaggtacctttaccggtaccttaccgttaccaaccctacgttaccgaagtacccgtacgtcccgttacggtaccacgggtaccgttaacggaaaggtcttacgggtacggtaccttttaggttttaccgtcggatttcggtaaccgtagtacttaaacgtttatttaagtttaccttaaccgtttacccgttaccgttaccggtttacccgggacccgttacgggtaaaccgttaaacggtgtaaacgttaacggtaccgttaaaacccggtagtttcggttaccggccgttaaaccg

SEQ ID NO: 116736 - DNA, 702 bp, Homo sapiens
  misc_feature: GYAE6OF02H1QS1.45.37.D04.1.454.CMB.1.raw
  modified_base (130)..(130): a, c, t, g, unknown or other
  misc_feature (130)..(130): n is a, c, g, or t
  modified_base (310)..(310): a, c, t, g, unknown or other
  misc_feature (310)..(310): n is a, c, g, or t
  modified_base (410)..(410): a, c, t, g, unknown or other
  misc_feature (410)..(410): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggntctctggtgccgtacggggacatcgtgatcgaccagtctccagactccgtgctgtcgtcgtcgtgggcgagacgggccacatcaacgtgcaagtcagcagtgtttcgttttacggcctaatagtaacgtaactattagcgttacgtaccagacagaacgccgagggcctacgccctaccncgtcctgcctttctttacgcgggtccttccggtacccggggtacggtccgggtcccgtagtaccggtctacgacggtcggacgtacggtcgggtttcggnggactacgttacgttcaacgttcctaccgacctagcgtacggcaccgtccgtcgaccggtacgaccgtaggtaacggtagtcgggttacggtacggtttacgtttaggttcggtacgtcgttaacgacggttaattaacgttttaactttaagtttacgtttaccgtttacccgtaacggtttaccccggtttaaccggccggttaaccgggtaaccgttacggtaacgtacgttaacgtaacgtaaacgttcggttacggtcggttacggtaccgacttaccgtgttaacc

SEQ ID NO: 116737 - DNA, 756 bp, Homo sapiens
  misc_feature: GYAE6OF02JXC1Y.45.37.D04.1.454.CMB.1.raw
  modified_base (234)..(234): a, c, t, g, unknown or other
  misc_feature (234)..(234): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
tcagacgcgatcgacacgaccggtgctcgatttagtagcatactgttgggtttgggcgatcacccagcaaccacatctgtcctctagagaatcccctgagagcgtccgttcctccaccatggactggacctggaggatcctcttcttggtggcagcagccacaagagcccacctcccaggtgccgagctggtgcagtcgtggggctgaggtgaggaacgccgtgggcctcgagngaaggtcctctgcaggtctcgtggctacatccttcgaccggcgaccttatctaccgcgttgggcncggactcggccccttggacaagggtccttggaggttggacgttgggaacgnggtaatacccgaaaccctaacggtaaagtcggggtacggaaccaaccgtaaaacgtagtcgaactaaccgtaaggttaacggtttaggaaccgggggtacgtaccggggttaacctaacccgtaacggttaaccggaaacccgggtacccgggtaaaccgtacccggtaccgtaaaccgtaccgggaccgaacgaacccgttaaccgaacccgtaacgtacgggtacgggtacggtcgtaacgggacgtacgtaacggtaacttacgaacccgtagttcgaaccggttaaccgaccggtcccggtaacccttaattttaaccggttcgtaccggttacgtaaccgggttaggtaaccgtttacccggtttacggtacgggttttcggttacggttttttacccggg

SEQ ID NO: 116738 - DNA, 734 bp, Homo sapiens
  misc_feature: GYAE6OF02HJ6YV.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctgactgtgtctcgtgggcgagagggccaccatcaactgcagtccagccagtagttgttttaccgcccaatagtaagaactacttagcgttaggtaccagcagaacgccgagggacacgccctacctacgcctcgtccttcttttacgtcgggtcctccgtacccggggtacggtcccggggtcccctggaccgtacttcgaggtcggcgacggtccggggtcggtggggactaggtaactttccgaccgttcctccctaaccctagttacccgaacggcctacggtccccgttagggacccacggtcccgtaaggaaacggtattccggtacccggtacttaacggttttaactaccgttgtaccaacggtaaccttaaagttacgtttaacgtagggtaactttaccgttttcccttacgttaccgttaaccggtttccgggaccggggtaaccgggtaacccggttaaagggtccgggtaacggtaaaccgttaaccggtaaaaccggtacgtttacgggtaccgtacccgttcggaacccctacggttaacg

SEQ ID NO: 116739 - DNA, 613 bp, Homo sapiens
  misc_feature: GYAE6OF02F3DLU.45.37.D04.1.454.CMB.1.raw
  modified_base (330)..(330): a, c, t, g, unknown or other
  misc_feature (330)..(330): n is a, c, g, or t
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgaggcgggcccacactcaaactcgcaagtccagccagtagttgtttagacagctaccaacaataagacttacttagcttggaccagacaacgaaacctaggaccacgtccctacgtaagctagcctctatttcgngggtctacgtccgtaacccgggaacgtccccggggtacctacggtaccgtattcgaggtggacagggtccgggtcgtagggactagtactttcacttcgaccacactctagccagcctagccacgccgtaaggacgtagtcggtacgtacgtacgtttaacctcgtcggtactaacgtctaattacttatgaacgtcttacccttctactaccggtttcgggaccggtaacgggtaaccgtaggttcgaccgtacgttaacgaaaccggtcgttaggcgtacg

SEQ ID NO: 116740 - DNA, 725 bp, Homo sapiens
  misc_feature: GYAE6OF02HT2IJ.45.37.D04.1.454.CMB.1.raw
  modified_base (167)..(167): a, c, t, g, unknown or other
  misc_feature (167)..(167): n is a, c, g, or t
  modified_base (270)..(270): a, c, t, g, unknown or other
  misc_feature (270)..(270): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggagactcctcttctggtggcagcagccaacaangcccactcccaggtgcagctggtcgcagtctggggcttggaggtgagaagcctgggctcgagtcgaagtctcctgcagtcttcgtgctactaccttcaccggngtactactcctccacgtggtcgtacgacgacggaccccgtggtaccgaagggtccttacggaaggtacgtaaggtaggggagttacggacttaccgaaacccgtaacgtaacgtgggtaccggtaacaaccgaaaacttagttacgacctaaacggtaagtaaccggtttacggacggggtacgtaacgggtaccaacccgtaggtaaccgaaccgtacggggtaacctacgtacccgactaacggaccgtacgaactaccgaacgtacgacggttacggaacgtacgtacggacgtaccggtacgtaaccgtcgggtaaactacgtttaccgtacggtaaccggtaccgtaacccggttaacttaaccggtttttaacgttaaccgttgggtacctacggggttacgttaaggtttccgggtttaaccgggttcggtttaccggttttaccggg

SEQ ID NO: 116741 - DNA, 776 bp, Homo sapiens
  misc_feature: GYAE6OF02GXGHX.45.37.D04.1.454.CMB.1.raw
  modified_base (273)..(273): a, c, t, g, unknown or other
  misc_feature (273)..(273): n is a, c, g, or t
tcagacgcgatcgacacgaccggtgctcgatttagtagcatactgttggggtttgggggagctacaacaggcaggcaggggcagcaagatggtgttgcagacccaggtcttcatttctctgttgctctggatctctggtgcctacggggacatcgtgatcgacccagtctccagactccctggctgtgtctcgtgggcgagaggccaccatacaactgacaagtccagccagtagtgtttagacacgctaccaacaataacgaactacgttancgttggtaccagacaacgaaaccacggtctacgccttaccgtaacgtcgtcgaccttactacgtttaccgtgggtaccaacttccggtaacccgggtaacgttcccggggtacccgtcgaaccgttacgttaccgtaaggtcgtacgacgggtccgggtacgttacgggaactacggttacgtttcgaaccgttcgtaccctaccgtagtcccgtagacccgtaacgtccggtacggtaccgtaacgggtccttagggtaaaaccgtgttaccgggtacggttacgttaagggttttaacgttcggaaccgttaccggtaacgtaaccggtacgttaaacgttttacggtttaacttaacgtttaaccgttaccccgttaccggttacccggtttttacccggcccggtttaaccggtaaccggttaaaacggttccggttaaacgttaccgtttaaccggtaaaccggttaccggttacgggttaccggtacttaacccggg

SEQ ID NO: 116742 - DNA, 744 bp, Homo sapiens
  misc_feature: GYAE6OF02FHTXO.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgactgacccagtctccagactcccgtggctgtgtctctgggacaggacggccaccagtccaactgacaacgtccacgccagtacgttgttttacgacacgctaccgaacaaactaagtaactattacgtcgtttacggtaccagactacgaaaccgaggtccaacgtcctaccgtaacgctcgactctatttaccgtggtacacgttacctaaccgggacgttcccggggtccctacggacgtacttacgaggtcggacgtacggcgggtcgtacggggtactacggttatttacccgacgttacctacgaccgttaactacgtaagccaccgtcccgtacggcgaacggttacgtaagaaacgtggtacgtacggttaccgttaagtttttacttacggtaccttgggaaccgttacggtaacctttaagttaaacgtttttacctttaagtttaaccgttttacccgtttacccgttaccgggttttaccccgggtacccgtttaccggggaaacccgttaaagggttacggtaaccttaaccgtttaccggaaaaccgttacggttaccgtaggttacccgtaccg

SEQ ID NO: 116743 - DNA, 707 bp, Homo sapiens
  misc_feature: GYAE6OF02ILP0Z.45.37.D04.1.454.CMB.1.raw
  modified_base (190)..(190): a, c, t, g, unknown or other
  misc_feature (190)..(190): n is a, c, g, or t
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
  modified_base (386)..(386): a, c, t, g, unknown or other
  misc_feature (386)..(386): n is a, c, g, or t
  modified_base (484)..(484): a, c, t, g, unknown or other
  misc_feature (484)..(484): n is a, c, g, or t
tcagacgcgatcgacacgaccggtgctcgatttagtagcatactgttggggtttgggggctacaacaggcaggcaggggcagcaaagatggtgttgcagacccaggtcttcatttctctgttgctctggatctctggtgcccgtacggggacatcgtgatcgacccagtctccagacctccctgactgtntctcgnggcgagacggccaccatacactcgcagccncgcagtagttcgtttaccgccctaatagtaagtaacctacttagcttacggaccgagacaagaacggccgaacgggcacgtccctaccgtacgaccctgtccttccgttttaccggcggtacccctaccggtaccccggggtccggtcccgggttacccncggtaaccgtacgccgtaggtccggacgtacgggtcgggtcgtagggacgtaagttacgttcctacctccgtacctactccgaccgtagaccgtaccncgttacgccgtacgtaccgtagtaacggtacgttccggtacgtaacgtttaacgtttaacccttacgtacgttaccgaacttaacgtaagtttaagttacgtagtaacgtccttaccttacgtccgttacggttaccgggacgggtacggtaacgtaacggtcgaaccgtaaggttaacccaaaggttaccgtaggtccgacgtacaccctagccgttaaccg

SEQ ID NO: 116744 - DNA, 702 bp, Homo sapiens
  misc_feature: GYAE6OF02ID4YQ.45.37.D04.1.454.CMB.1.raw
  modified_base (376)..(376): a, c, t, g, unknown or other
  misc_feature (376)..(376): n is a, c, g, or t
  modified_base (580)..(580): a, c, t, g, unknown or other
  misc_feature (580)..(580): n is a, c, g, or t
  modified_base (595)..(595): a, c, t, g, unknown or other
  misc_feature (595)..(595): n is a, c, g, or t
tcagacgcgatcgacacgaccggtgctcgatttagtagcatactgttgggtttggggagagcatcacccagcaaccacatctgtcctctagagaactcccctgagagctcccgttcctcaccatggactggacctggaggatcctcttctggtggcagcagccacaagacgcccactcccgaggtcgcagcgtggtcgcaggtcggtggggctggaggtggaggacgcgtgggcctgagtgagtctccgtgacgaggtcttcgcgactaccacgttccgaccggcgtaactctccctacgcgtcgggtcgaccgtaaccggccggccccgtaggaccggtaacgggtccgtttgagggtcgggtagtacgggggtntacgggtaactaccccgtaaaccctaaacgagggttcgggtcgaaccttaaaactaaacgttcgaacgtaccgtaaacgttaacgggttaacgtttccgggaacgggtacggaacgggttaccacggaagtaaccggaacgtaaccgggacgtacccgactacgtaaccgacggtacctacgaccgtactacgacgtgaacggntacggacgcgtaacncgtacgatacgtacggacaaccgacgtaccgtaactttagttaccgttagtcgtacggacgttacgggttaccgtttacggggttacgttcggttacgttttaccgg

SEQ ID NO: 116745 - DNA, 673 bp, Homo sapiens
  misc_feature: GYAE6OF02FJIQQ.45.37.D04.1.454.CMB.1.raw
  modified_base (250)..(250): a, c, t, g, unknown or other
  misc_feature (250)..(250): n is a, c, g, or t
tcagacgcgatcgacacgaccggtgctcgatttagtagcatactgttggggtttggggtagagcatcacccagcaaccacatctgtcctctagagaatcccctgagagctccgttcctcgtaccgatggactggacctggacggatcctcttcttggtggcagcagccacaagagcccactcccaggtgcagctggtgcagtctggggctggaggtgaggaagccgtggggcctcgagtgaaggtctccngcaaggcttctggctacaccttcaccggcgactatcctccacgtgggtgcgacacggcccctggacgagggtctgagtggagtgggatggatccgaaaccctaacgaagttggtcggacaacaaacgtatacggacaacgaaggtaacgtttcgaaggggcgtacgggtcaaccgtagtacggaaccgacgggacaccggtaccacgtacacgacacgacgacccttacacgttaggacggtcgtacggacggacgaacgtaacgtacggaactacgttaccgtacggtaacccgaccggtaacccgggtaccctttaagtttttaaccgttaaccggtttacggttaccgggtaacggggtaacgggaaacgggggggtaaccggggggggggtaacgggtaacgtttagggtttaaccggg

SEQ ID NO: 116746 - DNA, 830 bp, Homo sapiens
  misc_feature: GYAE6OF02HHDMU.45.37.D04.1.454.CMB.1.raw
tcagacgcgatcgacacgaccggtgctcgatttagtagcatactgttgggtttggggagagcatcacccagcaaccacatctgtcctctagagaactcccctgagagctccgttcctcaccatggactggacctggaggatcctcttcttggtggcagcagccacaagacgccccacctcccaggtgcagctggtgcgagtcgtgggctgaggtgaggagccgtgggcctcaggtgaggtctccgtgacgaaggtccttcgtcggcctacctaccgttccgacccggcgaaccttactccctccgtacgttgggggtcgaccggtaccgaccgggtcccccgtagggaaccggaacggggtccgtttcgggtaagggttacgggaaggtgggggtaggtacgggaacttaaccccgaaaaccccttaaacggtaaacggttcggggttacggaaccgtaaaaccgtaaaacttacgtacgaaccctaaacggtaacgggttaaacgggttttcccgggaacgggggtaaccggttacggggtaaccctaaccggtaaccgtaaccgggtaaaccccggaacggggtaacccgtaacccggtacccgtaacgtacccgaacgacccgtaacctaacccggtaccctaaccgaggttaccggaacggtaccgtacggtaacggaccgaaccgaccgttaacgaaccgtacgttccgaccgaacccgtaacggtacccggtaacctttaacggtttacttaccggtcggtacggtaccgggtaggttaccggtttaccggggttttacggttccgggttacgttttacccggg

SEQ ID NO: 116747 - DNA, 613 bp, Homo sapiens
  misc_feature: GYAE6OF02G3O9R.45.37.D04.1.454.CMB.1.raw
  modified_base (462)..(462): a, c, t, g, unknown or other
  misc_feature (462)..(462): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagcgcccactcccaggtgcagctggtgcagtcgtggggctgaggtgaggaagccgtggggcctcgagtgaaggtctccgtgcgaaggtcttcgtgctacaccttcgaccggcgactactccgtcctacgtgggcgtcgacgcggccccgtggaacgacgggcgttaggagtggagtgggagtggactaccgaaaccgtaacgaagtgggtacgacaacgtaaactagacgacacaagtaagtttcgaaggtcgacgggtacacgagacgaacgacggactacgtcactcgacgcaacncgacctagagtcggacgtacgtagacgacgaacgtacgtagaacgtactaccgacggtaaccgaccgacgtaccttagtttaacgttacgtcggtacgacggtacggttagtttaccgggttacggtcggttccggtttcggttttaccgg

SEQ ID NO: 116748 - DNA, 739 bp, Homo sapiens
  misc_feature: GYAE6OF02JUKPK.45.37.D04.1.454.CMB.1.raw
  modified_base (138)..(138): a, c, t, g, unknown or other
  misc_feature (138)..(138): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggntcctcttcttgggtggcagcagccacaagagcccctactcccaggtcgcagcgtggtgcagtcgtggggctgaggtggaggaagccgtgggcctcgaggtggaaggtcctccgtgacgaaggtctcgtcggactaccgaccgttacgacccgggtcgaacgtactccgtacccgacggttcggggtcgaccgtaccgtaaccgggtcccccgttagggaacccgtaacggggtccgttagggtacggtcgggtaaggtgggtaggtcgtaacgtacccgaaacccgtaaacgtaacggtgggtacgaccgtaaactaaacgtactaccgtcgtaaacgtaaacgggtaacgttttacgggaacggtacggtaacgggtccaacggtacgtaccggaaccggtacgggtaccgtacgtaacctacggtactaccgggaccaacggtaacctacgttaaccgaggttaccggaggtaaccgtacgacggcgtaacggtaccgctaacgtacgtcggacaccgtaccgacttacggtaactttaaggtacgcgttacgaggtacgtacggttccggttacggtggttaccttgggttttacccg

SEQ ID NO: 116749 - DNA, 663 bp, Homo sapiens
  misc_feature: GYAE6OF02F1KOQ.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagacgcccactcccaggtcgcagcgtggtgcagtcgtgggctgaggtgaggagccgtgggcctcgagtgaggtctaccgtgcgaaggtcttcgtggctacaccttcgaccgtacgactatcctccgacgtcgggtgccggacgaccggtccccgaggaaccgtaaagggtccttaggacggtgggtacgtaggggtacgtagggaactaaccaaacccgttaaacgaaggttcgggtacggtaacaaacgtaaacgtagtacgacctaacgtaaggtttaacggttcgaacggggtacgtaaccgggtactaaccgagtacggaaaccggaggtaaaccgtacggacctaagtaccgaacgtacaccgtaacgctaacgtagtcggaagtccgtagacgtacgaacgacgtacacgtgtacacggtaccgacgtacgtacttaagtttaccgtaacgtgtcgacgtagtaccgtacggtttcggtcgtcgtttaccgg

SEQ ID NO: 116750 - DNA, 859 bp, Homo sapiens
  misc_feature: GYAE6OF02GSKWR.45.37.D04.1.454.CMB.1.raw
tcagacgcgatcgacacgaccggtgctcgatttagtagcatactgttgggtttgggggctacaacaggcaggcaggggcagcaagatggtgttgcagacccaggtcttcatttctctgttgctctggatctctggtgcctacggggacatcgtgatcgacccagtcctccagactccctggctgtgtctcgtgggcgaggacggccacctatacaactgacaacgtccacgccagtagttagttttacgacgacgacctaccgaaacaaattaaacgaacttaaccgttaagtccgttaggtaccagacaacgaaaacccgagtccgaacgtccctacgtaacgtcctacggtacctacttaactttaccggtcggggacctaccgttacccggtaaccccgggggtaaacgttcccccggggtcccgttacggaccccgttacgttacgaggtcgggtacgacgggtccgggtagtccgggtaaactacggtatttccgaacccttccgtacctaaccctacttaccggacgtaccgtacggcccgttaggaaccgtacgggtacctaggtaaaggttacggtcggtttaagggtacgttacggttttaagtttacggaacgtttcggaccgtaggttaaccttaagtttttaaccgtttaaaagttttacctttaacccgttttaacccccgggtttacccgggtttacccggtttcccgggtttaaccccggggtttaaccgggttaaaaccccgggttaaacggtttacccgggttaaactttaaacccggtaaacgggttaaacccgttaacccggtttaagggttcccggttaccgttaacccgggtaacccc

SEQ ID NO: 116751 - DNA, 737 bp, Homo sapiens
  misc_feature: GYAE6OF02HDWH8.45.37.D04.1.454.CMB.1.raw
  modified_base (498)..(498): a, c, t, g, unknown or other
  misc_feature (498)..(498): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagactcctggctgtgtctcgtgggcgagacgggccaccatacaactgaccaacgtccacgaccaggtagttacgttttagacagcctaccaaacaattaaacgaacttaacttacgtcttacgggtacctaggacaagaaaacccgtaggtacacgcccttacctaaggcctggcctacgtactttacgtcgggtacacgttaccggtaacccggggtaactcccgggggttacctacggaacccgtattaccggaggtcggacgacgggtccgggtacgtacggggaactacggtactttaccgaccgttctacccgtaacgtacncctaacggcctaggcctggcgacggtcgtaagaacgtagtcggtacggtactttaggtttagttcgtactcggttacgaacgttacctaaagtttactttaaacgttaactttaccgttcccgttaccggttacccggttttacccgggtccgtttaaaccgggaacgttaaacgggttacgtaagtttaaccggtaaccgtaaaacggttaccggtttacggtccggaccttaaccgg

SEQ ID NO: 116752 - DNA, 859 bp, Homo sapiens
  misc_feature: GYAE6OF02IR7E5.45.37.D04.1.454.CMB.1.raw
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcacgccacaagacgcccactcccaggtgcagctggtgcagtcgtgggctggaggtgaggacgccgtgggcctgagtaggaacggtctccgtgacgtaaggcttcgtggtcctacctaccgttaccgaccggcgtaaccttatcctcccgtacggtcgggtcgtaccggaccgtaccgggtcccccgtagggaaccggaaggggttccttagggtaacggtggggtacgtaggggttaacgtagggtaacctaacccgtaaaccccgtaaagtaaggttaccgggtacggtaaccgtaaaccgtaaaacgtacgtaaccggactaaacggtaaacggttaacggtttcccgggaaggggttaccggtaaacccgggttacaaaacccgttagtaaccggggaaaccccggaaacgggtaaccccgtaccgggtaacctaaccggtaccgaacggtacccgtaacgacccggttaccgtaaacgtaccggtagggaacgttccgtaaggggaccgtaaccgaaaccggttacgaaccgtttaacgacgtttaccgggaccgttaaccggacccgggtaacgtttaacccgtttaaagtttttacccgtaggttcccggttaagggaccgggttaacggtttaacgggttttacccgggttacccggggtttacggtttaccgggtttttcccggttttaacccgg

SEQ ID NO: 116753 - DNA, 678 bp, Homo sapiens
  misc_feature: GYAE6OF02GNMJQ.45.37.D04.1.454.CMB.1.raw
tcagacgcgatcgacacgaccggtgctcgatttagtagcatactgttgggtttggggagagcatcacccagcaaccacatctgtcctctagagaatcccctgagagctccgttcctcaccatggactggacctggaggatcctcttcttggtggcagcagccacaagagcccactcccaggtgcagctggtgcagtctgggctgaggtgaggagccgtgggcctcagtgaaggtctcctgcaaggcttctggctacaccttcaccggcgactatctccacgtgggtgcgacgacggccccgtaggaccgaagggcgttaggagtgggagtggggatggactacaaccctaagaagtggtaggcaacgtaaacgtagtacgacaacgtaggtaacgtttacggacgggcgtacgggtacgaccgtacgtacggaacccgtaacgggacctacgggtaccctacgtcgaacgtaccaacgacgtaccctaacgtaacgtcgggaacgtacgttacggacgtccgtaaacgaccggttacgaaaccgtaacgttaccgtacgggtaccgaacgtaaccgggtaccctttaagttttaacgttaacggttacggttacgtaccgggtaaggtttaccggtttaccggggtttaccgggttacggttccgtttttacccgggg

SEQ ID NO: 116754 - DNA, 702 bp, Homo sapiens
  misc_feature: GYAE6OF02IUPER.45.37.D04.1.454.CMB.1.raw
  modified_base (592)..(592): a, c, t, g, unknown or other
  misc_feature (592)..(592): n is a, c, g, or t
  modified_base (601)..(601): a, c, t, g, unknown or other
  misc_feature (601)..(601): n is a, c, g, or t
  modified_base (634)..(634): a, c, t, g, unknown or other
  misc_feature (634)..(634): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcttggtggcagcagccacaagagcccactcccaggtgcagcgtggtgcagtcgtggggctggaggtgaggagccgtgggcctcgagtgaaggtcctcgtgacgaaggtcttcgtggctactaccttcgaccggcgactatcctcacgtgggtgacggacgacggccccgtaggacgaacgggtcctaggtaggttacggagtggggtaatcggaacgttaccgtaaacccgtaacgaaaggttcgggtacggactaaaccgtaaaacgtacgttcgaaccaacgtaacggtaaacggtttacgacgggacgtaacgggtacgtaaccgaacgttacggaacccggtaagggtaaacctaccggtacccgaagtaccgaacgtaacccgtaacgacggtaacccctaaggtaagtccgggacgtacgtcggaacgtacgacgtaacgngaacctacncgtacgaccaccggtacgtaccgtaacgttttnaacgtggtaccgtggttaacggtaccgtttcggttaccgggtcgtttaccggttcggtttttacccgg

SEQ ID NO: 116755 - DNA, 666 bp, Homo sapiens
  misc_feature: GYAE6OF02F8HJR.45.37.D04.1.454.CMB.1.raw
  modified_base (318)..(318): a, c, t, g, unknown or other
  misc_feature (318)..(318): n is a, c, g, or t
  modified_base (410)..(410): a, c, t, g, unknown or other
  misc_feature (410)..(410): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctctgggcgagagggccaccatcaactgcaagtccagccagagtgtttagacagctccaaacaataagaactacttagcttggtaccagacagaaacccaggtcagcctcctaagcctgctctatttacncgggctaatccgtacccgggaagttcccggggtccctagacccgtattcaggttggctaggccggggtcgtaggggaacagtacttttaccnccttacgtcaaccctatcgacgctacgccctagccgaggctaggaaagtattcgggtggacttaaggtttattacggcttacgtctaagtaccttaaatttacttaaacgttttaattaaccttttacccgtacccgtttaccggtttcccggttaccccggttaaggggtaaaccccttaaaaggttacgggtaaaccgttaactttaaccggaaaaacccggtttaaccgtagggtttacgggacttaacccgg

SEQ ID NO: 116756 - DNA, 615 bp, Homo sapiens
  misc_feature: GYAE6OF02IRFK2.45.37.D04.1.454.CMB.1.raw
  modified_base (253)..(253): a, c, t, g, unknown or other
  misc_feature (253)..(253): n is a, c, g, or t
  modified_base (421)..(421): a, c, t, g, unknown or other
  misc_feature (421)..(421): n is a, c, g, or t
tcagacgcgatcgacacgaccggtgctcgatttagtagcatactgttgggtttgggggagcatcacccagcaaccacatctgtcctctagagaatcccctgagagctccgttccctcaccatggactggacctggaggatcctcttcttggtggcagcagccacaagagcccactcccaggtgcaactggtgcagtcgtggggctggaggtgaggaagccgtggggcctcagtgaggtctcctgcaggcttcnggctacaccttcaccggcactatctccacgtgggtgcgacgacggccccgtggacgaaggggtcttgaggtggagtgggtatggactaccgaaccctaaacgaagtgggtacgacaacaaacgtatcgactaacgagtaacgtttcgaggggcagggtaccaccgtanacggaccgagggaccgtacgtaccacgtccgacgctaacacgtacctacacgtacggagcgtaggacgacgagacttacgaactacgtcctacgaaccggaccgtaccgggaccttactttaacgttacttcggtcggacggtaggtacgttcggttaccggttggtacggttttcgggtttccgttttacggg

SEQ ID NO: 116757 - DNA, 855 bp, Homo sapiens
  misc_feature: GYAE6OF02F62L7.45.37.D04.1.454.CMB.1.raw
tcagacgcgatcgacacgaccggtgctcgatttagtagcatactgttgggtttgggcatcacccagcaaccacatctgtcctctagagaatcccctgagagcctccgttcctcaccagtcggacgtcggaccgtggaggactcctcttcgttggtggacagcacgaccaacgaagaccgacccctacctacccgagggtcgcgacgcgttgggtcgcgtacggttcggtggggctaggtagggtggaaggaacgccggtcggggtcctcgaggtaggtaacggttcctccgtcggacgtaacggttccttacgtcggaccttacctacccgttaccgacccggacgtacctactccgttacccgtacggttcgggtcgaccgtaccggaccgggtacccccgtagggaaccggtaacggggttccgttacgggaacgggttagggtaggttacggggtaagttacggggtaacctaacccgaaaaccccgttaaagtaaacggttcggggtaaccggaaccctaaaacgtaaacgttacggtaccgaaccgtaacgtaaacgggttaacggtttacgggaacgggtaccggtaaccggggtaccctaaccgtacggtaaccggtaacccggaacgggtaaccctaacggtaccctacgtaccgaacgaccgtaaccgacgttacccgtactaacggtcggacgtacgtacgacgtaccgaacgtacgtcgaactactcggaacgtaccgaccgtaccgtacttaagtttacgtacggttcgcggtaacgttacgggttacgtttacggggtttaccggttcggttacgtttttacgggttttaccgttaaccggg

SEQ ID NO: 116758 - DNA, 791 bp, Homo sapiens
  misc_feature: GYAE6OF02F2OLC.45.37.D04.1.454.CMB.1.raw
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgcctacggggacatcgtgatgacccagtctccagacctccctggctgtgtcgtcgtgggcgaggacgggccaccatccaactgacaacgtccagccagtagttgtttagactacgcctaccaacaataacgaactacttagaccttggtaccagcaacgaaaccgaggtcacgtacctacctaagctcgctactattacgtgggctacgtaccgtacccgggaacgtcccggggttaccctacggacccgtattaccgaggtcgggtacgacgggtccggggttcggtacggggaacgtaggttaccgtttccaccgttcctacccgtaaccctagtaccgtacgccgacggtcccttacggaccgacgggtaccgttaaggaaacgtacggttacggtacggtaccggtttaaggtttttacggttacgtaccggtttacgtaccgtaacggttaaccgttaaatttaacgtttttaaacgttttaacgttaaccgttttaccccggttacccgggtttaacccggtttaccccggggtaaccccgggtttaaccggggtaaacccgtaaacggggtttaacggttaaacgtttaaccttaaacccggtaaaaccggttacccggtaacgggttacccgggtacgttacccgg

SEQ ID NO: 116759 - DNA, 722 bp, Homo sapiens
  misc_feature: GYAE6OF02GVMK4.45.37.D04.1.454.CMB.1.raw
  modified_base (286)..(286): a, c, t, g, unknown or other
  misc_feature (286)..(286): n is a, c, g, or t
tcagacgcgatcgacacgaccggtgctcgatttagtagcatactgttgggtttgggcatcacccagcaaccacatctgtcctctagagaatcccctgagagctccgttcctcaccatggactggacctggaggatcctcttcttggtggcagcagccacaagacgcccactcccgaggtgcagctggtgcgagtcgtggggctggaggtggaggacgtcgtcgggcctcgagtgaggtcctctgcgaggtcttgtcggctacctaccttccgaccggcgacttacncctccacgtgggtcgcgacgaccggcccgtggacggaagggtccgttaggacggtagggtaggtacggggtagtacgggacttaccgtaaacctaaacgtacggtcggggtaggaaccctaaactaaccgtagtacggaactaacgtaaggttaacgtttacgggacgggtaaccggtacggttaccaccgtagtaaccggtaaaccgggacggtaaaccgtcccggaacctacgtacccggaacgaccgttaaccgacgtacccttagacgggacggtagactacggaagtccgtaagtaccgagtaccgttacgtactaaccgggactaaccggacgttaaccctagttttaacgtacggtaggtccggtaacggtcgtttacggttccgggttacggttccggttacggtttttccggttcggtttaaccggg

SEQ ID NO: 116760 - DNA, 737 bp, Homo sapiens
  misc_feature: GYAE6OF02HJ52L.45.37.D04.1.454.CMB.1.raw
  modified_base (481)..(481): a, c, t, g, unknown or other
  misc_feature (481)..(481): n is a, c, g, or t
tcagacgcgatcgacacgaccggtgctcgatttagtagcatactgttgggtttgggggagctacaacaggcaggcaggggcagcaagatggtgttgcagacccaggtcttcattctctgttgctctggatctctggtgaccgtacggggacatcgtgatcgacccgtagtcctccgacgaccgtccctggcgtgtgtctcgtgggcggaggacgggccacactacaacgtgacacgtaccaggaccagtaggttgtttaacgacgtacgcctaccgaaaacaagtaaagtaactacttagtccgttacgtaactacgacaacgtaaaccgacgtacgacgtcctacgtagccgtgcctacttacgttacgtcggactaacgtacccggtaacccgggtacggttcccgggtccgccgtaaccgtcttacgtacggtcgaccgacgggtcgggtacggtacggacgtacgttacgtttaccnccgttacctaccgaacctactaccggacgactccggcgtacgacggtacggccgttaggaacgtgttaggacgtttacggtagtttacttcgggtacttcggattaaccgttaagttaacttttaagtatttactttacccgttcccgtacccgtttaccggtttaccccggaccggtttaacgggaaccgttaaacggacgttaacgttaaccggaacgttaaccggtaacgttcgggttaccgtagttacccgg

SEQ ID NO: 116761 - DNA, 756 bp, Homo sapiens
  misc_feature: GYAE6OF02HLLE8.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcggtgatcgacccagtcctccgagacctcccgtggctgtgtctcgtgggcgaggcggaccaccatcaactcgacaacgtccacgccaagtagttgtttagactagctaccaaacaataaactaaacttacgtaacgtcgttacggtaaccagactaacggaaaccgtacggtacaccgtacccttaccgtaacgtccgtacaccttaccgtaacgttttaccggagggtacccttacgttaacccggttaaccccggggtaaccgttccccgggggtacccttacgggaaccgttacgtttaccggagggtccggacgtacggggtccgggttacggtacgggaacgtacgttactttccgtaaccgtcctacctacgtaagtccacgactaccgtcgacgtacgaggtaccgtagaacttggttcgtagtactaggttttgtccgtacgttcgtacgtaactaacgttagttaactttacttacgtttaccttcccggtcccgttttaccgtacccgggttaacccagggtaaacccgttaggttaaccgtaattaaccggtaacccgtaaaacggttaccgggtgtacccggtaggtaccg

SEQ ID NO: 116762 - DNA, 894 bp, Homo sapiens
  misc_feature: GYAE6OF02FRYFX.45.37.D04.1.454.CMB.1.raw
tcagacgcgatcgacacgaccggtgctcgatttagtagcatactgtgggtttgggggagctacaacaggcaggcaggggcagcaagatggtgttgcagacccaggtcttcatttctctgttgctctggatctctggtgccgtacggggactatcgtgatcgacccgagtctcagacctccctggctgtgtcctcgtgggtcgaggacgggccctacctactaccgtaactggaccgaacgtccgacgaccgtaaggtacgtttacggttttaacgaccgtacgtccttaacccaaaacgtaaacgtaaacgtaaaccttacgttaacggtacctttacgggtaaccacggaaccgtaacggaaaaccctaggggtaccacggaccccttaccgtaacggtaccgtcggtaccttacgtttaactttacggtcggggtactaccggttacccggtaacccgggtaacggttccccggggtaccttaccgggtaccggtaacttacggtaacgggtcggtacgtacgggttcccgggtaggtacgggaaccgtaggtacctttctaccgtaccttacggaccctacgtcgaacgtcgaaccgtccggtacgtcggtaccggacgttaacgggaacgtaccggttagggttcccgggttaacggttttaaccgggttttaccgtttccgggtacgtttacggtaacccgtttaagttaaccgtttaaacggttaaccgtttttaaacgttaaacccggttttccgttaacccccgtttcggttaacccccgggtttttacggtaccccgggtaacggggttaaccccgttaagggttaacgttaacgttaccgtaaaccggttaaacgtacggtttaccggtacggtacctacccgg

SEQ ID NO: 116763 - DNA, 699 bp, Homo sapiens
  misc_feature: GYAE6OF02JANF5.45.37.D04.1.454.CMB.1.raw
  modified_base (123)..(123): a, c, t, g, unknown or other
  misc_feature (123)..(123): n is a, c, g, or t
  modified_base (430)..(430): a, c, t, g, unknown or other
  misc_feature (430)..(430): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttnctctggatctctggtgcctacggggacatcgtgatgacccagtctccagactccctggctgtgtctcgtgggcgaggacgggccaccatacaactgcaacgtccagccagtagttgtttagacagctaccaacaataagaacttacttagcttggacccagacaacgaaaccaggtacacgcctacctagcgtcgctctatttacgtgggctataccgtacccgggaacttcccggggtccctacgaccgtatacaggtcggcagggtccgggtcgtacggggactagttactttaccgaccttccnccgaacccattaaccgacgaccgtacgcccttagcggacggtcctaggaaacgtaggttacggtacggtacgttaacggttttacgttcggtacttcgtactaggtaacgtaaattttaacgtttaactttaacgtttacgttttcccccgttaccggttttacccggtttacccgggtaccccgtaccggggttaaaccctaaagggttaccggttaacttaacgttaaccggtaaaccggtacgttacgggtccggtactaaccggg

SEQ ID NO: 116764 - DNA, 611 bp, Homo sapiens
  misc_feature: GYAE6OF02HOQBH.45.37.D04.1.454.CMB.1.raw
  modified_base (371)..(371): a, c, t, g, unknown or other
  misc_feature (371)..(371): n is a, c, g, or t
  modified_base (421)..(421): a, c, t, g, unknown or other
  misc_feature (421)..(421): n is a, c, g, or t
  modified_base (456)..(456): a, c, t, g, unknown or other
  misc_feature (456)..(456): n is a, c, g, or t
  modified_base (552)..(552): a, c, t, g, unknown or other
  misc_feature (552)..(552): n is a, c, g, or t
  modified_base (600)..(600): a, c, t, g, unknown or other
  misc_feature (600)..(600): n is a, c, g, or t
  modified_base (607)..(607): a, c, t, g, unknown or other
  misc_feature (607)..(607): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacagtcgtgatcgaccctagtcctccaacgtacctccccgtggtctggtcgttcgtcgtcgggcgaggtacgggcccaacgatacaacgtgtacgaagtcccaaggccaggtagttgtttacgacgactactaccaaactaataaagtaacctattaggtccttacggaccagtacaagtaaaccgtagtcacgtacctactaagcctgctactattacggngactacgtccggtaaccgggtacgtaccggcctagcctatcgaggtgacncggtgggtctaggcagtctttcgaactctaccganacgtcgaacgccagtcctacgacgtgctagaacgtcgtgtgtacgtagtttgtcggtcttgacgacagttaacttaattaactgttacctaccgtnttaccgtccggtcacggaactaaggtacattacggaactacgtaggtnacggtanccgg

SEQ ID NO: 116765 - DNA, 700 bp, Homo sapiens
  misc_feature: GYAE6OF02H7IIT.45.37.D04.1.454.CMB.1.raw
  modified_base (500)..(500): a, c, t, g, unknown or other
  misc_feature (500)..(500): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctcgtggtcgccgtacgggactacgtcggtagactcgacccacgtcctccagtacctcccgtggcgtgtgtcgtcgtgggacgaggacggaccaccatacaactgacacgtccacgccaggtagtttagtttacgacgaacgtcctaccgaacaaagtaaagtaaccttacttaagccgttacgaccgagaccgaacgaaaccgtagtaccgacgtcctacgtacacgtctacctagtactttacgacggtactaccgttacccggtaaccgggtaccggttacccgggtcctacgaaccgtcgttacggacgcggtcgacggtccgggtacgagggtactaggtactttaccaccgttcactacctanccgacgacgtcgaccgtaggtacgtcgagtagtagtaggttcgttacgtacttggtttacgtacgtctacggtctaagtacttaagttactttagttaacgttacctttccgtacccgtttcggttaccggtacccgtacggtaaccgttaaggtaaccgttagtacgtaaccgttaaacggtgtcggtagcccgttacg

SEQ ID NO: 116766 - DNA, 868 bp, Homo sapiens
  misc_feature: GYAE6OF02IQZRM.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacagtcgtgatgacccagtctccagactccctggctgtgtctcgtgggcgaggacggccaccatacaactgacaagtccagccagtagttagtttagacacgacctaccaaacaaataagaaccttacttagccgttacggtaccagaccaacggaaaccaggtaccacgaccctacctaagctacgccttactactttacgtcgggactacgttccgtaaccccggggtaacgtcccggggtaccctacggaaccgtattaccgaggttcggaccgtacgggtaccgggggttacgtacgggggtaactaacggttacgttttacccaaccgtttacccggttaccctaaacccgtacgtaaccccgtaaggtaccccgtaacccgggtcccgttacggaacccggtaaccggggtacccttaaagggaaacgttacggtttagggtaccgggtaccgtttaaggttttacgttacggtaccgtttacgggttaccaacgtttaaccgtaaacgtttttaaactttaacgttttaaacgtttaacccgtttccccgttttaacccgggttaacccggttttttccccgggaaccccggttttaaacggggaaacccgtttaaaaacgggggttccggttaaaccgtttaaacccggtaaaccgggttaaaaaccccggtacggtttaacccggggtttcgggttacccgttaacccggg

SEQ ID NO: 116767 - DNA, 813 bp, Homo sapiens
  misc_feature: GYAE6OF02JLD9P.45.37.D04.1.454.CMB.1.raw
  modified_base (131)..(131): a, c, t, g, unknown or other
  misc_feature (131)..(131): n is a, c, g, or t
  modified_base (141)..(141): a, c, t, g, unknown or other
  misc_feature (141)..(141): n is a, c, g, or t
  modified_base (231)..(231): a, c, t, g, unknown or other
  misc_feature (231)..(231): n is a, c, g, or t
  modified_base (621)..(621): a, c, t, g, unknown or other
  misc_feature (621)..(621): n is a, c, g, or t
  modified_base (639)..(639): a, c, t, g, unknown or other
  misc_feature (639)..(639): n is a, c, g, or t
  modified_base (659)..(659): a, c, t, g, unknown or other
  misc_feature (659)..(659): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctcgtggntctctggtcnccgtacgggacatcgtgatcgaccctagtctccgacgtcctccgtggcttgtgtccgtcgtacgggcgaggcggtccaccatacctaacngaccaacggtccacgaccgtaaggtacgtttaggtttacgaaccgtagtacccgtaacctaaaacgaaacgtaaactaaccgtttaaccgttacggtacgtttacggaaccctaaggtaccgtaaaacgaaaacccggtccggttaaccgaacccggttaccccttaaccggtaacgtccgttaaccgtccgtttaacctttaaacggttcgttaccgggcttaaccggttacccgggtaaaacccggggtacggttccccgggggttacctaacgggtaacccgtttacgtacccggtaggtacggtaccggtaacgggtccggtccgggtaagggaccgtacggtttacctcctaacggtaccgtaacccgactacgtacaccggtanccgtacgtcgacgtacgngttaacgaacgtcgtcggtntacgttacggttacgtcgccgttagaccggtataacttacgttaacgttacttaacgttactcccggttacgtcggtttacccggaccggtacgtaaaccgtagggttactaacgtacttaacccggtaagtaccggttaggcgtaccgtaacg

SEQ ID NO: 116768 - DNA, 561 bp, Homo sapiens
  misc_feature: GYAE6OF02FOTJB.45.37.D04.1.454.CMB.1.raw
  modified_base (436)..(436): a, c, t, g, unknown or other
  misc_feature (436)..(436): n is a, c, g, or t
  modified_base (553)..(553): a, c, t, g, unknown or other
  misc_feature (553)..(553): n is a, c, g, or t
tcagacgcgatcgacacgaccggtgctcgatttagtagcatactgttgggtttggggagagcatcacccagcaaccacatctgtcctctagagaatcccctgagagctccgttcctcaccatggactggacctggatgatcctcttcttggtggcagcagccacaagagcccactcccaggtgcagctggtgcagtctggggctggaggtgaggaagccgtgggggcctcagtgaaggtcctcctgcaaggtcttcgtggctacaccttcaccggcgactatctccacgtgggtgcgacgacggccccgtggacgagggcttgaggtggagtggatggataccaaacctaacaagttgggtaggacaacaaactatagcacgagtaagttcgagggcaggtccacgagtacgaccgaggacaccgacatcagcacncgcctacgagtggacgtcgtagagacgaagctacgacacgtcagaccggaccgtaaccgggtaccttaagtttaccttacgttggtacggacggtaggttagttcggttttaccggnggttccgg

SEQ ID NO: 116769 - DNA, 795 bp, Homo sapiens
  misc_feature: GYAE6OF02IS4NZ.45.37.D04.1.454.CMB.1.raw
  modified_base (166)..(166): a, c, t, g, unknown or other
  misc_feature (166)..(166): n is a, c, g, or t
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (423)..(423): a, c, t, g, unknown or other
  misc_feature (423)..(423): n is a, c, g, or t
  modified_base (611)..(611): a, c, t, g, unknown or other
  misc_feature (611)..(611): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggactggaggatcctcttcgttggtggacagcagcccaanaagacgcccacctcccgaggtnctacgtcgtagggtnaccgtagtccggnggggcttagggacgggtagaaggtaaggtccggtgggccttacggaggtaggtaacgtccgtacgtgaaccgaaggttccttacggtaggcctaacgtaccgttcggaccggtaacctacgttaactccgtaacccggtaggtcgggtacgggacctacgtaacccggtcccgtagggtaaacgacgggttcttacggagggttagnggttacgggatacggacgtaccgaaaacttaggaagttcggacgaacgtaaacaagttggtaccagggaacctaagggttaccttgggaacgggacgtacggtactacgaaactaccgggaacgtaaccggaaacggtaccgttacctaacgtacgaacgaaccggtagtaaccgtaccggttaaacncggtaacgggtacgtaacggttacggaaaccggtacgtaaacggtcctaacggtaacgacgtttacggaacgtaaccgttaccgaccggttaaacgtaagtttacccgtaggtaacggttcggtacggttacgaacgggtttaaccggttagggttacccggttagttaccgttttaacccggg

SEQ ID NO: 116770 - DNA, 682 bp, Homo sapiens
  misc_feature: GYAE6OF02JOEBH.45.37.D04.1.454.CMB.1.raw
  modified_base (213)..(213): a, c, t, g, unknown or other
  misc_feature (213)..(213): n is a, c, g, or t
  modified_base (327)..(327): a, c, t, g, unknown or other
  misc_feature (327)..(327): n is a, c, g, or t
  modified_base (429)..(429): a, c, t, g, unknown or other
  misc_feature (429)..(429): n is a, c, g, or t
tcagacgcgatcgacacgaccggtgctcgatttagtagcatactgttgggtttgggggaggagcatcacccagcaaccacatctgtcctctagagaactccctgagagctccgttcctcaccatggactggacctggaggatcctcttcttggtggcagcagcctacaagacgcccactcccgaggtcgcagcctggtgcgagtcgtggggcnggaggtgagggaagccgtgggggcctcgaaggttcggaaggtcctccgtgacgaaggcttcgtggactacgaccttcgaccggcgacctatcctaccagtcgggtacgcgaccnccgggaccccgtcggaacgaacgggtcttaggacggtcggacggttaggggagtacggactaccaaaccctaagaagtggtacggacgaacctaaagtacgngacgaacgaagtacggtttaccggagggtaccggaacggtaccgaaccgtaggtacggaaccggtacgggaaccgtccgggtaacacgtaccgaacgtaccgaacaccgaacctacgagtacgggactacgtacggactcgtaacgacgttacgacgtatcgtacggacaaccgaccgggtcttaagttacgtccgttacggagtacggtaacggttaggttcccggtttaacggggtcgttccgtttacggg

SEQ ID NO: 116771 - DNA, 668 bp, Homo sapiens
  misc_feature: GYAE6OF02IOTH2.45.37.D04.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (475)..(475): a, c, t, g, unknown or other
  misc_feature (475)..(475): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagngggccaccatcaactgacaagtccagccagtagtgtttagntagctaccaaacaataacgaacttactagctttacggaccagacaagaaacctacggtcaacgcctactaagctcgtactactaacttttacgcgggtacacgttccgtaacccgggaagtcccggggtcctaggaaccgtacttcgaagttcggacacgggtccgggtatcgggacagtacgtttcgactctacactatcgtagacacgccgtagcagggactaagtaaacgngttacggtacgtacctaaggtttttaacgcgtaccgttgtaccgtaacgtaccgtaaattagttaaacgttaactacgtttccccgtaccgttacggtttaccccggtccggttaacggtaaaccgttaaacggtcgttaacgtaacttaaccgtaaaacccgtaggttttacggacggttaccctaaccggg

SEQ ID NO: 116772 - DNA, 762 bp, Homo sapiens
  misc_feature: GYAE6OF02H4BSB.45.37.D04.1.454.CMB.1.raw
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
tcagacgcgatcgacacgaccggtgctcgatttagtagcatactgttgggtttgggggagcatcacccagcaaccacatctgtcctctagagaatcccctgagagctccgttcctcaccatggactggacctggaggatcctcttcgttggtggcagcagccacaaagacgccccacctcccgaggtcgcagcgtggtcgctagtcgtggggctggaggtgaggacgcgtcgggcncgagtgagtcnctgcgagtcttcgnggcctacnccgttcgaccggcgactactcctccacgtgggtcgccgacgaccggcccgtagggaccgaagggtccttacgggagtacgggaggtgggacgttcgggtaactaccgtaaaaccctaagtaaggttcgggtacgaactaaacgtaaaacgttctacgtacgaacgtaacgttaaacggttccggacgggtaccgtaaggtccaacgacgtacgaaccggacggaaccgtaccgtacgtaacgtaccgaacgaccgtaaccgtaccgtaacccttaacgacggtaacgggtacgtaccgttaacggaaccgtaccgtaacggtaaccgttaccgaaaccgttacggttacgtaaccggtaaccgtacccggtaacccggtacgtttaacgtttaacgtttaccggttaaggtaccggtacgggttaacggttacggtttccgggttaaacccgggggtttccggtttaccggttttcccgggttttaacccggg

SEQ ID NO: 116773 - DNA, 792 bp, Homo sapiens
  misc_feature: GYAE6OF02FORT3.45.37.D04.1.454.CMB.1.raw
  modified_base (569)..(569): a, c, t, g, unknown or other
  misc_feature (569)..(569): n is a, c, g, or t
tcagacgcgatcgacacgaccggtgctcgatttagtagcatactgttgggtttgggggctacaacaggcaggcaggggcagcaagatggtgttgcagacccaggtcttcatttctctgttgctctggatctctggtgaccgtacggggacatcgtgatcgaccctagtcctccagacctcccgtggctgtacgtcgtcgtgggcgaggaggcccaccatacaactgacgaacgtccgacgaccgagtacggttagttttaacgaccgtacgcctaacctaaactaaagtaacgtaaaccttaacttaacgtcgtttacggtaaccaaggacaaacggtaaaacccgtaacggtacaaccggtacccttaccgtaacggtccgtacgtacccgtattaaccgttttacggccggggtacctacggtacccggtaaccccggggtaaccgggttccccggggttaccccctacggtaaccggttacgttacgtacggtcgggtacgtacggcccggggttactcgggggaacctacgtacgtttaccaccggtcctaacacccgtagtacnggaccccgtagtaccgtccgacgacggaccgtaggaaccgtcgttaggtcggttactttacggttatccggggtattacggacgtactaaagtattttaaacgttattaccctttaccgttcccgttacgttaccccggtacgttacccggttaacggtaacgttaacgggttaacagtttaccgtaacgtaaccgtgtaacccgtccggtagtacccgtacc

SEQ ID NO: 116774 - DNA, 785 bp, Homo sapiens
  misc_feature: GYAE6OF02FS7R6.45.37.D04.1.454.CMB.1.raw
  modified_base (375)..(375): a, c, t, g, unknown or other
  misc_feature (375)..(375): n is a, c, g, or t
tcagacgcgatcgacacgaccggtgctcgatttagtagcatactgttggggtttgggggagctacaacaggcaggcaggggcagcaagatggtgttgcagacccaggtcttcatttctctgttgctctggatctctggtgccgtacggggacatcgtgatggacccagtctccagacctcccgtggctgtcgtctcgtggggcgacggacgggcccaccatccaactcgacaacgtccacgccagtaggttgtttaacgactagcctaccaaacaaagtaaacgaacttactagtacgttacggtaacccagacctaacggaaacctagggtaccacgtaccctaccgtaaagtcctcgcttactagtttaccgnggtacctacgtaccggtaccgggtacgtcccggggttcctacggtaccgtacttcgacgggcgacggacgggtcggtacgacgggacagttactcgacctctaccacgtactccgacgcgtacgtccgtacggaccgtacgggtacgtaaggtaaacggtcgttagggtacggttaacgtttaacggttttacggtcggtacgttacggttacgtaagttaaaccgttaaacgtttaacgttttaaacgtttaacgtttacccgtttaccccggttacccgggtttaacccgttacccggggttaacccgggttaacggggtaaaccgttaaacgggttaccggtaacgttaaacccggtaaaccggttaaaccggttaaccggtcggggttacggtaaccgtaacccgg

SEQ ID NO: 116775 - DNA, 733 bp, Homo sapiens
  misc_feature: GYAE6OF02IU53Q.45.37.D04.1.454.CMB.1.raw
tcagacgcgatcgacacgaccggtgctcgatttagtagcatactgttggggtttggggagagcatcacccagcaaccacatctgtcctctagagaactcccctgagagctccgttcctcaccatggactggacctggaggatccgtcttcgttggtggcagcacgccaacaagacgccccactcccgagggtcgacagtcgtagggtgcgtaggtcgtggggctggaacgggtgaaggacgccggtgggcctgaggtagacggtctcgtgcgaagtcttgcggctacctaccgtcgaccggtcactctcctcgtaggtcgggtacgccggtaacgtccggtcccgtaggaacggtacgggtcgttaggacggtggtaagtcggggtaatcggtaactaacccgtaacccgtaagtacgtacggggactaactaaaccgtaactgacgacgtaacgtacggttacgttaacggagggtaccgtagacctaacgagtaccgggacgtaacgacctaccgtacacgtaacgtaccgacgaaccgtacgtaccgaaaggtggtcgaacgacggtacgaacggtacgtaccgcgtaaaccgtacgtaccgtaggtaaccgtacccgaacggttacccggtaacttttaaggttacccgtacgttacgggttacggtaccggtttaacggtttaccgggttacccggtttcgggttaccggtttcggtttttaacccgg

SEQ ID NO: 116776 - DNA, 227 bp, Homo sapiens
  misc_feature: GYAE6OF02JK5WN.45.37.D04.1.454.CMB.1.raw
  modified_base (218)..(227): a, c, t, g, unknown or other
  misc_feature (218)..(227): n is a, c, g, or t
tcagacgcgatcgacacgaccggtgctcgatttagtagcatactgttgggtttgggggagctacaacaggcaggcaggggcagcaagatgtgttgcagacccaggtcttcatttctctgttgctctggtatctctggtgccgtacgggcagtcgtgatcgaccagtcctccagtacctccgtggctgtgtctcgtgggacgaggacggcccaaccgtnnnnnnnnnn

SEQ ID NO: 116777 - DNA, 809 bp, Homo sapiens
  misc_feature: GYAE6OF02FSQSE.45.37.D04.1.454.CMB.1.raw
tcagacgcgatcgacacgaccggtgctcgatttagtagcatactgttgggtttggggagctacaacaggcaggccaggggcagcaagatggtgttgcagacccaggtcttcattttctctgttgctcttggatctctggtgcctacggggacatcgtgatggacccagtctccacgactcccgtggcctgtgtctcgtgggcgagagggcctaccgtatcaaacgtgacaaagtccgaagcctagtaggttgttttaacgacaggcttccgaaacaaacttaaggaaaccttacgttaagtactttgggtacccaaggtcaaggaaaccaggttcacggtacccccctaaaggtccttaggtctacctaagttttaccgtggggtctagtaccgtttaacccgggggaacttccccggggttacccctcggtaacccgtaactttaccgaaggtttcgggacgacgggtcgggtccgttaggggacctacggtaagttttcccgtaaccgttcgttaccgtaaccctaacgttccgaacggtacgtaaccgtcccgttcggaacctacggggtacccgtaaggtaaacggaacgttcggttacgggaataccgggttttttaatcgggtaaccttcgggttacgaacgggtacctaaagttttagtttaacgtttaaacgttacgtttaccccgttaccgttaccgtttaccggaccccggttaccggggtaaacctaacgggttacggtacttaacgtaacccggttaaaccggtaacgtttacggtacggttaccgtagtaaccccg

SEQ ID NO: 116778 - DNA, 772 bp, Homo sapiens
  misc_feature: GYAE6OF02FO92Z.45.37.D04.1.454.CMB.1.raw
  modified_base (753)..(753): a, c, t, g, unknown or other
  misc_feature (753)..(753): n is a, c, g, or t
  modified_base (764)..(764): a, c, t, g, unknown or other
  misc_feature (764)..(764): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctcgtggtgccgtacggggacatcgtgatcgacccagtcctccagacctcccgtggctgtgtctcgtgggcgaggacggaccacactacaacgtgacacgtccagccagtagttagtttacgactacgacctaccaaactaaagtaacgtaaccttacgttacgtacgttacggtaaccacgtaacgaaaccgaaaccgtacggtaccgaacgtacccgtaaccgtaacgtcgttcgtacctacttaacgtttacgtcgggtacctacgttacccgggtaacccgggtaccgggtcccggggtaccctacgggaccgttagttacgacggtacggaccgtacggggtccggggtacggtacgggtaaccgttacggttacctttaccgtaccgtttaccgaccctaaccgtcggtaccgtacggaccgtaccgtccgtacggacgtacggacgtaaggacgttacgttcggtacgtacgttacggttctcggtacttcggtactaacggttacttaattagtttacttaacctttccgttacccgttaccgttacccggttccggtaacccggtacggtaaaccggtaagtacgtaacgttaacgtaaccgtaaacccggtntagggtacccngtaacccg

SEQ ID NO: 116779 - DNA, 810 bp, Homo sapiens
  misc_feature: GYAE6OF02GV6EK.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacggggacatcgtgatgacccagtctccagactcccctggctgtgtctcgtggcgagagggcccacgatcaactgacaacgtccagaccgagtaggttaggttttacgacgtacggtcctacccaaacgtaaataacggtaacttaaccgtttaagtccgttacgggtaacccaaggtaccaaacggtaaaccacggtacgacgtacccgtacctaaacgctacgtacctcgtaactttacgtcgggactagtaccccgttaacccgggtaacgtccccggggtttaccggacggacccttagttacgacggttcggaccgagggttccggtacgtacgggaacgtacggtaccttttaacgccgttaccgtaccgacccgttaacgtaccgtaccggaccgtaccggtaaccgtcggtaccggaacgggtacgtaacgtaacggttacgtacgggtaagtccgggttttaaagtttccggttacgaccgttacggttactaacggtaaccttaaaggtttaacttttacggttactttaccgtacccgtttaccggttacccgtttacccggggtacccggtttaacggaaacccggttaacggttacggtaactaccgtaaaccgtaaacccggttaacggttggtaccgggtacctaacccggg

SEQ ID NO: 116780 - DNA, 759 bp, Homo sapiens
  misc_feature: GYAE6OF02GZZZN.45.37.D04.1.454.CMB.1.raw
  modified_base (566)..(566): a, c, t, g, unknown or other
  misc_feature (566)..(566): n is a, c, g, or t
  modified_base (610)..(610): a, c, t, g, unknown or other
  misc_feature (610)..(610): n is a, c, g, or t
  modified_base (618)..(618): a, c, t, g, unknown or other
  misc_feature (618)..(618): n is a, c, g, or t
  modified_base (647)..(647): a, c, t, g, unknown or other
  misc_feature (647)..(647): n is a, c, g, or t
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtcctccagacctccctggtctgtcgtctcgtgggcgagacgggccaccatcaactcgcaacgtccacgtaccaggtagttcgttttaacgactacgcctacccgaaactaaataaaacgtaaccttaacttagtaccgtttacgggtacccagtaccgaacgtaaaacccgtacggtaccgaacgtcccgttacctaagtccgtacgtaccttacgtacgtttacggtcgggtactaccgttaacccggtaccccggggtaaacgttccccgggggtacccttacgggtaacctacggttccgtaacgggtttacgggaccgtacggggtccggttaccgggttcggggtaccgtaggttaccttttaccgtaccgttccgtacccacgttactcggaccngtaccgcgtagaccggtggtacctggaagtacgttgggacgttnttaggttntcggtcgtacgtcaagtaccgtaaatttnttaaactttacgttaccgttacccgttaccgtacgttcccggtaccgttaacggtaacggtagttacggtaactacggttaactaaccggttagtacgttaccgatacccgg

SEQ ID NO: 116781 - DNA, 897 bp, Homo sapiens
  misc_feature: GYAE6OF02IRPOC.45.37.D04.1.454.CMB.1.raw
tcagacgcgatcgacacgaccggtgctcgatttagtagcatactggttggggtttgggggagcatcacccagcaaccacatctgtcctctagagaactcccctgagagctccgttcctcaccatcggactcggaccgtggaggatccttcttcgttggtggcagcacgccaacaagaccgcccacctacccgaggtcgcgacgtcgtggtcgccgtaggtcgtggggctggaggtaggacggacgccggtcgggcctcgtaaggtacgtacgggtcctcgtacgacgaacggttccttcgcggtacctaccgtaccgttaccgaccggtacgtaactacctcctaccggtacggtgggtaccgacgaccggccggtacccgtaggtaacccgtagggttaccgttagggtacgggtacggtacggggtacggggtaagttaccgggtaaaccttaacccggaaaacccgttaaaggtaacgggtttcgggaaccggtaacctaaaacgttaacgtacggtaacggacgttaaacggttaaccggttacgttacgggaacggttaccggacgtaacccgtaagtaccgtaaaccgggtacggaaaccggggtaacctaaccgggtaccaaacggtacccgaaaacgcccgtaacgaaaccgtaccgtacgggtaacacggggtacgacccgtaaagggcaacccggttaaagaccggttacaacccgttaaactccgggtaaacgacccggtaaccgttaccggtttaccgtttaacgttttacggtaaacccgggtttgggacgggttttaaacccggtaacggggttttaaacccggttttacggggttaacccggggtcgtttttaccgggtttaccccggggtttttaacccgg

SEQ ID NO: 116782 - DNA, 729 bp, Homo sapiens
  misc_feature: GYAE6OF02FZK6M.45.37.D04.1.454.CMB.1.raw
  modified_base (541)..(541): a, c, t, g, unknown or other
  misc_feature (541)..(541): n is a, c, g, or t
  modified_base (620)..(620): a, c, t, g, unknown or other
  misc_feature (620)..(620): n is a, c, g, or t
tcagacgcgatcgacacgaccggtgctcgatttagtagcatactgttgggtttgggggagctacaacaggcaggcagggcagcaagatggtgttgcagacccaggtcttcatttctctgttgctctggatctctggtgcctacgggacatcgtgagtcgacccagtctcacgacctcccgtggctgtgtcgtcgtgggactaggacggccacctacgtaccaacgtgaccgaacgtccgacgtaccgaagtagtttacgttttaacggaacctacgtaccgttaacccaaaacgtaaaaacgtaaacgtaaaccggttaacttaacggtaccgtttaccggtaaccagtacaaacgtaaaaccgtaggttaccgacgtacccgtacctaacgtcgttcgcttacgtaacgtttacgtgggtaacctacgttaccggtaaccggtaaccggtcccggggtacctcgaaccgttatccgaggtcgaccgtaggtcgtacggtacggacctaaggtaccttacgacttccgaactaaccgtacnccgtacgtaccgtcgtaccgtacgcgtacgttacgaagacgtagtgcgttaccttaggttacgtcgaccgtgtaacggnttaacgtattacttagtacttaccgtccgttaccgtcgttaccgaaccgtacggtaaacgtagttactaacgtaacgtacgtaaaccgtagtacggttacgccgttacg

SEQ ID NO: 116783 - DNA, 801 bp, Homo sapiens
  misc_feature: GYAE6OF02IIMR0.45.37.D04.1.454.CMB.1.raw
  modified_base (676)..(676): a, c, t, g, unknown or other
  misc_feature (676)..(676): n is a, c, g, or t
tcagacgcgatcgacacgaccggtgctcgatttagtagcatactgttggggtttgggggagaactacaacaggcaggcaggggcagcaagatggtgttgcagacccaggtcttcatttctcgtgttgctctggattctctggtgcgtacggggacatcgtgatcgacctagtctccagactcctggctgtcgtctcgtgggacgtacggacgggcccacaagtactaacgtcggacacgtaccgacgcctaaggtacggtttacgtttagaaccgacggtaccttaaccaaactaaagtaaacgaaccttacgtacgtcttacggtaccagcaaagaccgacgagggtacacgtccctacgacgtcctagtcgttactttacggacggtccctacgggttacccggggacggttcccgggtacccgtagacccgtagttccgaacggtggacgtcggggtccggttacggtacgggactaggtaaccgtttccacgttaaccgtccaaccgtaacgttaccgagtacccgtacgtaccggtaccgtaccggtaacgtaccgtaaggtaaaccggttacttaccggtcctaaaccgggttttactttaaacccggttcggtaccggttaaccgagtaaacccggtttaattaaccggtttgtaaccgggtttaaacncccgttttttaagtcccgtttaacggtttacccggtttagggggaaccggtaaacggaccggtttaaacggtcggaacttaacgtaaacccgtaccggttagtaaccggtccgtaccggttaacc

SEQ ID NO: 116784 - DNA, 800 bp, Homo sapiens
  misc_feature: GYAE6OF02HGY1H.45.37.D04.1.454.CMB.1.raw
tcagacgcgatcgacacgaccggtgctcgatttagtagcatactgttgggtttgggggagctacaacaggcaggcaggggcagcaagatggtgttgcagacccaggtcttcatttctctgttgctctggatctctggtgccgtacgggacatcgtgatcgacccagtctccagacctcccgtggctgtgtctcgtgggcgagacgggccaccatcaactgaccaagtccagccagtagttgtttagacagctaccaacaagtaacaactacttagcttacgtaccgagacaagaaacccaggtacacgcccgtacctaagcctcgtcctctaatttaccgcgggactacgtaccgtaacccgggtaacggttccccggggtccctacggaccctattccgaggtcggacgtacggtccgggtacgtacgggacgtacgttactttaccaccttcgtaccacctacgtaccgaacgtccgtaacgcccgtacgtaccgagggtacgtacggtaaagtacggttacgggtacggtacgttacggtttttacgttacggtaccgtttacggtaccgttaaacggtactttaaacgttttaacttttaaacgtttaaccgttttaaccgtttaccccgttaccccgttttaacccggttttttaccccggggtacccggttttaaccgggggtaaaaccccggtttaaaggtttaacccggttaaacggtttaacccggtttaaaccccggtaaaaaccgggttaacccgtttacggggttaccccgggttaccgttaacccgg

SEQ ID NO: 116785 - DNA, 379 bp, Homo sapiens
  misc_feature: GYAE6OF01A704W.43.85.H08.1.454.CMB.1.raw
  modified_base (372)..(379): a, c, t, g, unknown or other
  misc_feature (372)..(379): n is a, c, g, or t
tcagtgtgagtagtcacgaccggtgctcgatttagtatcactcagtcgcggggatgcaagtcagaaatattatctggactctgtgaagggccgattcaccatctccagagacaacaccaaggactcactgtatctgcagatgaacagcctgagagccgaggacacggctgtgtattactgtgtgagagacagtagtggctattactggggccagggaacccaggtcatcgtctcctcagcctccaccaagggcccatcggtcttcccctggcgccctgctccaggagcacctccgagagcacagcggccctgggctgcctggtcaaggctacttccactactcacactgacgcggctggcaaggcgcatagnnnnnnnn

SEQ ID NO: 116786 - DNA, 489 bp, Homo sapiens
  misc_feature: GYAE6OF02JZUUP.43.85.H08.1.454.CMB.1.raw
  modified_base (225)..(225): a, c, t, g, unknown or other
  misc_feature (225)..(225): n is a, c, g, or t
  modified_base (315)..(315): a, c, t, g, unknown or other
  misc_feature (315)..(315): n is a, c, g, or t
  modified_base (456)..(456): a, c, t, g, unknown or other
  misc_feature (456)..(456): n is a, c, g, or t
  modified_base (459)..(489): a, c, t, g, unknown or other
  misc_feature (459)..(489): n is a, c, g, or t
tcagtgtgagtagtcacgaccggtgctcgatttagtatcactcagtcgcggggatgcaagtcagaaatattatctggactctgtgaagggccgattcaccatctccagagacaacaccaaggactcactgtatctgcagatgaacagcctgagagccgaggacacggctgtgtattactgtgtgagagacagttagtggctattacgtggggccaagggaacccnggtcagtcgtctcctcgacgcctaccgaccaacggggccccagtccggtccttccccccgtgggcccgtccccctgccaacccgtggacnccacctccgagcgccacgcggcccggcccgtgggcctggcccgttgggtaccaaacggtccttaacctccaaccgttcctacaccgtacgtcgaacggccgggtcctagggaccaagggccgacgtacgtagcagcgcgtngcnnnnnnnnnnnnnnnnnnnnnnnnnnnnnnn

SEQ ID NO: 116787 - DNA, 421 bp, Homo sapiens
  misc_feature: GYAE6OF02JCYQ3.43.85.H08.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
  modified_base (403)..(421): a, c, t, g, unknown or other
  misc_feature (403)..(421): n is a, c, g, or t
tcagtgtgagtagtcacgaccggtgctcgatttagtatcactcagtcgcggggatgcaagtcagaaatattatctggactctgtgaagggccgattcaccatctccagagacaacaccaaggactcactgtatctgcagatgaacagcctgagagccgaggacacggctgtgtattactgtgtgagagacagtagnggctattacgnggggccagggaaccnggtccatcgtcncctcagcctccaccgaacgggcccacgtcggtcccttccccctggccgcccctgcctcccgaggacnccacctccgagacgcacgngccggccgtggctcgcctggccaaggcctacgtccactacctcaacnctcggaacgcggggctcggcaaggccgagataggcnnnnnnnnnnnnnnnnnnn

SEQ ID NO: 116788 - DNA, 460 bp, Homo sapiens
  misc_feature: GYAE6OF02GZ0MX.43.85.H08.1.454.CMB.1.raw
  modified_base (436)..(460): a, c, t, g, unknown or other
  misc_feature (436)..(460): n is a, c, g, or t
tcagtgtgagtagtcacgaccggtgctcgatttagtatcactcagtcgcggggatgcaagtcagaaatattatctggactctgtgaagggccgattcaccatctccagagacaacaccaaggactcactgtatctgcagatgaacagcctgagagccgaggacacggctgtgtattactgtgtgagagacagtagtggctattacgtggggccagggaacccaggtcatcgtctcctcacgcctccactaacgggcccagtccggtccttcccccgtggccgcccctcgcctccgaggacgccgaccctccgagacgccacaggccgcccgtgggctcgccgtggtacgaacggaccttaccttcccgaacttaccgtacaacctaccgtagacgggtcgggaccgtcgggacgtaacgggccgacaagtagagcnnnnnnnnnnnnnnnnnnnnnnnnn

SEQ ID NO: 116789 - DNA, 474 bp, Homo sapiens
  misc_feature: GYAE6OF02HOLA5.43.85.H08.1.454.CMB.1.raw
  modified_base (126)..(126): a, c, t, g, unknown or other
  misc_feature (126)..(126): n is a, c, g, or t
  modified_base (199)..(199): a, c, t, g, unknown or other
  misc_feature (199)..(199): n is a, c, g, or t
  modified_base (280)..(280): a, c, t, g, unknown or other
  misc_feature (280)..(280): n is a, c, g, or t
  modified_base (318)..(318): a, c, t, g, unknown or other
  misc_feature (318)..(318): n is a, c, g, or t
  modified_base (435)..(474): a, c, t, g, unknown or other
  misc_feature (435)..(474): n is a, c, g, or t
tcagtgtgagtagtcacgaccggtgctcgatttagtatcactcagtcgcggggatgcaagtcagaaatattatctggactctgtgaagggccgattcaccatctccagagacaacaccaaggactnactgtatctgcagatgaacagcctgagagccgaggacacggctgtgtattactgtgtgagagacagtagtggntattacgtgggaccaaggggaacccaggtcatccgtctcctcagccctccaccaaacgggcccatccggtccttcccccgnggccgccccttgcctccgaggacgccaccgtccggagngccaacgacggccggcccgtggggcctacggccgtcggtacgaaacggaccttaccttaccgaccttactaccacaactgacgtcgggactggaccgaacgcgaactactagctagnnnnnnnnnnnnnnnnnnnnnnnnnnnnnnnnnnnnnnnn

SEQ ID NO: 116790 - DNA, 635 bp, Homo sapiens
  misc_feature: GYAE6OF02G5AIU.43.85.H08.1.454.CMB.1.raw
  modified_base (107)..(107): a, c, t, g, unknown or other
  misc_feature (107)..(107): n is a, c, g, or t
  modified_base (145)..(145): a, c, t, g, unknown or other
  misc_feature (145)..(145): n is a, c, g, or t
  modified_base (242)..(242): a, c, t, g, unknown or other
  misc_feature (242)..(242): n is a, c, g, or t
  modified_base (553)..(553): a, c, t, g, unknown or other
  misc_feature (553)..(553): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (585)..(585): a, c, t, g, unknown or other
  misc_feature (585)..(585): n is a, c, g, or t
  modified_base (588)..(589): a, c, t, g, unknown or other
  misc_feature (588)..(589): n is a, c, g, or t
  modified_base (591)..(592): a, c, t, g, unknown or other
  misc_feature (591)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
  modified_base (608)..(611): a, c, t, g, unknown or other
  misc_feature (608)..(611): n is a, c, g, or t
  modified_base (613)..(613): a, c, t, g, unknown or other
  misc_feature (613)..(613): n is a, c, g, or t
  modified_base (616)..(616): a, c, t, g, unknown or other
  misc_feature (616)..(616): n is a, c, g, or t
  modified_base (619)..(624): a, c, t, g, unknown or other
  misc_feature (619)..(624): n is a, c, g, or t
  modified_base (628)..(630): a, c, t, g, unknown or other
  misc_feature (628)..(630): n is a, c, g, or t
  modified_base (632)..(634): a, c, t, g, unknown or other
  misc_feature (632)..(634): n is a, c, g, or t
tcagtgtgagtagtcacgaccggtgctcgatttagtatcactcagtcgcggggatgcaagtcagaaatattatctgactctgtgaagggccgattcaccatctccanagacaacaccaagactcactgtatctagcagatgaacngctgagagcgaggacgacggctgtagtattacgtgtgtgagacgtacgaggtacggtgtcttaagttaccggtcgggggacctaacgggaaccccgnggttacctacgttccgtacctccttacgaccgtcccctaccgaaccggaaccgggtccctacggttcccgttcccccttccccggtcggccccgtacccgttcggacctacccgggaacgggaccgtaccctaccccggtaccgaagggaacccgtaccgaacccggtacgggcccccgtaccggggttcggccgttaccggtaccggtaacggtaaccaaaccggtttaccctaccgtttacccgaaccttacctacgaccgtaacgtacgggaccgggtacggtacgtacggaaccggtaggcccgtanaaccgtnagctcgcngacttacgntacntacngcnncnncncnancatgngnngnnnngngcncgnnnnnncgcnnncnnnc

SEQ ID NO: 116791 - DNA, 149 bp, Homo sapiens
  misc_feature: GYAE6OF01C2UVW.36.35.D02.1.454.CMB.1.raw
  modified_base (148)..(149): a, c, t, g, unknown or other
  misc_feature (148)..(149): n is a, c, g, or t
tcagtacgctgtctcacgaccggtgctcgatttagcacacgatagttgggtttgggattcacgttgcagatgtaggtctgggtgccctggctgcctggtcaaggactacttcagacagcgtactgagcgggctggcaaggcgcatagnn

SEQ ID NO: 116792 - DNA, 174 bp, Homo sapiens
  misc_feature: GYAE6OF01CUE0H.36.35.D02.1.454.CMB.1.raw
  modified_base (172)..(174): a, c, t, g, unknown or other
  misc_feature (172)..(174): n is a, c, g, or t
tcagtacgctgtctcacgaccggtgctcgatttagcacacgatagttgggtttggggaagaggaagactgacggtcccccaggagttcaggtgctgggcacagcggccctgggctgcctggtcaaggactacttccagacagcgtactgagcgggctggcaaggcgcatagnnn

SEQ ID NO: 116793 - DNA, 180 bp, Homo sapiens
  misc_feature: GYAE6OF01BUMXF.36.35.D02.1.454.CMB.1.raw
  modified_base (171)..(180): a, c, t, g, unknown or other
  misc_feature (171)..(180): n is a, c, g, or t
tcagtacgctgtctcacgaccggtgctcgatttagcacacgatagttgggtttgggggaagaggaagactgacggtcccccaggagttcaggtgctgggcacagcggcctggctgcctggtcaaggactacttccagacagcgtactgagcgggctggcaaggcgcatagnnnnnnnnnn

SEQ ID NO: 116794 - DNA, 174 bp, Homo sapiens
  misc_feature: GYAE6OF01A8G49.36.35.D02.1.454.CMB.1.raw
  modified_base (173)..(174): a, c, t, g, unknown or other
  misc_feature (173)..(174): n is a, c, g, or t
tcagtacgctgtctcacgaccggtgctcgatttagcacacgatagttgggtttgggggaagaggaagactgacggtcccccaggagttcaggtgctgggcacagcggccctgggctgcctggtcaaggactacttccagacagcgtactgagcgggctggcaaggcgcatagnn

SEQ ID NO: 116795 - DNA, 495 bp, Homo sapiens
  misc_feature: GYAE6OF01A0QZC.36.35.D02.1.454.CMB.1.raw
  modified_base (246)..(246): a, c, t, g, unknown or other
  misc_feature (246)..(246): n is a, c, g, or t
  modified_base (477)..(477): a, c, t, g, unknown or other
  misc_feature (477)..(477): n is a, c, g, or t
tcagtacgctgtctcacgaccggtgctcgatttagcacacgatagttgggtttgggggagctacaacagacaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgttactgggcctctaccgggatccgggtcctgaacgatcagtggcggcggtctgggacagatttcactctcaccatcagcagcctgcggctgaagatgtggcggtttattactgtcagcagtattatgttactctcactagtttggcagggaccagctggagncgcacgactgtgctgcac

SEQ ID NO: 116796 - DNA, 175 bp, Homo sapiens
  misc_feature: GYAE6OF01CQAV9.36.35.D02.1.454.CMB.1.raw
  modified_base (173)..(175): a, c, t, g, unknown or other
  misc_feature (173)..(175): n is a, c, g, or t
tcagtacgctgtctcacgaccggtgctcgatttagcacacgatagttgggtttgggggaagaggaagactgacggtcccccaggagttcaggtgctgggcacagcggccctgggctgcctggtcaaggactacttccagacagcgtactgagcgggctggcaaggcgcatagnnn

SEQ ID NO: 116797 - DNA, 505 bp, Homo sapiens
  misc_feature: GYAE6OF01B4S5S.36.35.D02.1.454.CMB.1.raw
  modified_base (242)..(242): a, c, t, g, unknown or other
  misc_feature (242)..(242): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttacngggcctctacccgggatccgggtccctgaacgattcagtggcggnggtctgggacagatttcactctcaccatcagcagcctgcggctgaagatgtggtcggtttattactgtcagcagtattatgttactcctctactagtttgccgagggaccagcgtggagatcgcacgactgtgcngcncntcg

SEQ ID NO: 116798 - DNA, 529 bp, Homo sapiens
  misc_feature: GYAE6OF01A4XW1.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggcttagctggcttttcttgtggctattttaaaaggtgtccagtgtgaggtgcagctgctggagtctgggggaggcttggtacagccggggggtccctgagactctcctgtgaagcctctggattcacctttgacaagtgtgccatgacctgggtccgccaggctccagggaagggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtgacgtaaacttcctttagacttggttattactacccctagtcgacctacgg

SEQ ID NO: 116799 - DNA, 506 bp, Homo sapiens
  misc_feature: GYAE6OF01D5QXG.36.35.D02.1.454.CMB.1.raw
  modified_base (247)..(247): a, c, t, g, unknown or other
  misc_feature (247)..(247): n is a, c, g, or t
  modified_base (487)..(487): a, c, t, g, unknown or other
  misc_feature (487)..(487): n is a, c, g, or t
  modified_base (498)..(498): a, c, t, g, unknown or other
  misc_feature (498)..(498): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctacccgggaatccgggtcctgaacgattcagtggcggcgggtctgggacagatttcactctcaccatcagcagcctgcggctgaagatgtggtcgtttattactgtcagcagtattatgttactcctcactagtttgccagggaccaagcgtaggagncgcacgactgngctgcacc

SEQ ID NO: 116800 - DNA, 177 bp, Homo sapiens
  misc_feature: GYAE6OF01D6FBW.36.35.D02.1.454.CMB.1.raw
  modified_base (173)..(177): a, c, t, g, unknown or other
  misc_feature (173)..(177): n is a, c, g, or t
tcagtacgctgtctcacgaccggtgctcgatttagcacacgatagttgggtttgggggaagaggaagactgacggtcccccaggagttcaggtgctgggcacagcggccctgggctgcctggtcaaggactacttccagacagcgtactgagcgggctggcaaggcgcatagnnnnn

SEQ ID NO: 116801 - DNA, 536 bp, Homo sapiens
  misc_feature: GYAE6OF01CFP65.36.35.D02.1.454.CMB.1.raw
  modified_base (249)..(249): a, c, t, g, unknown or other
  misc_feature (249)..(249): n is a, c, g, or t
  modified_base (510)..(510): a, c, t, g, unknown or other
  misc_feature (510)..(510): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccaacgatcaactgcaagtccagccggagtgttttanacaactcaagaataagagttcttagcttggtaccagcaagaaaccacgacagcctcctaagctgctcgttactgggcctcgtacccgggaatcccggggtcctagaacgtattcgaggtcgggcggcgggtcgtgggacagtattcactctcacatcagcagccgtgcggctgaagtagtggtcggtcgtttatacgtgtacagtctagtattatgttactcctctactagtttcggaccgacgggtaccaggcgtaggancgtcgacaacgtactggtgctgctac

SEQ ID NO: 116802 - DNA, 546 bp, Homo sapiens
  misc_feature: GYAE6OF01CWLMC.36.35.D02.1.454.CMB.1.raw
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
  modified_base (419)..(419): a, c, t, g, unknown or other
  misc_feature (419)..(419): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccagacagcctctaagctgctcgtttacngggcctcgtaccgggaatccgggtccctgaacgattcgagtgggcggcgggtctgggacagtatttcactctcaccatcagcagcctgcggctagaagntgtggtacgtttattacgtgtcagtcgtagttactttagtcgttaccttccttactacgtacgtttcggaccgtaggggaacctaaggcgtaggagacgtcgacgacgtaacgtcgtggctgctacg

SEQ ID NO: 116803 - DNA, 603 bp, Homo sapiens
  misc_feature: GYAE6OF01EGZEA.36.35.D02.1.454.CMB.1.raw
  modified_base (263)..(263): a, c, t, g, unknown or other
  misc_feature (263)..(263): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagcggtgtgtttctaggtggctatttaaaggtctctgtgaagctctggattcacctttgacaagtgtgccatgacctgggtccgccaggcctccagggaagggctgggagtgggtctnaggttattaggtggtagtggtagtagcacagattacgcagactccgtgaagggccggttcaccatctccagagacaattccaacagcacgtctgtattgcacatgaacngcngagagcgagacacgcatatattattgtgtacgtaactttccgtttagtacgttgtttacttactaccctagtcgtaccgtacgtcgggaccgtacgggtaacccgtcggtaccgtacccgttcctacccgtccgaccgtccctacccgaaccgaaccgggtcccctacgttcccggttccccttcccccgtcggcccctacccctccctaccaacgccgccgtacccg

SEQ ID NO: 116804 - DNA, 514 bp, Homo sapiens
  misc_feature: GYAE6OF01CYEUU.36.35.D02.1.454.CMB.1.raw
  modified_base (246)..(246): a, c, t, g, unknown or other
  misc_feature (246)..(246): n is a, c, g, or t
  modified_base (490)..(490): a, c, t, g, unknown or other
  misc_feature (490)..(490): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttactgggcctctacccgggaatccggggtccctgaacgattcagtggcggcgggtctggggacagatttcactctcaccatcagcagcctgcggctgagatgtggcggtttattactgtcagcagtattatgttactcctcactagttttggccaggggaccaagcgtggagntcgcacgaactgtggctgctaccg

SEQ ID NO: 116805 - DNA, 570 bp, Homo sapiens
  misc_feature: GYAE6OF01A5SL6.36.35.D02.1.454.CMB.1.raw
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagcgtgcgttttctagtggctattttaaaaggtctctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgagggcacggccatatattattgtgacgtaaacttccttttgacttggttattactccccttagtcgaccacgtggggccagggaaccctggtccaccgtctcctcacgcctccaccgaacgggccccattccggtccctttccccccgtcgggccctaccccttccctacccaacgtcgcctacccg

SEQ ID NO: 116806 - DNA, 510 bp, Homo sapiens
  misc_feature: GYAE6OF01A78OH.36.35.D02.1.454.CMB.1.raw
  modified_base (418)..(418): a, c, t, g, unknown or other
  misc_feature (418)..(418): n is a, c, g, or t
  modified_base (488)..(488): a, c, t, g, unknown or other
  misc_feature (488)..(488): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaaccacgacagcctcctaagctgctcgtttactgggcctctacccgggaatcccgggtcctgaacgattcagtggcggcggtctgggacagtatttcactctcaccatcagcagcctggcggctgaagntgtggtcgtttattactgtcagctagtattatgttactctctactagtttgccgagggaccagctggagntcgcacgtactgtgctgctacc

SEQ ID NO: 116807 - DNA, 512 bp, Homo sapiens
  misc_feature: GYAE6OF01BYQ7X.36.35.D02.1.454.CMB.1.raw
  modified_base (242)..(242): a, c, t, g, unknown or other
  misc_feature (242)..(242): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctcctaagctgctcgtttactgggcctctacccgggaatccggggtccctgaacgattcgagtggcggcgggtctgggacagatttcactctcaccatcagcagcctgcggctgaagatgtggtcggtttattactgtcagcagtattatgttactcctcactagtttggccgtagggaccagcgtggagatcgcacgaactggtggctgcncntcg

SEQ ID NO: 116808 - DNA, 510 bp, Homo sapiens
  misc_feature: GYAE6OF01DXT8O.36.35.D02.1.454.CMB.1.raw
  modified_base (242)..(242): a, c, t, g, unknown or other
  misc_feature (242)..(242): n is a, c, g, or t
  modified_base (317)..(317): a, c, t, g, unknown or other
  misc_feature (317)..(317): n is a, c, g, or t
  modified_base (507)..(507): a, c, t, g, unknown or other
  misc_feature (507)..(507): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttacngggcctctacccgggaatccggggtccctgaacgattcagtggcggcgggtctgggacagatttcactctcaccatcagcagcctgcggctgaagatgtggtcggtttatactgtcagcagtattatgttactcctcactagtttggccaggggaccaagctggagatcgcacgaactgtggctgcaccntcg

SEQ ID NO: 116809 - DNA, 571 bp, Homo sapiens
  misc_feature: GYAE6OF01BLMVN.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcgttggtacgaggccgggggggtccctggagactctcctgtgaagcctctggattcacctttgacaagtgtgccatcgacctgggtccgcaaggcctccgaggggaacggggctgggagtgggtctcgtagttattagtggtagtggtagtagcacagtattacgcagactcggagaacgggtccgttacacctatcctcagagacaactccaacacgcacgctgtattgacacatacgaacacgcctaggagacggaccgaggaccgacggacctagtatagttagtggtagaccgttaaactttccttttagacgtttgttaacttactcccctagtcgtaacccg

SEQ ID NO: 116810 - DNA, 512 bp, Homo sapiens
  misc_feature: GYAE6OF01CZJJ4.36.35.D02.1.454.CMB.1.raw
  modified_base (246)..(246): a, c, t, g, unknown or other
  misc_feature (246)..(246): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccaacagaaaccacgacagcctcctaagctgctcgtttactgggcctctacccgggaatccggggtccctgaacgattcagtggcggcgggtctgggacagtatttcactctcaccatcagcagcctgcggctgagatgtggtcgtttattactgtcagctagtattatgttactcctcactgtttggccgagggaccagcgtggagatcgcacgaactgtgntcgcnctac

SEQ ID NO: 116811 - DNA, 710 bp, Homo sapiens
  misc_feature: GYAE6OF01BRQ9O.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctgggagtcgtgggggaggcgttgggtacgaggcccgggggggtccctggacgactcgtcctgtgaagcctctggtatctacctttgacaagtgtgccatgaccgtggtccgccgaggctccgagggaagggcgtgggagtgggtctcgtagttataggtggtagtggtagtagctacagtattacgcagtaccgtccggtaggaacggggtccggttacaccacttctaccgaagacgaactaacttacccaaacgagtaccaacggtcttacggtaactttcggacctaacctaagtacggaaactacggccctagggaaacggaccgacccgggaacgggaacccgaacccgggaccctaaagttaacgtttaaatttacggtttacggtaacgggtaaccccgtttaaacgtttttccccgtttttaaggtaacccgtttacgggttttaaccttttaaaccgttccccccgtttaaagggttacggtaaacccccggg

SEQ ID NO: 116812 - DNA, 578 bp, Homo sapiens
  misc_feature: GYAE6OF01EA2N1.36.35.D02.1.454.CMB.1.raw
  modified_base (249)..(249): a, c, t, g, unknown or other
  misc_feature (249)..(249): n is a, c, g, or t
  modified_base (421)..(421): a, c, t, g, unknown or other
  misc_feature (421)..(421): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgcaagtccagccggagttgtttanacaactccaaagaataagtagttctttagcttaggtaccagacaacgaaacccacgacacgaccctacctaagctcgtcttcgtttacgcggtccctaccgtaacccgggacgtcccggggtcctagaacgtatcgaggtgggcggtcggtcgtgggacagtacttcactcncacctatcacgcacgtcctggcggctaggaagtagtggtcggtacgtttatacgtgtacagctagttattacttcgttacctctactacgttacgttcggacgtacgggacctaggtcgtaggagtcgcgacgacgtacgtggtacgctgcctaacg

SEQ ID NO: 116813 - DNA, 519 bp, Homo sapiens
  misc_feature: GYAE6OF01DIJM1.36.35.D02.1.454.CMB.1.raw
  modified_base (247)..(247): a, c, t, g, unknown or other
  misc_feature (247)..(247): n is a, c, g, or t
  modified_base (381)..(381): a, c, t, g, unknown or other
  misc_feature (381)..(381): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcaagaaaccacgacagcctctaagctgctcgttactgggcctcgaccgggaatccgggtcctgaacgattcagtcggcggcgggtctgggacaggntttcgactctcaccatcagcagcctgcggctgaagatgtggtcgtttattactgtcagcagtattatgttactctcactagtttcggccgagggacaaggtcgtaggagagtccgacacgtaactgtggctgctaccg

SEQ ID NO: 116814 - DNA, 536 bp, Homo sapiens
  misc_feature: GYAE6OF01A0JXA.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttctttagcttggtaccagcagaaaccagacagcctcctaagctgctcgttactggcctcgtacccgggaatcccgggtcctagacgattcagtggcggcgggtctgggacagattcactctcacatcagcagccctgcggctagaagtatggtggtcggtttatacgtgtcagctagtattatgttactcctctactagtttcggccgtaggggaccaaggccgtaggaggtactccgacacggtaactggtacggtctcggctaacccg

SEQ ID NO: 116815 - DNA, 194 bp, Homo sapiens
  misc_feature: GYAE6OF01DMBCG.36.35.D02.1.454.CMB.1.raw
  modified_base (174)..(194): a, c, t, g, unknown or other
  misc_feature (174)..(194): n is a, c, g, or t
tcagtacgctgtctcacgaccggtgctcgatttagcacacgatagttgggtttgggggaagaggaagactgacggtcccccgaggagttcaggttgctgggcacagcggccctgggctgcctggtcaaggactacttccagacagcgtactgagcgggctggcaaggcgcatgnnnnnnnnnnnnnnnnnnnnn

SEQ ID NO: 116816 - DNA, 541 bp, Homo sapiens
  misc_feature: GYAE6OF01AIT3C.36.35.D02.1.454.CMB.1.raw
  modified_base (241)..(241): a, c, t, g, unknown or other
  misc_feature (241)..(241): n is a, c, g, or t
  modified_base (391)..(391): a, c, t, g, unknown or other
  misc_feature (391)..(391): n is a, c, g, or t
  modified_base (453)..(453): a, c, t, g, unknown or other
  misc_feature (453)..(453): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgttttanacaactccaagaataagagttcttagcttggtaccagcagaaaccacgacagcctcctaagctgctcgttactggcctcgtacccgggaatccggggtcctagacgattcagtggcggcggtctgggacagtattcactctcaccatcancacgcctgcggctagaagagtgtggtcgtttatacgtgtcagctagtattagtgttactctntacgttgttcgaccgacgggacctaaggcgtagggagtagtcggctaacggtaacgtcggtacggcctaggacctaccgtagttcccg

SEQ ID NO: 116817 - DNA, 527 bp, Homo sapiens
  misc_feature: GYAE6OF01A4P7K.36.35.D02.1.454.CMB.1.raw
  modified_base (522)..(522): a, c, t, g, unknown or other
  misc_feature (522)..(522): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaaccacgacagcctcctaagctgctcgtttactgggcctctacccgggaatccggggtccctgaacgatcagtggcggtcggtctgggacagatttcactctcaccatcagcagcctgtgggctgaagatgtggtcggtttattactgtcagcagtattatgttactcctctacgtagtttggccgagggaccaggtccgtaggacgtatcggcacgtacgtgtcggctagcaccgtnttccg

SEQ ID NO: 116818 - DNA, 520 bp, Homo sapiens
  misc_feature: GYAE6OF01D0T5U.36.35.D02.1.454.CMB.1.raw
  modified_base (247)..(247): a, c, t, g, unknown or other
  misc_feature (247)..(247): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctcgtacccgggaatccggggtccctgaacgattcagtggcggcgggtctggggacagatttcactctcaccatcagcagcctgcgggctgagatgtggtcggtttattactgtcagcagttattattgttactcctctactagtttcggccgaggggaccaaggctggagngtcgcacgactgnggctgcacc

SEQ ID NO: 116819 - DNA, 834 bp, Homo sapiens
  misc_feature: GYAE6OF01B8WQY.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggtcttgggtacgagggccggggggtccctggagactctccgtgtgaacgcctctggattctacctttgactaagtgtgccatcgaccgtgggtccgccgacggccgtacccgaaggggaacggggtcgtgggtacggtgggtcctacgtaggtttagttaggtaggtaggtggtaagtacgactaacgagtaacttacggactaacggtaccttccggtagggaaaccggggttcccggtttacgaacccgtacgtcccgttaccgaaggtaaacggtaaacccttaaacgtttaaccccgaaaaccgtaacggacccgtaaaccggtacgtttacggtttaacgttttcggacctaaccgtaagttaaccggaaaaccgtaaccggtacccgttagggaacgggtaaccggacccgggtaacgggaacccgaaaccggggtaccctaaaaggtttaacgtttaaacgttttaaggtttacgggttaaccggtaacccggtttaaaaacccgttttttccccggtttttaaacggtaaccgtttttaacgggtttttaaacctttaaacccgttttaccccccggttaaaggtttccccggtaaaccccggg

SEQ ID NO: 116820 - DNA, 555 bp, Homo sapiens
  misc_feature: GYAE6OF01EXRXR.36.35.D02.1.454.CMB.1.raw
  modified_base (233)..(233): a, c, t, g, unknown or other
  misc_feature (233)..(233): n is a, c, g, or t
tcagtacgctgtctcacgaccggtgctcgatttagcacacgatagttgggtttgggggagagaggagcccagccctgggatttttcaggtgttttcatttggtgatcaggactgaacagagagaactcaccatggagtttgggctgagctggctttttcttgtggctattttaaaaggtctcctgtgaagcctctggattcacctttgacaagtgtgccatgacctgggtccnccaggctccagggaaggggctggagtgggtctcagttattagtggtagtggtagtagcacagattacgcagactccgtgaagggccggttcaccatctccagagacaattcccaacagcacgctgtatttgcacatgaacagcctgagagccgaggacacggccatatattattgtgacgtaacttcctttgacttggtttattactcccctagtcgaccacgtcggggccagggaccctggtccacctctcctcagcctccaccacggcccatccggtccttccccctggcccacccctccctaccaacgtcgcctacccg

SEQ ID NO: 116821 - DNA, 589 bp, Homo sapiens
  misc_feature: GYAE6OF01CNHOW.36.35.D02.1.454.CMB.1.raw
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (183)..(184): a, c, t, g, unknown or other
  misc_feature (183)..(184): n is a, c, g, or t
  modified_base (186)..(186): a, c, t, g, unknown or other
  misc_feature (186)..(186): n is a, c, g, or t
  modified_base (189)..(190): a, c, t, g, unknown or other
  misc_feature (189)..(190): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcggcgtgttctaggtcgcattaagntcngnngngtnngcngntgntnggagctgangcggggtctganctcnctgtgagcctgtgatcaccttgataagtgtgccatcgccgttgggccgcgnggcnccgagggagggtntggaggtggtctgagttaataggtggtgtggggttaacgtagacagtagtacgtacgacgacgtcgtcggtaggtacggtcccgttacaaccgtacgtccgaaccgagtaacaactaacgtaccaacgacgacgtacgtacgtacgttacgttactactactagtacgaacgacgtacgtacggacgtacgacggacgaccgacgtacgtactattagttacgttcgtagttacgttaaccgtttacgtttacgttacgttacgttaacgttaccgttacccgtccgtacgtaccg

SEQ ID NO: 116822 - DNA, 534 bp, Homo sapiens
  misc_feature: GYAE6OF01B3BTJ.36.35.D02.1.454.CMB.1.raw
  modified_base (248)..(248): a, c, t, g, unknown or other
  misc_feature (248)..(248): n is a, c, g, or t
  modified_base (359)..(359): a, c, t, g, unknown or other
  misc_feature (359)..(359): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctctgggcgagagggccacgatcaactgcaagtccagccggagtgttttanacaactccaagaataagagttctttagcttggtaccagcaagaaaccacgacagcctcctaagctgcctcgtttactgggcctcgtacccgggaatccgggtcctgaacgnttcagtggcggcgggtctgggacagtatttcactctcaccatcagcagccctgcggctgaagatggtggtcggtttattacgtgtcagctagtattatcgttactcctctacgtagtttcggccgacgggacctaagtcgtgggagcgtcgacacgtaactcgtagctgctaccg

SEQ ID NO: 116823 - DNA, 737 bp, Homo sapiens
  misc_feature: GYAE6OF01BDCUD.36.35.D02.1.454.CMB.1.raw
  modified_base (253)..(253): a, c, t, g, unknown or other
  misc_feature (253)..(253): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatgacccagtctccagactccctggctgtgtctcgtgggcgaggacgggccacgatcaactgacaagtccagccggagttgttttanacaactcaagaataagtagttcttagcttggtaccagacaagaaaccacgacacgcctactaagctagtccttcgtttacgcgggtccctacgtacccgggaacgtcccggggtcctagaacgtacttcgacggtcgggcggtcgggtcgtacggggactaggttactttaccgacttccgtacaaccgtacgttaccgaacgtaccgaacggtcccgtacgggtccgggtaccgttaaggaaacggtaacggttcgggttacgggtttaccgggtttttaacttaccggtttaggtacccgtaggtaaccgttaagtttaacgtttaacgtttaccggtttaacccttacccgttacgtaaccggtttaacgggttttccgggaaccggtaacggggtaacccgtaagggtcggttagggaacgtacgtacccggtaccgtaacggtaaccgttacgggtacggtaccgtcggaccgtaaccg

SEQ ID NO: 116824 - DNA, 574 bp, Homo sapiens
  misc_feature: GYAE6OF01CKDMN.36.35.D02.1.454.CMB.1.raw
  modified_base (329)..(329): a, c, t, g, unknown or other
  misc_feature (329)..(329): n is a, c, g, or t
  modified_base (358)..(358): a, c, t, g, unknown or other
  misc_feature (358)..(358): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggtctttttcttgtggcttaattttaaaaggtctcctgtgaagcctctggattcacctttgacaagtgtgccatgacctgggtccgcaggctccgaggggaggggctggagtgggtctcgagttattagtagtagtagtagttacatatactagcagactcagtgaaggccatcacatcncagagacaacgcaagactcaactgtatcngacaaatcgaaacagcctaggaacgacgaccggaaggtaccacggctggtagtattactggtggcgggtaatgacgtattagtttgacttggtttacttctaactacttactaactactagtcgacgttcgacgggaccaacgggccgtcggtccgaccgtctcctacacgccctaccaccgacggtcccacgtcccggtcctccccgtgtacccc

SEQ ID NO: 116825 - DNA, 559 bp, Homo sapiens
  misc_feature: GYAE6OF01EVXEE.36.35.D02.1.454.CMB.1.raw
  modified_base (246)..(246): a, c, t, g, unknown or other
  misc_feature (246)..(246): n is a, c, g, or t
  modified_base (332)..(332): a, c, t, g, unknown or other
  misc_feature (332)..(332): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagctccctggctgtgtctctggggcgagagggccacgatcaactgcaagtccagccggagtgtttanacaactcaagaataagagttctttagcttggtaccagtcaagtaaaccacgacacggccctcctaaagcctagccttacgtttacnggggtcctcgtacccgggaatcccggggtcctgaacgattcgaggtcggcgggtcgggtctggggacaggtactttcacgtctacacctatcagcacgcctgcggactgaagagtgtggtcgtttatactgtcagcgtagtattatgttactctcgacttaggtttcgccgtagggacctaaggtcgtaggacagtcgacaacggtacgtggtaggcttgcctaacg

SEQ ID NO: 116826 - DNA, 534 bp, Homo sapiens
  misc_feature: GYAE6OF01CUOFA.36.35.D02.1.454.CMB.1.raw
  modified_base (247)..(247): a, c, t, g, unknown or other
  misc_feature (247)..(247): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcaagaaaccacgacagcctcctaagctgctcgtttactgggcctcgtacccgggaatccggggtcctagaacgattcgagtggcggcgggtctgggactagtatttcactctcaccatcagcacgcgtggcggctgaagagtgtggtcgtttattacgtgtcgagctagttattatcgttactcctctacgtagtttggacgacgggaccagtcgtggagacgtcgacgacgtaactgtggctgctaccg

SEQ ID NO: 116827 - DNA, 601 bp, Homo sapiens
  misc_feature: GYAE6OF01C1RPJ.36.35.D02.1.454.CMB.1.raw
  modified_base (247)..(247): a, c, t, g, unknown or other
  misc_feature (247)..(247): n is a, c, g, or t
  modified_base (337)..(337): a, c, t, g, unknown or other
  misc_feature (337)..(337): n is a, c, g, or t
  modified_base (563)..(563): a, c, t, g, unknown or other
  misc_feature (563)..(563): n is a, c, g, or t
  modified_base (571)..(571): a, c, t, g, unknown or other
  misc_feature (571)..(571): n is a, c, g, or t
  modified_base (598)..(598): a, c, t, g, unknown or other
  misc_feature (598)..(598): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacgggacatcgtgatgacccagtctccagactccctggctgtgtctcgtgggcgagacgggccacgatcaactgacaagtccaggccggtattgttttaanacaactaccaaagaataagtagttctttagcttaggtaaccagacaagaaaccagacacgcctaccgtaagctcgtccttacggtttacncgggcccttaccggtaacccgggaacgttcccggggtaccctaggaaaccgtacttcgagggttcgggcggtcgggtcgtagggactagtactttccactccgtacacatcgacgcacgccgtggcggtactaggaagtatgggtcggttacgtttatacgtgtacagtctaagttattacgtcgttaacctccgtatacgttggttcggacgtacgggacaggtntaggaatnacgctacgagtgtcgctagcctacgtntcg

SEQ ID NO: 116828 - DNA, 562 bp, Homo sapiens
  misc_feature: GYAE6OF01BV0YU.36.35.D02.1.454.CMB.1.raw
  modified_base (247)..(247): a, c, t, g, unknown or other
  misc_feature (247)..(247): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctcctaagctgctcgtttactcgggcctcgtaccccgggaatcccggggtcctgaacgattcgaggtggcggcgggtctcggggacagtatttccacgttctccaccactcagcacgccgtggcgggctaggaagagtgtgggtcggttttagttactgtcagctagttattagttcgttacctcctactactaggtttcggaccgtaggggtacccaaggtcgtaggacgctcgcgacgtaactcggtaggctcgctaccg

SEQ ID NO: 116829 - DNA, 543 bp, Homo sapiens
  misc_feature: GYAE6OF01AS8AC.36.35.D02.1.454.CMB.1.raw
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccagatcaactgcaagtccagccggagtgttttanacaactccaagaataagagttcttagcttggtaccagcagaaaccncgacagcctcctaagctgcttcgtttactcgggcctacgtacccggggtaatcccggggtccctagaacgtattcgaggtgggcggcgggtctgggacagtactttcactctcaccatcagcacgccgtgcgggctaggaacgtagtggtggtcggtttattactgtcagctagtattatgttactctcactcgtttggcgtagggaccaaggcgtaggagtcacgacacgtaactggtagctgctaaccg

SEQ ID NO: 116830 - DNA, 802 bp, Homo sapiens
  misc_feature: GYAE6OF01CJ4H6.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtcgccgtacggggacatcgtgatcgacccagtcctccacgacctccctggctgtgtctcgtgggcgaggacggccaacgataccaactcgacaacgtccgacggaccgggtagttacgttttaacaaccaactaccaaaagtaataagtagttacttagcgttaggaccagacaaacgaaaccacgacacgcctacgtaagctgtccttacgttacgtcgggtccctaccggtaaccgggtacgtcccggggtacctacggtaacgtacgttcgacggttcgggccgggtcgggtacgtaggggtactagttactttaccgaccttccgacaccgtactaccgacgccgacggtacccggttacgggcgggtaccttaagggaacggttacggtttacgggttacgggttaaccgggtttttaacgttaaccggttacggttaccgtacggttaaaccgttaaggttttaacgtttaccgtttaaccggttttaacccttcccgtttaacggttacccgttaacggggttttacccggaaccgggtaaaccggggtaacccgtaacgggtccgggtaagggtaacgtacccggttaccggaaccggttaaccgggtaaccgtttagggtaccgtacccggttagcccgttaaaccg

SEQ ID NO: 116831 - DNA, 634 bp, Homo sapiens
  misc_feature: GYAE6OF01C7PUD.36.35.D02.1.454.CMB.1.raw
  modified_base (259)..(259): a, c, t, g, unknown or other
  misc_feature (259)..(259): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccaacgtatccgaactgacaacgtccaggccggtagttcgttttanaactaactccgaaagaataagtgttctttaagctttaggtaccagcaacgaaaccacgacagcctacgtaagctgtcttcgtttacgcgggacctcggtaaccccgggagtcccggggtacctaggtaacgtattcgaggtcgggtcggcgggtctagggactagtactttcgactctacaactatcgagcacgtccgtggcggactaggaagtgttcggtggttacgtttaacttacgtcgtacgagtactaagttagtttacgttacgttaacctcctacgtacgttaggtttacggacggtaacgggacgaacggtcgtagggtacgacgtaccggacaaacggtaacgttacgtggtcctggccctaaccg

SEQ ID NO: 116832 - DNA, 644 bp, Homo sapiens
  misc_feature: GYAE6OF01B9HKK.36.35.D02.1.454.CMB.1.raw
  modified_base (262)..(262): a, c, t, g, unknown or other
  misc_feature (262)..(262): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatcgacccagtctccagactccctggctgtgtctcgtggggcgaggacgggccaacggatacaaactgacgaaagccagccggtagttgttttaanaacaactaccaaagaataagagttcttagcttaggacagcaagaaaccagacagcctacctaagctgtctcgttacgcgggtcctacgtaacccgggaacgtcccggggtaccctagaaacctgttcgaggtcgggcgggtcgggtctaggggaacctagtactttaccacgttcctacaccatacagcgagcccgtggcgggactaggaagtgtggtacggtacggtttatacgtgtaccgagactaagttattaacgttcgttaccgtcctacgtacgttacggtttacgggaccggtaaacggggtaaccaacgggcgttaagggaatacggtaccgaacgtaacgtaacgtacggtaggaccgttcgaccgtaacccg

SEQ ID NO: 116833 - DNA, 521 bp, Homo sapiens
  misc_feature: GYAE6OF01AZ6BW.36.35.D02.1.454.CMB.1.raw
  modified_base (242)..(242): a, c, t, g, unknown or other
  misc_feature (242)..(242): n is a, c, g, or t
  modified_base (517)..(517): a, c, t, g, unknown or other
  misc_feature (517)..(517): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctacccgggaatccggggtccctgaacgattcagtggcggcgggtctgggacagatttcactctcaccatcagcagcctgcgggctgaagatgtggtcggtttattactgtcagcagtattatgttactcctcactagttttcggccgtaggggaccaagcgtggacgtatcgcacgaactggtggctgcaccnttcg

SEQ ID NO: 116834 - DNA, 503 bp, Homo sapiens
  misc_feature: GYAE6OF01EGG9J.36.35.D02.1.454.CMB.1.raw
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
  modified_base (344)..(344): a, c, t, g, unknown or other
  misc_feature (344)..(344): n is a, c, g, or t
  modified_base (404)..(404): a, c, t, g, unknown or other
  misc_feature (404)..(404): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttacngggctctaccggatccgggtcctgaacgnttcagtcgcggcggtctgggacagatttcactctcaccatcagcagcctgtggctgaagntgtggcgtttatactgtcagctagtattatgttactcctctacgtagtttggccagggacctagcgttggagtatcgcacgactgtgctgcnccgntcg

SEQ ID NO: 116835 - DNA, 597 bp, Homo sapiens
  misc_feature: GYAE6OF01BT147.36.35.D02.1.454.CMB.1.raw
  modified_base (357)..(357): a, c, t, g, unknown or other
  misc_feature (357)..(357): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggctttttcttgtggctattttaaaaggtctcctgtgaagcctctggattcacctttgacaagtgtgccatgacctgggtccgccaggctccgagggaaggggctggagtgggtctcgagttattagtggtagtggtagtagcacagattacgcagacctccgtggaacgggtccggttcaccatcctccagacgacaattccaaacngcacgctgtatttgcacatgaacagcctagacgacgccgaggacacggccaatatattatgtagacgtaactttcctttagtacttaggttattactccctagtacgtaccacgtcgggaccgacgggaaccctggtacctacccgtctccctcacgtccctaccgaaccgacgggccctagttcccggtcccttcccccgtcgccctacccctccctacccgaacgccgccgtacccgg

SEQ ID NO: 116836 - DNA, 534 bp, Homo sapiens
  misc_feature: GYAE6OF01BQJWA.36.35.D02.1.454.CMB.1.raw
  modified_base (247)..(247): a, c, t, g, unknown or other
  misc_feature (247)..(247): n is a, c, g, or t
  modified_base (326)..(326): a, c, t, g, unknown or other
  misc_feature (326)..(326): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacgggacatcgtgatgacccagtctccagactccctggctgtgtctcgtgggcgagagggccacgatcaactgcaagtccagccggtagtgtttanacaacttccaaagaataagagttctttagctttggtaccagtcaagaaaccacgacagcctcctaagctgctcgttacnggcctctaccggatccgggcctgaacgntcgagtggcggcggtntgggacngatttcactctacaccatcagcagctggcggctgagtagtgtgtcgttatcgtgtcgagctagttatacgtagttactctacgtacgtagttttcggaccgtaggggaccaggtctaggacggtaacgcggcaacggtatcgtaggctgcgtaaccg

SEQ ID NO: 116837 - DNA, 173 bp, Homo sapiens
  misc_feature: GYAE6OF01A6ZJF.36.35.D02.1.454.CMB.1.raw
  modified_base (173)..(173): a, c, t, g, unknown or other
  misc_feature (173)..(173): n is a, c, g, or t
tcagtacgctgtctcacgaccggtgctcgatttagcacacgatagttgggtttgggggaagaggaagactgacggtcccccaggagttcaggtgctgggcacagcggccctgggctgcctggtcaaggactacttccagacagcgtactgagcgggctggcaaggcgcatagn

SEQ ID NO: 116838 - DNA, 546 bp, Homo sapiens
  misc_feature: GYAE6OF01B9MYN.36.35.D02.1.454.CMB.1.raw
  modified_base (247)..(247): a, c, t, g, unknown or other
  misc_feature (247)..(247): n is a, c, g, or t
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
  modified_base (524)..(524): a, c, t, g, unknown or other
  misc_feature (524)..(524): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcaagaaacccacgacacgcctcctaagctagctcgtttactgggccctcgtacccgggaacgttcccggggtaccctggaaacgtnttcgaggtcggcggcgggtctggggactagatttcactctcaccatcagcagcctgcggctgaagngtgtggtcggtttattactgtcagctagtattagtgttactcctctactaggtttcggaccgacgggaaccgaggcgtaggacgacncgacacgtactgagctcgctac

SEQ ID NO: 116839 - DNA, 764 bp, Homo sapiens
  misc_feature: GYAE6OF01DLCE0.36.35.D02.1.454.CMB.1.raw
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
tcagtacgctgtctcacgaccggtgctcgatttagcacacgatagttgggtttgggggagagaggagcccagccctgggatttttcaggttgttttcatttggtgatcaggactgaacagagagaactcaccatggagtttgggctgagcgtgtgtttctaggcggctaatttaaaggtctctgtgagcctgtgattcactttgacaagtgtgccatgaccgtggccgccaggcttccgagggaggggctggagtgggtctnaggttattagnggtagtgtaagtgccagatatacganagtcgtcgagacggtccgtacacctgtcctacgagaanaactaactaccgaacacgtaccacgtacttagttacgtttcgtactaactaacgtaacgtaacgaacgtaccgtacggaacggaacggaccggaaccggaaccgaaccgaccgtaacgttaacgttaagtttaagttacgttaacgttaaccgttaaaccgttttaaccgttttacgttaacgtttaaccgtttaacgtttaacccgttaacccgttaacgtaaccgtaaccgtaaccggtaccgggtacccggtaaccggtaacccggttaccgtacccgtacccgtacccgtaccgtaccgtacccgtacccgtaccccgtaacccgaacccggtacccgtaccgttacccgttccccgttacccccgtaccccgtaccccgtaccccgttacccctaaccgtaaccgaccgtacccgtacccgg

SEQ ID NO: 116840 - DNA, 745 bp, Homo sapiens
  misc_feature: GYAE6OF01D1LLR.36.35.D02.1.454.CMB.1.raw
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggtctttttcttgtggcttaattttaaaaggtctcctgtgaagcctctggattcacctttgacaagtgtcgccatcgaccgtggggtcccgccgaggcctaccgaagggggaacggggctgggaggtgggtctcgtagttattaggtggtagtggtagtagcacagattacgcagactccggtggaacgggtccggttacaccatcctaccagagacaacttccaacagcaacgctagttactttgacacatacgaacgagcctagagacgaccggacggacgaccggacctaattattaacttttagttacggttacgtaaccgttaaaccttttccgttttaggtaaccgtttagggtttaacttttaccgttaccccgttaagttaccgtaacccgtacggtccgggggacccgtaaccggggtaaccccgttacgggttaccctacccggttcccgttcccgtaccgtacccggtaccccttaccccgaacccggtaaacccgggtcccctacggttccccggttaccccgttccccccgtacggcccccctaccccgtcccctaaccgaaccgtccgacccgtaccccggg

SEQ ID NO: 116841 - DNA, 863 bp, Homo sapiens
  misc_feature: GYAE6OF01CXWS2.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggtcttaattttaaaaggtgtcctagtgtgaggtgcagctgcgtggagtcgtggggagtcgttggtacgacgggcccggggggtcctggacgtacctctccgtggtacgaacgtcctcgtggtacttcctaccgtttagaactaagtgtcgccatcggtaccgtcgggtcccgccgtacgggcctaccggaaggggacgggtcgtgggtaggtcgggtctacgtagtttagttaggtaggtaggtaggtagtagacgacgaagtacttacgacgtacgtacccgttacgggtaaggtaaccgggggtcccgttaaccgaacccgttacgttacccgtaccgtaaacgggtaaactaaacccgtttaaaccgttaaccccgaaaaccgtacggtaaccccgtaacggttacccgttttaaggtttaacgttttaccgaacccgtaaacgttaacgttaaaccggaaacccgtaccggtaccccggtaagggaacccggaaccgggacccggtaaacggggaaccccgtaacccgggtaaccttaaacgttaaacgtttaaaccgtttaacgggttacggttaccgttaaacccggttttaaacccgtttttacccgttttaggttaacccggttttacggttttaaaccctttaacccgttaacccccggttaagggtaccccgtaaaccccggg

SEQ ID NO: 116842 - DNA, 792 bp, Homo sapiens
  misc_feature: GYAE6OF01EBSZ8.36.35.D02.1.454.CMB.1.raw
  modified_base (193)..(193): a, c, t, g, unknown or other
  misc_feature (193)..(193): n is a, c, g, or t
  modified_base (293)..(293): a, c, t, g, unknown or other
  misc_feature (293)..(293): n is a, c, g, or t
  modified_base (408)..(408): a, c, t, g, unknown or other
  misc_feature (408)..(408): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagcgtgtcgtttctaggtcggctaatttaaaggtctcctgtgagcctntgattcaccttgactagtgtgccatcgacctggtccgacaggcttccgagggagggctgggagtggtctcgtagttagtaggtggtagtgtacgtagcanagtatcgacagtacgtccggtaggaacgggtccgttacaccgtactcctccaagacgaactaacttccaacacggcaaccgtcttaggttacttacgccactaaggtacgaaacncgtacctaggaagacgaccgaggtaccgcggacctaagtacttattacgttgtacgtaacgttaaacttttccgtttagtacgtttacgttaactttaccgtccccgttaagtacgtaacctacgggttacggggtaccgtaacccggggttaacccgttacgggttacccgtaccccggttacccttaccccgtacgtaccccggtaccccggttacccccggaaacccggtaaccccggggtacccccgttaaaccgggttttaccccccgggttcccccgtttaccccccccgggtaccgggtacccccccggttaacccccccttacccgttaaaccccccggaaacggtcccccggtaaccccgttaacccccccgggg

SEQ ID NO: 116843 - DNA, 802 bp, Homo sapiens
  misc_feature: GYAE6OF01CYK2G.36.35.D02.1.454.CMB.1.raw
  modified_base (165)..(165): a, c, t, g, unknown or other
  misc_feature (165)..(165): n is a, c, g, or t
  modified_base (173)..(173): a, c, t, g, unknown or other
  misc_feature (173)..(173): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (199)..(200): a, c, t, g, unknown or other
  misc_feature (199)..(200): n is a, c, g, or t
  modified_base (209)..(209): a, c, t, g, unknown or other
  misc_feature (209)..(209): n is a, c, g, or t
tcagtacgctgtctcacgaccggtgctcgatttagcacacgatagttgggtttggggagctctgagagaggagcccagccctgggtatttttcaggttgttttcattttggtgatcaggactgaacagagagaactcaccagtggtagtttgggctgagcgtgtntttcgtgngactatttaagngcngtgtgagtncnnctgcgtggngtcggtggggagtcgttaggtacgacggggcccggggggtccctggacgtaccttcgtccgtgtacgacgtccttacgtggtacttaccttaccgttagaacgtagttgtcgacctaggtccgtaccggtcggtccccgacgacgtaccggtaccggaagggggacggggtcgtagggtacggttcgggtacctaggtaaggtttagttagggttaggttaggttacgggttaacggtacgacctaacggtagttaacgttacgaccgtaacggtaccgttaccgggtaacgggaaccgggttcccgttaacgaccctaccgtaccgtacccgaagtaaccgtaaaccctaacgttaccgaaaccgtcggtacccaacgttaccgttagttaccttttaccgacctaactacgtaacgtaacgtacgtacccgtaggaacggtaccggacccggaacggacccgtaacggtaaccttaagttacgtttacgtttaagtttcggtaacgtttaacccgtttaacgttttacccgttttacgttaacgttttacgtttaacctttacccgttaccgtacggttccgtaacccggg

SEQ ID NO: 116844 - DNA, 846 bp, Homo sapiens
  misc_feature: GYAE6OF01DTTCR.36.35.D02.1.454.CMB.1.raw
  modified_base (245)..(245): a, c, t, g, unknown or other
  misc_feature (245)..(245): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgaggacgggccacgatcaactgcaagtccagccggagttgtttaanacaactaccaaagaataagagttctttagctttaggtaaccagaccaagaaaaccacgacacgccctactaaagctagtccttcggtttacgcgggtcctacgtaaccccggggaacgttcccggggtaccctagaaaccgtactttcgacgggtcgggccgggcggggttacgtaggggaacctaggtacttttaccgaaccttcctaccaaccctaattaccgaacggtaccgaaccgtcccgtacgggtacccgggtaccgtaacggtaaacgtaacggttagggtttacggggtttaccgggtttttaaacgtttaaccggtttacggttaaccgtaacggttaaccgttaaggtttaaacgttttaacgtttaaccggttttaacccgtttacccgtttaacccgttaaaccgttaaccgggttttttaccggggtaaccccgggttaaaccggggggtaaacccgtaaaaccgggtaccggttaacgggtaaacggttaaccggttaccggtaacccggaaaaccggtaaaccggttacgggtaccgggttaacccgttaccggtaaaccccgtaacccgttaacgtttacccgg

SEQ ID NO: 116845 - DNA, 681 bp, Homo sapiens
  misc_feature: GYAE6OF01BE9XV.36.35.D02.1.454.CMB.1.raw
  modified_base (245)..(245): a, c, t, g, unknown or other
  misc_feature (245)..(245): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggagttgttttanacaacgtaccaagtaataagtagttctttagctttacggtaaccagacacgaaaccacgacacgtcctcctaagtctgtccttcgtttacgtcgggccctaccgtaacccgggtaacgttcccggggtacccttaggaaccgtatttcgaagggtcggccggtcggggtcgtggggaactagtacttttcgaaccttccacaccctatcgacgcgacgccgtggcccgggatacggaaaggtgttcgggttacggtacggtttttactacgttcgtacgacgtacgttaaggttaactttagttcggtttaacctcccgttactacggtttacgggtttacggaccgggtaacggggtaacctaacggtcggtaacggtagtacgtaccgtacgaacggtaacgtcgggttcggactacgacctaactcgttaccg

SEQ ID NO: 116846 - DNA, 562 bp, Homo sapiens
  misc_feature: GYAE6OF01EO5EH.36.35.D02.1.454.CMB.1.raw
  modified_base (246)..(246): a, c, t, g, unknown or other
  misc_feature (246)..(246): n is a, c, g, or t
  modified_base (428)..(428): a, c, t, g, unknown or other
  misc_feature (428)..(428): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaaagaataagagttctttagcttggtaccagcaagaaaccacgacagcctcctaagctgctcgtttactgggcctcgtacccgggaatcccggggtcctagaacgtatcaggtcgggcggcgggtctgggacagtattccactctcaccatcagcacgtctggcggctagaagngtgtggtacgtttattacgtgtcgagtctagttattattcgtttaccttcctactacgttcgtttcggaccggtacgggtaccgaacgtcgtaggacgtagtccgacgacgtaacgtggtagcgtcgcgtaccg

SEQ ID NO: 116847 - DNA, 580 bp, Homo sapiens
  misc_feature: GYAE6OF01CXL3U.36.35.D02.1.454.CMB.1.raw
  modified_base (378)..(378): a, c, t, g, unknown or other
  misc_feature (378)..(378): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggctttttctgtggctattttaaaaggtctcctgtgaagcctctggattcacctttgacaagtgtgccatgacctgggtccgccaggctccgaggggaaggggctgggagtgggtctcagttattagtggtagtggtagtagcacagattacgcagactccggtgaacggggccgttacaccgatctccagagacaacttccaacagcacgctgtattgcacatcgaangcctgacgagccgaggacacggccatatatattgtgacgtaaacttctttgacttgttattactccctagtcgtaccacgtcgggaccgacgggaaccctggtccaccgtcctcctccacgccctaccacccgaacgggcccacgttccggtcccttcccccgtggtccccacccctccctaccaacgtccgccgtacccgg

SEQ ID NO: 116848 - DNA, 835 bp, Homo sapiens
  misc_feature: GYAE6OF01CMSLW.36.35.D02.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (338)..(338): a, c, t, g, unknown or other
  misc_feature (338)..(338): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagacctccctggctgtntctcgtgggcgagagggccacgatcaactgacaagtccaggccggagtgttttanaacaacctaccaaagaataagtagtttctttagcttggtaccagacaagaaaccacgacacgcctacctaagctcgcttcgtttacncgggccctcgtacccgggaagtcccggggtaccctagaacgtacttcgaggtcgggcgggtccgggtcgtacggggactacggtacttttccgaacctttcccgtaccaaccctaacgttaccgaacggtacccgtaaccgggtccccggttacgggacccggggtaccgttaacgggaaacggttacgggtttacggggtttacggggtttaacccggggtttttttaacgtttaaccggtttacgggttaccgtaacggttaaccgttaaaggtttaacgttttaaacgtttaccggtttttaacccttccccgttaaccgttaaccgttttacgggtttttacccggggaacccgggttaaaccgggggtaaaccccgttaaacgggtcccggttaaggggtaaccggttaaccggtaacccgggtaacccgtaaacccgggttaaccggttacggggttaccgggtccgttaccggaacccgttaaaccccgg

SEQ ID NO: 116849 - DNA, 688 bp, Homo sapiens
  misc_feature: GYAE6OF01CD3CI.36.35.D02.1.454.CMB.1.raw
  modified_base (254)..(254): a, c, t, g, unknown or other
  misc_feature (254)..(254): n is a, c, g, or t
  modified_base (683)..(683): a, c, t, g, unknown or other
  misc_feature (683)..(683): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtgggcgaggacgggccacgatcaaactgacaagtcccaggccggtagttgtttaanaccaactacaaagtaaataagtagttcttagcttacggtaccagacaagaaacccacgacacgccctactaacgctcgtcttacgtttacgtccgggtaccctacggtaccccgggtaacgtccccggggttaccctaggtaaccgtgttaccgaggtcgggacgggtcgggtcgtgggaactagtacgtttccaacttcgtaccacgtatcgacgacgtacgccgtggaccgggtacgtacggtaaaggtacgttcgggttacgggttacggttttaactacgttcgtacgacgtacgtagttattacgttcgttaaccttccgtaacgtactttaacggtttcggaaccggacgggtaacctaaggtcgtaggacgtacgtaccggacgtacggtaagttcggtacggtacgtagacccgtaccgtnttccg

SEQ ID NO: 116850 - DNA, 531 bp, Homo sapiens
  misc_feature: GYAE6OF01CUCMN.36.35.D02.1.454.CMB.1.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
  modified_base (346)..(346): a, c, t, g, unknown or other
  misc_feature (346)..(346): n is a, c, g, or t
  modified_base (495)..(495): a, c, t, g, unknown or other
  misc_feature (495)..(495): n is a, c, g, or t
  modified_base (526)..(526): a, c, t, g, unknown or other
  misc_feature (526)..(526): n is a, c, g, or t
tcagtacgctgtctcacgaccggtgctcgatttagcacacgatagttgggtttggggacaacaggcaggcaggggcagcaagatggtgtcgcagacccaggtcttcatttctctgttgctctggatctctgttactacaggtgcctacggggacatcgtgatgacccagtctccagactccctggctgtgtctctgggcgagagggccagatcaactgcaagtccagccggatgtttanacaactccaagaataagagttctttagcttggtaccagcaagaaaccacgacagcctctaagctgctcgtttacngggcctcgtacccggatccgggtcctgaacgnttcagtggcggcggtctgggacagtatttcgactctcaccatcagcagcctgtggctagaagtatggtggtcgtttatacgtgtcagtctagttattattcgttactcctactacgttggtttcgaccgtagggaccaaggtctagganagtcgacacgtaacgtgtcggcttagcctcngttcg

SEQ ID NO: 116851 - DNA, 574 bp, Homo sapiens
  misc_feature: GYAE6OF01DDD19.36.35.D02.1.454.CMB.1.raw
  modified_base (247)..(247): a, c, t, g, unknown or other
  misc_feature (247)..(247): n is a, c, g, or t
  modified_base (362)..(362): a, c, t, g, unknown or other
  misc_feature (362)..(362): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactccaaagaataagagttctttagctttggtaccagcaacgaaaccacgacagcctacctaagctgtctcgtttactgggcctcgtacccgggaatccgggcctgaacgtnttcgaggtcggcggcgggtctggggacaggtactttcactctaccaccatcagcacgccgtggcggctgaagtgtggttggtacggttttacttacgttgtcagcgtagttattattcgttacctcctacgtacgttaggtttcggaccgtacggggtaccaaggtcgtaggagtacgtaccgacgaaccgtacgtgtacggctgcgtaacc

SEQ ID NO: 116852 - DNA, 571 bp, Homo sapiens
  misc_feature: GYAE6OF01A5USD.36.35.D02.1.454.CMB.1.raw
  modified_base (249)..(249): a, c, t, g, unknown or other
  misc_feature (249)..(249): n is a, c, g, or t
  modified_base (331)..(331): a, c, t, g, unknown or other
  misc_feature (331)..(331): n is a, c, g, or t
  modified_base (396)..(396): a, c, t, g, unknown or other
  misc_feature (396)..(396): n is a, c, g, or t
  modified_base (428)..(428): a, c, t, g, unknown or other
  misc_feature (428)..(428): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggagtgttttanaccactaccaagaatagagttcttagcttggtaccagtcaacgaaaccacgacagccctacctaagctagcttacgtttacngggccctcgtaccgggaagtcccgggtcctagacgtattcgaggtggccgggtggtctggggacngtatttcacgtcacacatcagcagcgtgcggntagagtagtgtcggtacgtttatacgtgtcacgacgtattagttagttacgttacctcgtcctagttacggtttcggacgtacgggaaccgtacgcgtaggaacgcgtaccgacacgtaacgtggtacggtcgtgccgtaacg

SEQ ID NO: 116853 - DNA, 663 bp, Homo sapiens
  misc_feature: GYAE6OF01DFXL8.36.35.D02.1.454.CMB.1.raw
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatgggagtttgggctgagcggtgtggttctaggcgctattaaagncntgngngtgcagctgctgagtntgggagcttgcngcggggtcctgagctcnctgnganccngtgntcnccttgacngttgcgaacctgtcgtaccgtggggtaaccccgccgtacggtcgtcggaggggtacggcgtggtaggtcggtacgtcgtaagtttacgtgtaggtaggtggtaagtacgacgtacgtaacggggtacgtacgtacgtacgtacggtaccggtacggtacggtaccggtaccgtaccgtaccgtaccgtaccgtacgtacgtaacgtaaccgtaaccgtaacgacgtaccgaccgtacgttacgtagttacgtacgtactacgtacgtaaccgtacgtacgtacgtacgacgacgacgtaccgaccgtacgtacgttacgttacgttacgttacgttacgtaccgttaccgtttaccgttacgttacgttacgtttaccgttaccttaccgttaccgtacgtaccg

SEQ ID NO: 116854 - DNA, 666 bp, Homo sapiens
  misc_feature: GYAE6OF01BTJ9S.36.35.D02.1.454.CMB.1.raw
  modified_base (336)..(336): a, c, t, g, unknown or other
  misc_feature (336)..(336): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctggagtcgtgggggagcttggtacaggcccgggggggtccctggacgcctctccgtgtagacgcctgtggtacttcctaccgtttgacaagtgtcgcctagtcgaccgtcgggtcccgcgacggtccnccggaagggggaacggggtcgtagggaggttcgggtctacgtaagtttagttaggtggttaggtggtaagtaggctaagacgtataccgacacgtacctcggtaggaacgggtccgttaccacctatccgtaccgaggaacgaactaacgttacccaaacacgaccacgtcttagttatttcgacaactagtacgaacacgcgtagacgacgaccggaacggacgaccgggacctaattagttaagtttacgtggtacgtaccgttaaaccgttttccgtttagaccgtttaggtttacttaacccttccccgtaagtcccgtaacccgg

SEQ ID NO: 116855 - DNA, 699 bp, Homo sapiens
  misc_feature: GYAE6OF01DDTJD.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttctgtggctgttttaaaaggtgtccagtgtgaggtgcgaggtgtcggaatcgtgggggaggcttggttcagccgtgggggtccctgagctctcctgtgcagtctctggattaattctttagtgactatgcatgtatcgtgggtccgccgtaggccgtaccgagggggaacgggcgtagggtaggtcggggtactcgacgacttaaagtttaaagtggggttaagggggtagtaacgtttccaaacccgtacgtaacgtttaccgggcgggtaaccgttcccggggttcgggggggtacccggtttccaacccgtacgtacccgaaccgaacgaacgaaacctaacctaccggaagggaaccgaccgaacgtaccttaacgtaagtacctacggaactaaacgttcgacaaccgacgtacccgtaggtaagacggtacgaacggaccgacggtaccgtaggttacttagttggtacggacggaggtacgtaacctcccgaaacgggtccaaaccgattaacggttggttcgttttacg

SEQ ID NO: 116856 - DNA, 706 bp, Homo sapiens
  misc_feature: GYAE6OF01CCZQR.36.35.D02.1.454.CMB.1.raw
  modified_base (323)..(323): a, c, t, g, unknown or other
  misc_feature (323)..(323): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgctggagtcgtgggggaggctttggacaggcccggggggtccctggagactctcctgtgaacgtcctcgtggtatttccaccttttgactaagtgtgccatgacccgtgggtcccgcnggcctccgaggggaacgggctgggagttcgggtctcgtagtttagttaggtgggttagttgggtaagtacgcgaacgagtaacgttacgctagacctccggtggaaacggggtcccgttacaccctatccgtcgaagacgaactaaattcccaaactacgccaacggtcttacgttatttgctaactactagaaccgacgccgtcggaagacggacccggaaggtacccaccgggtacctaagttaaacttaacgtttaagttacgggttagtaaacccggttaaacccgttttttacccggtttttacggttaaccgttttaacgggttttaactttaaaccccgtttacccccgtttaacggttccggtaaaacccccggg

SEQ ID NO: 116857 - DNA, 787 bp, Homo sapiens
  misc_feature: GYAE6OF01CCBNT.36.35.D02.1.454.CMB.1.raw
  modified_base (779)..(779): a, c, t, g, unknown or other
  misc_feature (779)..(779): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatcgacccagtctccagacctcccgtggctgtcgtctcgtgggcgaggagggcccaacgatacaactgactaacgtccgaaggccggagtttgtttaacactaaacctaccgaaaagtaactaaaggtacgtttactttaaggccgtttacggaaccacgacctaaaacgaaaaccacgaaccacggtcccttaacgtaacgtccgtgtaccgtttacggttaccgtcgggtcccttaccggacccgggtaacgtcccgggtacctagtaacggtacttcggaggtcgggtaccgggtcgggttacgtggggaacttaggttaactttaccgaccgttacctaccgtacctaacgtacgacggtacgacggtcccgtcgggacgggtactaacggtaaagtcgggttacgggttagggtttaaccgttttagtaccgttaggtaccgtaaggtaccgtttaaaggtttacccttttagtttcgtttaaaccctttcccgaacggtttaacgttacgggttttaccgggaccccggtaaaggggtaacccgtaagggtccgtaagggtaccgtacggccgtaaacggtaaccggtagtccgggtatccgtaccnccggtaac

SEQ ID NO: 116858 - DNA, 589 bp, Homo sapiens
  misc_feature: GYAE6OF01DSCXN.36.35.D02.1.454.CMB.1.raw
  modified_base (246)..(246): a, c, t, g, unknown or other
  misc_feature (246)..(246): n is a, c, g, or t
  modified_base (330)..(330): a, c, t, g, unknown or other
  misc_feature (330)..(330): n is a, c, g, or t
  modified_base (416)..(416): a, c, t, g, unknown or other
  misc_feature (416)..(416): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacgggacatcgtgatgacccagtctccagactccctggctgtgtctcgtgggcgaggacgggccacgatcaatgacaagtccagcggatgtttanacaactacaagaataagagttcttagcttaggtaccagacaagaaaccacgacacgcctactaagcctggtaccttcgtttacncgggacccttacggtaacccgggagtcccggggtcctaggaacgtatcgaggtggcggcgggtctgggactagtacttccacgtcncacactcacgctacggcctcggcggcgtagaagtagtggttcggtacgtttacgttactcggtacagtctaaggttacttacgttagttacctccttacgtacgttagtttcggaccgtacgggtaccaaggtcgtaggatcgtcgacgtacgtacgtgtgcgtcgcgtaccg

SEQ ID NO: 116859 - DNA, 656 bp, Homo sapiens
  misc_feature: GYAE6OF01DRTF3.36.35.D02.1.454.CMB.1.raw
  modified_base (252)..(252): a, c, t, g, unknown or other
  misc_feature (252)..(252): n is a, c, g, or t
  modified_base (608)..(608): a, c, t, g, unknown or other
  misc_feature (608)..(608): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatgacccagtctcagactcccgtggctgtcgtctcgtgggcgaggacgggccacgatcaactgcaagtccagccggagttgtttanacaactcaaagaataagtagttcttagcttagggtaaccagacaacgaaaacccacgaacacgtccctacctaagtcctcgtccgttcgtttacgtcgggtcccttaccggtaccggggaacgtcccggggtcctaggaacgtcgttacgaggtcgggcgggtcgggtcgtgggactagtcttacactctacaccatcacgcacgtcgtgggcggacgtagaagtgttgggtaggttcggttttaactacgttcgtacgagtacttagttaagtttacgtccgtttaacctccttaacgtacgttacgggtttaccggaccggtaaggggtaacccagggttaccgtagggtaacncgtacccgagtaaccgtacggttacggacggaccgttcgacctaacgg

SEQ ID NO: 116860 - DNA, 777 bp, Homo sapiens
  misc_feature: GYAE6OF01DJW6X.36.35.D02.1.454.CMB.1.raw
  modified_base (246)..(246): a, c, t, g, unknown or other
  misc_feature (246)..(246): n is a, c, g, or t
  modified_base (384)..(384): a, c, t, g, unknown or other
  misc_feature (384)..(384): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacgggacatcgtgatgacccagtctccagacctccctggctgtgtctcgtgggcgagagggccacgatcaactgcaacgtccaggccggagttgttttanaccaactccaaagaataagtacgtttctttagcgtttacggtaccagaccaacgaaacccacgacacgccctaccgtaagctgtcttcgttacgtcggccctaccgtacccgggacgtccccgggtacctggaacgtnttcgaggtcgggccggtcgggtcgtaggggaactaggttactttccgaacgttccctaccgaacccgtacgttacgaacggtccgtaaccggtcccgttacggggtccgggtaccgttaacggaaaggttacggttacgggtttcgggttaccgggtttttaacgtttaccggttacggttaccgtaacggtacgttaaggtttaacgttttaacgttaccggttttacccttacccgttaccgttaaccgttaacgggttttaccgggaacccggtaaaccgggggtaacccgtaaacgggtcccgtagggaacggtacgtacccggtaccggtaaacccgtaacggttcgggtacggtaccctaccggccctaacccgtaccgtttaccgg

SEQ ID NO: 116861 - DNA, 735 bp, Homo sapiens
  misc_feature: GYAE6OF01CTRN9.36.35.D02.1.454.CMB.1.raw
  modified_base (204)..(204): a, c, t, g, unknown or other
  misc_feature (204)..(204): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatgacccagtctccagacctcccgtggctgtgtctcgngggcgaggacgggccacgatcaactgacaacgtccaggccggtagttgtttaacacaactaccaaagtaataagtagttcttaagcgttacggtaaccagacaacgaaacccacgacacgtccctacctaagctagtccttacgtttaacgcgggtccctaccgtaaccggggtaacgttcccggggtaccctaggaaaccgtacttccggagggttcggggccgggtccgggttcgacggggtaactaggttaactttcccaccgttcctaccgtaaccctacgtaccgaacggaccgtacggtcccgttcgggaccgggtaccggtaaggaaaggtacggttgggtacgggttacgttttaacgttaacgtcgtacgtacgtacgtaagttattacgttacgttacctccgttactacggttaggtttacggaccggtaacggggtaaccgaacggtccggtagggtaacgtacgtaccggtaccgtaacggtaaccggttcggtaacggtcgtccgtaccgtaacccg

SEQ ID NO: 116862 - DNA, 649 bp, Homo sapiens
  misc_feature: GYAE6OF01B4L2U.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatcgacccagtctccagacctccctggctgtcgtctcgtggggcgaggagggccacgatcaactgcaacgtccaggccggtagttgttttaacaacaactaccaaagtaataagtagttctttagcttaggtaccagacaacgaaaccacgacacgcctacctaagctagcttacgtttacgcgggtcctaccggtacccgggaacgtcccggggtacctagaacgtagttcgaggtcgggccggcgggtcgtaggggactaggtactttcacttcgtacaccataccgagcgacgcccgtcggcgggacgtaggaagtagttcgggtacggtacggtttacttacgtgtacgacgtacgtaagttacttagttcgttacctccgtactacgttacggtttacggaccggtacgggtaaccgaaggtcggtaggaacggtacgtccggacgtaacgtaacgttcggtcggcgtcgacctaccg

SEQ ID NO: 116863 - DNA, 704 bp, Homo sapiens
  misc_feature: GYAE6OF01ENASJ.36.35.D02.1.454.CMB.1.raw
  modified_base (277)..(277): a, c, t, g, unknown or other
  misc_feature (277)..(277): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtggtcttttctggtggcttaattttaaaaggtgtccagtgtgaggtgcagctgctggagtcgtgggggagcgttggtacgaggcccgggggggtccctggagactctccgtgtagacgcctntggtattccactttgacaagtgtgcctatcgacctggggtacccgccagggtcctaccggaggggaacggggtcgttagggaggtgggttctcgtaaggtttagttaggtggtaggttggtaagtagacacgagacttacgcagtactcggtaggaacgggtccgttacacctatccgtaccgagaacgaactaacgttacccaaacacggaccaccggtcgttagttacgtttcgacctaactagtacgaaacctacgtcccgtagaacggacggtaccggaaggaacccggaaccggacctaacgttaacttaacgttttaacgttaggtacgtaaccgtttaaaaccctttccgtttttaaggtaacgtttacgggtttaactttaacccgtttaccccgtttaaggttacggtaaaccccggg

SEQ ID NO: 116864 - DNA, 850 bp, Homo sapiens
  misc_feature: GYAE6OF01EHJAK.36.35.D02.1.454.CMB.1.raw
  modified_base (227)..(227): a, c, t, g, unknown or other
  misc_feature (227)..(227): n is a, c, g, or t
  modified_base (263)..(263): a, c, t, g, unknown or other
  misc_feature (263)..(263): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagcgtgtgtttctaggtggctaatttaaaggtctctgtgagctctggattcacttgacagtgtgccatcgacgtgggtcccncgaggcctaccgagggaacgggctgggagtgggtcnctaggttattaggtggtagtaggtagtacgcaacaggtacttacgcgaagtactccggtaggaacggggtccggttaccacctatcctaccgaaggacgaaccaaacttacccgaaacgacgtacccaccgtacttaggttaattttggaccccgaacagtttacgggaaaaccttcggtcccgtaaggaacggaaccgggcccggtaaaacgggacccgttaaccgggaccctaaatttaacttagtttttaacgtttacggtacgtaaccggttttaaaacccttttcccgggtttttagtaacgttttacggttttaaacctttacgttaccccccgtttaaggttaccccggaacccggttaccgggttccggggggaaccccctaaacgggggttaaaccccccgtttgggttaccccggtaaacccgttacccggtccccttaacgggacccttaccccgttacccggaaacccgtaacccggggtaccccttaacgggttccccggttccccttcccccggtcgaccccccttaccccgttacccctaaaccgaacgggtaccccgtcccgtaaccccgg

SEQ ID NO: 116865 - DNA, 848 bp, Homo sapiens
  misc_feature: GYAE6OF01A3Q9H.36.35.D02.1.454.CMB.1.raw
tcagtacgctgtctcacgaccggtgctcgatttagcacacgatagttgggtttggggagctctgagagaggagcccagccctgggattttcaggttgttttcatttggtgatcaggactgaacagagagaactcaccatggagtttgggctgagctggtctttttcttgtggtcttaattttaaaaggtgtccagtgtgaggtgcagctgctggagtcgtgggggaggtcgtttgggtacgacggggtcccggggggggttcccctggacggtacctccgttcccgtggtagaacgcccttccgtggtactttcctaccctttggaacctaaggtgtcgccatcgacccgtcgggtcccgccgagggcctacccggaagggggaacggggtcgtagggtagggttcggggttacctcgtaaggttttaagtttagggttaggggttaggttagggttaaggttaacggacgtaacgtaaggttaacgtttaaccggaccgtaacggtacccgttacccggggtacgggtaaaaccgggggttcccccgggtttaaccaaccccgtaacttccccgttacccgaaaggtaaccgaaacccgttaaacttaaccccaaaaccgacggtacccaaccgtaccgttaggtttaactttggaaccctaactaacgttacgaaccaacggtcccgttagggaacggaaccggaccggtaaaccggaccgaacccgggactaacgttaattaagtttacgttggttacggtaacccgttaaaccgttttcccgttttaagtacgtttacggttttaacttaacccgtttcccccgttaggtacccgtaaccccgg

SEQ ID NO: 116866 - DNA, 778 bp, Homo sapiens
  misc_feature: GYAE6OF01D88JG.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttggctgagctggtctttttcttgtggcttaattttaaaaggtgtccagtgtgaggtgcagctgcgtggagtcggtgggggaggtcgttaggtacgacgggcccgggggggtccctaggacgtaccgttccgtcccgtaggtacggaacgtcccttcgtaggtacttcctaaccgttttacgaaccgtaaggttgtcgcctaagtccggtacccgtcggggtacccgccgaacggccgtaccgggaaggggacgggcgtgggaggttcgggtactcgtaaggtttagttaggtagggtagtaggtagtagacacgaagtacgttaccgacgacgacccgttacggtaggtaaccgggtcccgttaaccaacccgtagttacccgtaccgaaggtaaacgtaaccctaaacttaaccccgaaacgaccgaccgtaccgttacgttagtttaacgtttcggacctaactagtaacgaaacccgtacgtaccggtaggaaccgtaccgggacccggtaacggacccgtaccggtaacctaagtttaacgttaagtttacgtcggtaacgtaaccgtttaacctttccgtttaagacgttttacgttacttaacccgtcccgtaggtccgtaacccggg

SEQ ID NO: 116867 - DNA, 720 bp, Homo sapiens
  misc_feature: GYAE6OF01B2NIB.36.35.D02.1.454.CMB.1.raw
  modified_base (240)..(240): a, c, t, g, unknown or other
  misc_feature (240)..(240): n is a, c, g, or t
  modified_base (396)..(396): a, c, t, g, unknown or other
  misc_feature (396)..(396): n is a, c, g, or t
  modified_base (469)..(469): a, c, t, g, unknown or other
  misc_feature (469)..(469): n is a, c, g, or t
  modified_base (498)..(498): a, c, t, g, unknown or other
  misc_feature (498)..(498): n is a, c, g, or t
  modified_base (506)..(506): a, c, t, g, unknown or other
  misc_feature (506)..(506): n is a, c, g, or t
  modified_base (556)..(556): a, c, t, g, unknown or other
  misc_feature (556)..(556): n is a, c, g, or t
  modified_base (616)..(616): a, c, t, g, unknown or other
  misc_feature (616)..(616): n is a, c, g, or t
tcagtacgctgtctcacgaccggtgctcgatttagcacacgatagttgggtttggggagctctgagagaggagcccagccctgggattttcgaggtgttttcatttggtgatcaggactgaacagagagaactcaccagtggtagttgggctgacgcgtgtcgtttctaggtcggtacttaagttttaaaggcgtaccgagtgtggacggttcgcagtctggcgtggagtcggtgggggngtcgttgggaccgacgggtccgggggtcctaggcgtactccgtacgtggtagacgtccgttgtacggtattaccgcgtttagaacgtaacgtgccgacctagtcggtaccggtccgggtacccacggtcggaccgtaccggaggggaacggggtcncgggtacgttgggcttacgaggtttagtaggtggttagtacggtagtacgcgtaacgtagtaacgttaaccgnacggtacctcggtagaccggggtaccttnaacccgtntaccgtacgagtaacactaactacgacgacgtccgactagtctacgttanctaaagtcaacgtaccgtacgtaccgacgaacgtaccggacgtaaccggcccaacggttnaaacgttccttaagttcgtaacgttcgtaaacccggtttaactttcccgtttaaggaccgtttacgtttaacccaccggttcccgttaaaggtcctaacccggg

SEQ ID NO: 116868 - DNA, 553 bp, Homo sapiens
  misc_feature: GYAE6OF01A12J7.36.35.D02.1.454.CMB.1.raw
  modified_base (241)..(241): a, c, t, g, unknown or other
  misc_feature (241)..(241): n is a, c, g, or t
  modified_base (520)..(520): a, c, t, g, unknown or other
  misc_feature (520)..(520): n is a, c, g, or t
  modified_base (542)..(542): a, c, t, g, unknown or other
  misc_feature (542)..(542): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgttttanacaactccaagaataagtagttcttagcttaggtaccagcaagaaaccacgacacgcctccaagctgcttcgtttactcggcctcgtaacccgggaacgtcccggggtcctaggaaccgtattcgaggtcggccggcggtcgtggggactagtactttcactctaccactatcagcagccgtgcggcagagagtgtcgtacgtttatacgtgtacagtactagttattattcgtacctcctctacgtgtttcggacgagggaccagtcgtaggacgtancggactaggacttggtcgctanacgtctagtcg

SEQ ID NO: 116869 - DNA, 758 bp, Homo sapiens
  misc_feature: GYAE6OF01EAU8H.36.35.D02.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (439)..(439): a, c, t, g, unknown or other
  misc_feature (439)..(439): n is a, c, g, or t
  modified_base (458)..(458): a, c, t, g, unknown or other
  misc_feature (458)..(458): n is a, c, g, or t
tcagtacgctgtctcacgaccggtgctcgatttagcacacgatagttgggtttggggagctctgagagaggagcccagccctgggtattttcaggttgttttcatttggtgatcaggactgaacagagagaactcaccatggagtttgggctgagcgtcgtgtttctaggtgactaagtttaaaggntcagtgtgaggtgcagctgcgtaggngtcgtaggggtagtccgttggtacgacggggtcccgggggtacctgacgtacttctaccgtgtagaactcccttcgtcggtatttccgtaacctttaggaacctaagtggtacgaccagttccggaccggttacgggccaccggaacgggttccgtaccggaaagggggcggtccgtagggtggttcggtacctagtaaggtttagtacgttaggtgtgttaacgngacaagtatacgttaccgngtacgaaccgttcgaggacggtaccgtacaacgtactccgacgagaactaacctaatacccaagactcctaacgttgttaacgttaatcgacccttaacggatttaccgaaagtcccgtaacgtagggacggaaccggaccgaacggttacccggaccgtaacgttaaatttaccggttaatttaacccgttagggttaaccgttaaacccggtttaaacctttaaacgggttttcgaaaacgggtttttcccgttaaaactttaccccgtaaccccgtttaaggcccgtaaaccccggg

SEQ ID NO: 116870 - DNA, 707 bp, Homo sapiens
  misc_feature: GYAE6OF01BW52I.36.35.D02.1.454.CMB.1.raw
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctggggcgagagggccacgatcaactgctaagtccaggccggtagtgttttatacaactccaagaataagagttcttagnttgactacacgacaacaacacacncncctacgagtctcgtccttacgttacggtcgtacctaccggtaaccgggtacggtcccggtacaagtactgtacgtggcgggcgggtcgtcggtacggactagtacttcacctctaccacgtaactcggactacgacgtcggtcggaccggtgtaagacggttaggtcggtttacgggttaacttttacttcgtacgtacgaaacgtaacgttaaggtttaatttacggtttaccctttaccctacccgtttacgtaaccggttttttaacggggttcccgggaaaccggggtaaaccggggttaaaggtacccggttacggggttaagggtaaaccttacggtacccgtaaaccggtacccggttaaggggttcgtaacccgggtccgtaccgtaaacccccg

SEQ ID NO: 116871 - DNA, 902 bp, Homo sapiens
  misc_feature: GYAE6OF01B8KV4.36.35.D02.1.454.CMB.1.raw
tcagtacgctgtctcacgaccggtgctcgatttagcacacgatagttgggtttggggagctctgagagaggagcccagccctgggattttcaggttgttttcatttggtgatcaggactgaacagagagaactcaccatggagtttgggctgagcttggtctttttcttgtggtcttaagttttaaaaggtgtccagtgtggaggtgcagctgctggagtcggtgggggagtcgttagggtacgacgggcccggggggtccctggacgacctcgtccgtgtagaacgcccttcgtggtactttcctaaccttttagcagtcctatcgccatcggacccgttggggtccccgccgacgggtccgtacccggaagggggaacgggtacgtaggggtacggttcgggtcctttcggtaccgtttagttaaggtagggttaatttagggggttacgtttaaattaaccgaaaacgttaccgacgtaaccggtcccgttaccgggtaaggaaaccggggtcccgtaccgtttacccgaacccgtacttacccgttaccgaacggtaacgtaacccgttacgtttaacccaaaggtaccgacctacgtttacccttaggttaactccgttaacgtaacgaaaacttaccggaaacctaccggtacccgttaaggggtaccggttaccggaaccccggtaacgggaccccggtaacccgggttaaccccttaaacggtttaaactttaacggtttaccgggttaacgggtaaaccggggttaaacggggtttggggggttaaaccgggggggggggttacgggttaccgggggggttaaccccgtttaacccgggtttccccggggtttagggggttttaccccggtttttcggggttaaaccccgggg

SEQ ID NO: 116872 - DNA, 882 bp, Homo sapiens
  misc_feature: GYAE6OF01DIGL4.36.35.D02.1.454.CMB.1.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtcgccgtacggggacagtcgtgatcgaccagtcctccagcctcccgnggcttgtgtctcgngggcgaggacgggaccacgatacaacgtgacacgtccgacggtcggtagtttacgttttaacaacctaaaccgtaccgtaaaagtaaagttaaacgttacgttttaccgtttagtaccggtttaaccggaaccagtaaccgaaaaccgaaaacccgaaccgaaccgtacccgtaccccttaaccgtaacggtccttcggttaccctttcggtttaaccggtccggtacccgttacccgggtaaccccggggtaccgttccccggggttacctaacgaacgttcgttacgagggtccggggtccggtcgggttcggtagggaacttacggttctttccacgttaccgtactaccgagtacgaccgtacgtcccggacgttccgggacggttacggtaacggtaaacgggttcgtttacggggttacgggtttttaacccgttttaagttcccgtacggtaccgtaacggtacgttttaacgtttagttttaaccgtttcccggtttaaaccctttcccggttaacgttacccgggttttaacgggtttaccccgggaaccgggttaaacccggggtaacgtaaccgggttcggttacgggtaacgtacccggttaccgggtaacgttaacccgggttagtccgggttacgtaccggtacgcccccgttaagttcccggttc

SEQ ID NO: 116873 - DNA, 712 bp, Homo sapiens
  misc_feature: GYAE6OF01CRNEO.36.35.D02.1.454.CMB.1.raw
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggtctttttcttgtggctattttaaaaggtctcctgtgagcctctggattcacctttgacaagtgtgccatgacctgggtccgccaggcgtccgggggaagggctgggagtgggtctcgtagttattaggtggtagtggtagtagcacagtattacgcagactcgtaggaacgggtccggttcaccactcctaccgagacgaactaacttccaaacgacgaccaacggtccttgttatttcgaccaactatacgaacagtccctagacgacggccggaaggaccacgggacctaattattatttagttgtacgtaaccgttaaaccttttccgttttagtaccgtttaggtttaactttaccgttaccccgttaggtacgtaacccgtacggtcggggacccgtaaccggggtaacccgtcgggtaccctacccgttcctccctcgaccgtccctacccgaacccgaccgggtcccctacgttcccggttaccccgttccccccgtcggtaccccctaccccgttcccgtacccgaacgtacccgcccgtcccgttcccgggg

SEQ ID NO: 116874 - DNA, 737 bp, Homo sapiens
  misc_feature: GYAE6OF01A2XN1.36.35.D02.1.454.CMB.1.raw
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgaggacgggccacgatacaactgacaaggtccaggtccggtagttgttttaactacaaaccgtccaaagtaactaaaggtacgtttactttagtacgtttaggtaaccagtaccaaacggaaaacccacggaactacgtacccttaccgtaacgtcctcgtacctttcggtttaaccgtcgggtcccctaccggtaccccggggtaacgtccccgggggtaccctaggaaccgtagtaccgtaggtcggtcgggtcgggtcgtgggaacgtacgtactttccactcctacgacctactcgacgcgaacgccgtcgggacggtcgaacggtaagtcgtggttcgggtacgttttaagttccgttgtaacggtagtaccgttaaggttatttaacggttccgtttaccttcctaacgttaacgttacgggttttacggacccggtaacggggaaactacgggtacggtagggtaacgtccgtacgggaccgtaaccggtaacgttcgtggtaccgtacgaccctaccgtgttacccgg

SEQ ID NO: 116875 - DNA, 651 bp, Homo sapiens
  misc_feature: GYAE6OF01ED3RJ.36.35.D02.1.454.CMB.1.raw
  modified_base (244)..(244): a, c, t, g, unknown or other
  misc_feature (244)..(244): n is a, c, g, or t
  modified_base (335)..(335): a, c, t, g, unknown or other
  misc_feature (335)..(335): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgcaagtccagccgagttgttttanacaactccaagaataagtagttctttagcttacggtaaccagccaagaaaccacgacacgcctacctaagcctagcctttacgtttaccgngggtaccctccgtaacccgggtaagtcccggggtaccctaggaaaccgtgttccgagggtcgggccgggtccggtacgtaggggactaagtactttaccgacttcctaccgaacccataccgaacgcaacgtccgtagggccggtctaggaagtagtgggtagggttacgttttattacgtcgtacagtactaagttattacgtcgtttacctacctcgtaacgttcggtttacggacccgtaagggaacctagggacgttgggaagtctaccggacaaccggttacgtggtcggactacgcctaacgtgttaccg

SEQ ID NO: 116876 - DNA, 753 bp, Homo sapiens
  misc_feature: GYAE6OF01DBBIT.36.35.D02.1.454.CMB.1.raw
  modified_base (735)..(735): a, c, t, g, unknown or other
  misc_feature (735)..(735): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacgaggtgccgtacggggacatcgtgatcgaccctagtctccagacctccctggcctgtcgtcctcgtggggacgacggacgggcccaagacttaccaaacgtgaccgaacgttccgaggtccgggtaagttcggttaataacctaaaccgttaccgaaaagtaaagttaaagtacgttttactttacgtcgttaggtaacccaagaccaacgtaaaacccacgaacctacggtaccctaccgtaacgtcgttacggtcctttcgttttaaccgcgggtaccccgttaccggtaaccccgggggtaacgttccccggggtacctacggtaaacggtcttacggtacgggtcggggaccgggtcgggtccggtagggaacctaggttacctttaccgaccttcctacctaaccacgtaccgcgccgtaacgtcccggtagggcgggtcctaagaacgggtatttcgggttacggttacggttttaatccgtaggtacccaggtacgttaattactttcggttaccttacgtcctacgttagttcggttacgggaccgtagggacgacggtgtaggacctagtcccgagaaccgtntcggtcgctcggactccg

SEQ ID NO: 116877 - DNA, 759 bp, Homo sapiens
  misc_feature: GYAE6OF01BSHXP.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccagtggtagtttgggctgagcgtggtctttttcttgtggtcttaagttttaaaaggtgtccgagtgtgaggtgcgagcgtgcgtggagtcggtggggtaggtcgttacggtacgacgggcccggggggttccctggacgtaccttccgtccgtggtgaacgtccgtgtgtacttcctacgtttgacgtaagtgtcgccgatcgaccgtcgggtcccgccgacggccgtaccggaaggggtacggggcgtgggaggttcgggtctacgttaagttagttaggtggtagtggtagtacgacgtagagtaacgttacgacgtaacgtaccgtccggtaggtaaaccgggtccgttacccgtaaccgtaaccgttcccgtaacccgaagggtaaactaaacccgtaaaccgttacccgaaacaccggtacccgtaacggttaccgttagtttaacgttccgaacgtaacgtaactacgtaaaccacggttcccgaggtaacgaccggtaccgggaaccggacgtaccggtacctaagttacttaagtttacgtacgttagaaccggtttaacctttccgtttaagtaccgttacgtttactaccgttcccgtaagtcccgtaacccgg

SEQ ID NO: 116878 - DNA, 612 bp, Homo sapiens
  misc_feature: GYAE6OF01C6AMW.36.35.D02.1.454.CMB.1.raw
  modified_base (207)..(207): a, c, t, g, unknown or other
  misc_feature (207)..(207): n is a, c, g, or t
  modified_base (259)..(259): a, c, t, g, unknown or other
  misc_feature (259)..(259): n is a, c, g, or t
  modified_base (450)..(450): a, c, t, g, unknown or other
  misc_feature (450)..(450): n is a, c, g, or t
  modified_base (476)..(476): a, c, t, g, unknown or other
  misc_feature (476)..(476): n is a, c, g, or t
  modified_base (602)..(602): a, c, t, g, unknown or other
  misc_feature (602)..(602): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatcgacccagtcctccagacctcccgtggctgtcgtctcgngggcgaggacgggccacgatacaactgacaagtccaggccggagttgtttanaacaactacaaagaataagtacgtttactttagcgttacggaccagacaacgaaaccacgacacgccctactagctcgtcgttcgttacgcgggtaccctaccggtaacccgggaacgtcccggggtacctaggaacgtatcggaggtcgggcggtcggtcgtagggactagtacttcactcgtcactacncagcacgcgtggacggactaggaagngtgtgtacgtttactcgtacgtcagtatagttattacgtcgttacctcctcgtacgttaggtttccggacggtacgggacacggtcgtaggacgtacgtccgacgaacgtacggtcggtggtaccncgtcctaacg

SEQ ID NO: 116879 - DNA, 796 bp, Homo sapiens
  misc_feature: GYAE6OF01DZ9DV.36.35.D02.1.454.CMB.1.raw
  modified_base (520)..(520): a, c, t, g, unknown or other
  misc_feature (520)..(520): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacgaggtgccgtacgggacatcgtgatcgacccagtctcagacctcccgtgctgtcgtctcgtagggcgaggacgggccacgactacgaacgacgacgaaacgtccgacggtccggtaagtttgttttaacaactaaacctaccgaaaagtaagtaaacgtacgtttacttaagtcgttacggtaccaagacaacgaaccacgacacgcctacgtaagctcgtcttcgtacgtcggtcccgtacgtaaccgggtacgttcccggggtacctagaaccgtagtacgtcggacgggtcgtaccgggtgtacgggactaggtacttaccgactctaccgactacgtcgagtacgacggtccgtcgggacggtacgtaaggtaaacgnggttcgggttacgggtttacgttttaaccgtacggtacgtacggtaccgtaagtttaagttaaccgttttaacgttaccggtttaccccgttacgttaacccggttaacggtttttaacggggttcccgggtaaacccgggtaaacggggttaaaccccgtaaggtcccggggttaaaggggtaacccgtacggttacccggtaaacgttaacccggggtaagtttccggggtaccttacggtaccccggtaacctacgggttaacccgtttccgg

SEQ ID NO: 116880 - DNA, 814 bp, Homo sapiens
  misc_feature: GYAE6OF01DWDGJ.36.35.D02.1.454.CMB.1.raw
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtcgccgtacggggacatcgtgatcgacccagtctccagacctccctggctgtcgtctcgtgggcgaggacgggaccacgatcaactgacaacgtccacggccggtagttgtttaacacctaactaccaaagaataaagtagtttactttagctttacggtaccagacaaggaaaccacgacacgtacctaccgtaagctcgtcttacgtttacgtcgggtaccctaccggtaacccggggaacttccccgggggtccctaggaaaccgttacgttaccgagggtcgggcccgggtcgggggtttcgtacggggaacctaaggtacttttaccgacctttcccgttaccaaacccgtacgtaccgtaacgacccgaacggtccccgttacggggacccggggttcctaaacggggtaaagtacggttacggggttaccggggtttaacgggttttttaactttacggttacggttacgtaacgggtacgttaacggtttaattttaacgtttaccgttttaacccgttacccttacgttaaccggtttacgggtttttaccgggaacccgggtaaacggggaacccgtacggtaccggttagggtaacgtaacgtccggaaccgtaaacggtaccgttgggtacggtcgttacgccctaacgtcctttacccgg

SEQ ID NO: 116881 - DNA, 955 bp, Homo sapiens
  misc_feature: GYAE6OF01C0I76.36.35.D02.1.454.CMB.1.raw
tcagtacgctgtctcacgaccggtgctcgatttagcacacgatagttgggtttggggacaacaggcaggcaggggcagcaagatggtgttgcagacccaggtcttcatttctcttgttgctctggatctctgttactacaggtgccgtacggggacatcgtagatcgacccagtcctccgacgacctccctggctgtcgtccgtcgtgggcgaggacggccagatcaactgacacgtccaggtaccggtagtttcgtttaacactaactacgaaagtaacgttaacgttacgtttacgtttacgtacgtttaccgtaaccgaacgtacgaaaccggaaaaccgacggtaaccgtaccgtaccctaacccgtaacgtccgttcgtccgttttaccggtttaccggccggggtacccctttacccggtaaaccccggggtaaccggttccccggggtttaacccaagggtaaaccgttcgtttacgggacgggttcggggacccggggtcgggtttaaccgacgggtaacttacgggtttaacctttcccgaactttcccgtaaaccgaccgttacgtaacgaccggtaaccgtccggtacccgggttacgggacccgggtaacgttaacggggtaaccgttaggtttccggggtttaacggttttaccgggtttttaacgttaccgttaccggtaacgttaccggttaagtttaacggtttaacgttttaaccgttttcccggttaacccttttacccgttaaaccggtttcggtttaaacccgggttttaccgggaccccgggggaaaacgggttaaacccgtaaccggggttaccggtaacgggttacccggtaaacccgggttaccggtaaacccgggtaaacccgttaacggggtttcggttaaccggtacccggtaccggttacccgtaaacccggttcgtttaacccggg

SEQ ID NO: 116882 - DNA, 845 bp, Homo sapiens
  misc_feature: GYAE6OF01ECR6O.36.35.D02.1.454.CMB.1.raw
  modified_base (238)..(238): a, c, t, g, unknown or other
  misc_feature (238)..(238): n is a, c, g, or t
tcagtacgctgtctcacgaccggtgctcgatttagcacacgatagttgggttgggggagagaggagcccagccctgggattttcaggtgttttcatttggtgatcaggacctgaacagacgagaactcaccatggagtttgggctgagcgtggtcttttctgtggcttatttaaaggtctcctgtgaacgtcctctggattctacctttgacaagtgtcgccatcgaccgtgggtccnccgaggcctaccgaggggaacggggctgggacggttgggtactactagtttacttaggtaggtaggtggtagtacgactacgagtacgttacgcagtacctcggtacggaacggggtccgttacacctatctaccgagtacgaactaacgttacccaaacgagacccgtaacgtcctttaggttactttaccggacctaaaccgtagtaacgaaacccgtaacggtaccccgttagggaaccggtaacggacccgggaacggaaacccggaccgggtaaccctaagttaacgttaacgtttacgtttacggtaccgtaaccgttaaaccgttttacccgttttacgtaccgttttaggtttaacctttacccgttaccccgtttaaggtacccgtaaccgtaaccggtacggggaccccgtaaacggggtacccgttacggtaccctaacccggttcccttacccgtaccgtaacccgtcccgtaccccggaacccggtacccgggtccccgtaaccggttccccggttaccccgtttcccccccgtagggtacccccctaccccgttaccccaacccggtaaccgacccgtccccgtaaccccggg

SEQ ID NO: 116883 - DNA, 807 bp, Homo sapiens
  misc_feature: GYAE6OF01DYIL1.36.35.D02.1.454.CMB.1.raw
tcagtacgctgtctcacgaccggtgctcgatttagcacacgatagttgggtttggggagctctgagagaggagcccagccctgggtattttcaggttgttttcatttggtgatcaggactgaacagagagaactcaccagtggtagtttgggctgagcgtggttcttttctgtgtcttaagttttaaaggtgtcagtgtgaggtgcagctgcgtggagttcggtgggggacgtcgttacggtacggtacggggtcccggggggtccctaggacgtaccgttcctccgtgtacgaacgtccgtcgttggtacctttaccgtaccgttttaggaaccgtaaggtcggtcgtaccgtacgtccggtacccggttcggggtccccgtaccgtacgggtacccggtaccgggaagggggtaacgggtccggtagggtacggttcgggttacgttacgttaaggtttaggttagggtacgggttacggttagggttagtaacgacgtaacgtaaggtaacgtacgtacgaacggtccgttaccggtacggtaacgggtcccgttaacacctaacgttcccgtaacgaagtaactaaaccctaacgtaacccgaagaccgtaccgtacgttacttagtttacgtaccgaacttaagtacgtaacgaaccgtacggtacccgtagggaaccggtaccggtaaccgggaacgaccgaaccggtaactaattacgttagttacgtcgtaacgttaccctttaaacgttttcgttacgtaacgtttcttaccttcccgttaacgtgtccgtaacccgg

SEQ ID NO: 116884 - DNA, 759 bp, Homo sapiens
  misc_feature: GYAE6OF01BOV61.36.35.D02.1.454.CMB.1.raw
tcagtacgctgtctcacgaccggtgctcgatttagcacacgatagttgggtttgggggagagaggagcccagccctgggattttcaggtgttttcatttggtgatcaggactgaacagagagaactcaccatggtagtttgggctgagctggtctttttcttgtggtcttaagttttaaaaggtcttccgtgtagaagtccttcgtggacttctaccgtttgactaagtgtagccatcgaccgttgggtcccgccgaggctaccgaagggaaggggctgggaggttcgggtctcgtagttattaggtggtagttggtagtagcaacgagtattacgcacgtaccgtcggtaggaacgggtccggttacacctactcctaccgaagagtaacctaaagttaccccaaagtgtacccgtaacgtcgttaggttaactttcgacctaactagtacgaaactaggccctaaggacggaccgaccggaacggaccgaccgtacctaagtttaacgttaacgtttacttaggtacgtaaccgttaaaaccgtttttccgtttacgtacgtttacggtttaactttaccgtcccgttaagtccgtaaaccgtcgggtacgggaccgtaaccggtacccgttagtacccgtacgttcctaccgtcgaaccgttccctaccgacggtaaccggccctaccggttcccgttcccgttaccccgtcgtcccctaacccgttcccgaaccgaacgtcgacccgtacccggg

SEQ ID NO: 116885 - DNA, 574 bp, Homo sapiens
  misc_feature: GYAE6OF01EXQ3I.36.35.D02.1.454.CMB.1.raw
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagctgctggagtcgtgggggagtcttggtacgacgggcccgggggggtccctaggagacctcctccgtggtgaacgcctcgtggtacttcctacctttgactaagtgtcgccatcgaccgtgggtcccgccgaggcctccgaaggggagggctgggagtgggtctcgtagttattaggtggtagtggtagtagcanagattacgnagactcgngacgggccgtcacnctcacagacactaatccaanacgcacgntgtattgcacatcgaactgcctgacgacgccgagacacgctagtactattagtcgtagtacgttaacctttctttagaccgtttaggttacttacctccccgtagtcgtaacccg

SEQ ID NO: 116886 - DNA, 843 bp, Homo sapiens
  misc_feature: GYAE6OF01B87AB.36.35.D02.1.454.CMB.1.raw
tcagtacgctgtctcacgaccggtgctcgatttagcacacgatagttgggtttgggggagagaggagcacagccctgggattttcaggtgttttcatttggtgatcaggactgaacagagagaactcaccatggagtttgggctgagcgtggtctttttcttaggtggcttattttaaaaggtctcctgtgaagcctctggattcacctttgacaagtgtgcctatgacctgggtcccgccaggctaccgaggggaagggctgggaggtgggtctcgagttataggtggtagtggtagtagcacgagtattacgcagaccttccggtaggaacgggtcccggttacacctatcctaccgaagacgaactaaacttacccgaaactactaccgacggtccttaggttaacttttacgacctaactaacgttaggaaaaccacggtacccgttaggaaggaccggtacccggggaaacgggtaacccggtaacccgggaccctaaacgtttaagtttaactttttaacggtttacgggtttacggttaaaccgggtttaaaaccctttttccccgttttttaaggaaccgttttagggttttaacctttaaccgtttacccccgttaaggttaccgtaaccccggtacggttacccggggggtaacccgtaaccgggggtaaaccccgttccgggttaccctaaccccggttcctacccgttacgacccgtaccccgtaccccgtaacccgaacccgggtacccgtacgtttcccggttaccccgtttccccccgtacgggtcccccttacccccgtaccctaacccgaacggtaccgtaccccg

SEQ ID NO: 116887 - DNA, 619 bp, Homo sapiens
  misc_feature: GYAE6OF01BIFQE.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggcttagctggctttttcttgtggctattttaaaaggtgtccagtgtgaggtgcagctgctggagtcgtgggggaggcttggtacaggccgggggggtcctgagactctcctgtgaagcctctggattcacctttgacaagtgtgccatgaccgtgggtcccgccaggcctaccgaggggaacggggctgggagtgggtctctagttattagtggtagtggtagtagcacagattacgcagtactccggtaggaacgggtcccggttacaccgattccctaccgaggacgaactaacttacccgaacagccacggtcttgttatttcggacacatacgaacacgtacctagaagtacggaccggaagaccgaccgggaccaagttactattagttgtacgaccgttaaacgttttccgtttacgacgtttcggtttaacttaccgttaccccgtaagtccgtaaccgtacggg

SEQ ID NO: 116888 - DNA, 777 bp, Homo sapiens
  misc_feature: GYAE6OF01CKFLW.36.35.D02.1.454.CMB.1.raw
  modified_base (203)..(203): a, c, t, g, unknown or other
  misc_feature (203)..(203): n is a, c, g, or t
  modified_base (647)..(647): a, c, t, g, unknown or other
  misc_feature (647)..(647): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactcccgtggctgtcgtctcgngggacgaggacgggccaacgataccaacgtgaccaagtccaggccggtaagttcgttttaacacaaccgttaccgaaagtaaagttaacgtagttttaacctttaggtaccgttacggttaacccaggtaccgaaaacggtaaaacccgaccggtaaccgtaacggtcccttaaccgtaaaaccggtcttcggtaccggttttacggttttaaccggtccggggtaacccttacccgggtaaacccggggtaacgtttccccgggggtaccctaggtaaaccgtaacgtttccggaggtccggtcgggtaccgggtcgtaacggggactaggtacttttaccgaacttccgtacgacctacgtacgtacgaccgacgtcccgtacgggccggtagtacggtaaaggtgttaggttccggtacgtttaacgttacgtcgtaacgnggtactaacgttactttacgttagttaccctcttaacgtatttcggttcgggaccgtacggggtaacccaaggtcgtaaggtcgacgttccgaccgtacgtaaccgtcggtaggtcgtacgacccgtacg

SEQ ID NO: 116889 - DNA, 766 bp, Homo sapiens
  misc_feature: GYAE6OF01AQY8Y.36.35.D02.1.454.CMB.1.raw
  modified_base (188)..(188): a, c, t, g, unknown or other
  misc_feature (188)..(188): n is a, c, g, or t
tcagtacgctgtctcacgaccggtgctcgatttagcacacgatagttgggtttgggggtaggcgtacaacaggcaggcgagggcagcaagatggtgttgcagacccaggtcttcatttctctgttcgctcgtggtatctcgttagttactacgagggtcgtacccgtacggggactagttcggttagnttaccgacccgtagttcctacccgaagtccttccccgtgggcttcggttggttccttacggaggggtccggaaacggcggggtaccctaacgtacgtacggtaacctaaggccgtaaaccgttccggaacggccggttaggttttagttttaacaccctaactaccgtaaagtaagttaacgtagtttactttacgtacgtttcggacacggtacaacgaacccgtacgacgtacctccgtaccaacgtcgtactcgtttaccgttaccgcggtaccgttaccggtaccggtacggtccggtcccgtagttacggtactcgtaggtacggcggtacggtcgtacggactagtactacgtacgtcctacgcgaactgacgcctacgcggtacggacggtctaggtaacgtgttcgggtacgttgttactttacggcttcgtagctttaaggttagtttacctggttaaccttcgtacgttacctgggtttaaccggccggtaccggaaactcggtacgtagggacgtacgttacccaacgggttaagtccggtcggttacggccttggacccttaccgg

SEQ ID NO: 116890 - DNA, 710 bp, Homo sapiens
  misc_feature: GYAE6OF01CSO11.36.35.D02.1.454.CMB.1.raw
  modified_base (118)..(118): a, c, t, g, unknown or other
  misc_feature (118)..(118): n is a, c, g, or t
tcagtacgctgtctcacgaccggtgctcgatttagcacacgatagttgggtttgggggagagaggagcccagccctgggattttcaggtgtttcattggtgatcaggactgaacaganagaactcaccatggagtttggctgagcgtggtcttttctgtggtctatttaaaaggtctcctgtgagcctctggattcacctttgacaagtgtgccatcgaccgtgggtccgaccgaggcctaccggaagggggaacggggctagggaggtcgggtctcgtagttagttaggtaggttaggtaggtagtacgactaacgtagtacgtacgacgtacgtaccgtccggtaggtacggtccgtaccacctactcgtacgagtacgtaactaactacgaacgacgactacgtcgttagttacgttacgacctacgtacgtacgaactacgtacgtaggaacggacggaccggaacggaccgtaccgtactaattaacttagttacgtacgtacgtaacgttaaccgtttcgtttagtacgtttacgttacttaccgtaccgtacgtacgaaccgtacggtccgggtaccggtaccggtaccgtcggtacctcccgtcctaccgtccgtaccgtcccgacccgaccggtaccggtccctcgttcccgtccccttccccgtacgtacccctacccgtaccacgacgtccgaccgtcg

SEQ ID NO: 116891 - DNA, 639 bp, Homo sapiens
  misc_feature: GYAE6OF01BLD7O.36.35.D02.1.454.CMB.1.raw
  modified_base (627)..(627): a, c, t, g, unknown or other
  misc_feature (627)..(627): n is a, c, g, or t
tcagtacgctgtctcacgaccggtgctcgatttagcacacgatagttgggtttgggggagctacaacaggcaggcaggggcagcaagatggtgttgcagacccaggtcttcattttctctgttgctctggatctctgttactacaggtgccgtacggggacatcgtgatcgacccagtctccagacctccctggctgtgtctcgtggggcgaggacgggccacgatacaactgacaacgtccaggccggtagttgttttacacaactaccaaagtaactaagtagtttcttagcttacggtaaccagaccaacgaaaccacgaacacgtccctacgtaagctcgtccttacggtttacgtcgggtaccctaccggtacccgggaacgtccccggggtacctacggaaccgtatcgaggtcgggcggtcgggtcgtcgggactagtacgttcacgtctacacctatcgagcgacgtccgtcgggcggtactaggagtagttgggtcggttacggtttacttcgtgtacgacgtcgtaagtttattagttacgtttacctccttactacggtttaggttacggaccgtaacgggacaaggtcgtaggagtcgtcgacgacgtacgtagnggtctcgctacc

SEQ ID NO: 116892 - DNA, 943 bp, Homo sapiens
  misc_feature: GYAE6OF01B9SRL.36.35.D02.1.454.CMB.1.raw
tcagtacgctgtctcacgaccggtgctcgatttagcacacgatagttgggtttgggggagagaggagcccagccctgggatttttcagggttgttttctatttggttgatcaggactagaacaagagagaactacaccaatggtaggtttgggtcgtgagcgtggttctttttcttttggtggtacttaattttaaaacggttactcctgtgaacgtcctctggtattcctaccttagtacaagtgtcgcctatgtccgtcgggtcccgccgacggcgtccgagggggaaggggcgtgggaggtgggtcttcgtagtttattaggtggttaggtaggttaaggtagacgacgtagtaacttacgcgagtaccgtcggtaggaacgggccgtccttacaccctactcctccaagactaccttatacccgaagacctcaactttcctagttaactctacgtaacgaaaatacgaaaccgacgtaccggtaggtaacgggtacccgaacccgggaacggggtacccaaccccgggttaccctttaaatttaacggttttaggtttacggtaaccgggttaaacgggaaagggggttttacggggggtaggggggggggtttaaaccgggggttccgggggttaccgtttacccgtttaccccggggtttgggggttttaccggttttttaaccggggaccggttttaaacccggggtccgggggggtaaccgtaacggggggttcccccggttacccgggttcccgggttaacccgtaccccggtttacccgtcccccgttacgccccggttaccccgtaaacccccggtaaaccccgggtaaccggggttaccccccgtccccgtttccccggggtttccccccctttcccccggcccgggggttcccctcccccggtaaccgtcccggtaccccggaaccgggg

SEQ ID NO: 116893 - DNA, 679 bp, Homo sapiens
  misc_feature: GYAE6OF01CSKUP.36.35.D02.1.454.CMB.1.raw
  modified_base (344)..(344): a, c, t, g, unknown or other
  misc_feature (344)..(344): n is a, c, g, or t
  modified_base (461)..(461): a, c, t, g, unknown or other
  misc_feature (461)..(461): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacagtcgtgatcgacccagtctccagacctcccgtggctgtgtctcgtgggacgaggagggccacgatcaactgacgaacgtccaaggccggtagttagttttaactacaactacaaagtaaataagtacggtttactttacgacgttgaaccaggacaacgaaaccacgtacacgtcctacgtanctcgtcttacggttacgtcgggtacctccgtaccgggtacgtccgggtaccacggtaacgagttcggaggtcgggtccgggtggtcgtacgggacctagtacttcacgtctacactntcacgctacggccgtcgggcgggtactaggtaacggtagttcgggtacggttacgggtttttatacggttcgtacgaggtaccgttaaggttactttagttaccgtttcttacctacgttacggtttagttaccgggaccgtaaccgggtactaacgggacgttagggactacgaccggtacgtaaacggcggttagtcggtacctgaccgttacccg

SEQ ID NO: 116894 - DNA, 656 bp, Homo sapiens
  misc_feature: GYAE6OF01A28LV.36.35.D02.1.454.CMB.1.raw
  modified_base (251)..(251): a, c, t, g, unknown or other
  misc_feature (251)..(251): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgcaacgtccagccggagttgttttanacaactaccaagtaataagagttctttagctttaggtaccagacaacgaaccacgacacgaccctctaagctgccttcgtttactcgggtccctaccgtacccgggtaacgtcccggggtacctaggaacgtactcgaggtcggccgggtcgggtcgtcgggaactacggttactttcacccgttccttaccaccctacttaccgacgtaccgacgcccgttcgggccgggcgttagaacggtagttcggttgggttacgtttacttcgtagtcgtagtactagtttaagtttactcggtttaacctcctttcgtacgtttacggtttacggaccggttaaacggggtacccgaggttcgtaggacgtacgttccgactaacgtacgtcggtagtctcgctaacg

SEQ ID NO: 116895 - DNA, 831 bp, Homo sapiens
  misc_feature: GYAE6OF01A60ED.36.35.D02.1.454.CMB.1.raw
  modified_base (825)..(825): a, c, t, g, unknown or other
  misc_feature (825)..(825): n is a, c, g, or t
tcagtacgctgtctcacgaccggtgctcgatttagcacacgatagttgggtttgggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggcccacgaatccaaacgtgacctaaaggtcccaaggcccgggtagtttcggtttttaaactaaccgaaaaccttcccaaaggtaaaacttaaaggtaacgttttaccgttttaacggtccgtttaacggtaacccgaacggaaccgaaacggtaaaaccccgaaccggaacctacggtacccctacccgtaaagtccgtaggtacctttaccggttttaaccggtccgggtaccctacccgttaaccccggggtaaacttcccgggggtaccctacggtaaccgtactttccgaggttacgggcggtccgggtaccgtacggggtacacggttaactttaccgaccttacgtaccaacctacgttacccaagggtacccctaaggtaccccgtcgggtaccgggacttacggggaaaacttagttcggttacgggtttaccgggttttaattaaccgttcggtacgtagaccgttaagttacgtttaattccggtttaacctcccgttaacgttaccgtttacggtttaccggaccggtaaccggggtactaaaccggtcgtaagggtacctacgtcggacccttaacggtaaactcgggtcgaccttgctaacccggtntacccg

SEQ ID NO: 116896 - DNA, 867 bp, Homo sapiens
  misc_feature: GYAE6OF01BEOT3.36.35.D02.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagtacgctgtctcacgaccggtgctcgatttagcacacgatagttgggtttggggagctctgagagaggagcccagccctgggtattttcaggttgttttcatttggtgatcaggactgaacagagagaactcaccagtggtaggtttgggctgagcgtgttcgttttcgtagtggtacttaagttttaaaggtgtacgngtgtggtaggtgangctgcgtggtggtcggtaggggngtcgttcggtacgcggggtccgggggtccctggacgtctcgtccgtgtacgacgtccgtcgtcggtacttccgtaccgtttagaacgtagtcgtacgtctacgtccggtaccgtcgggtacccgccggtacggtaccggaccgggtaggggtacggcggtagggtcgtcggtacttagttaagtttaggttaggtaggttaggtaggttacggtagtaccgtacgtaggttaacgtaaccgtacgtaaccggtacggtacggtaacgggacccgggttacccggttaccaacccgttacttaccgtacgaaggtaccctaaaccttaacccgtaacaacgtaccggacccgttacggttaactttacgtttaccggtacgtaaaccctacgtaaaccgttaacgtaacccggacccgttacgggaaccgggtaacggtaaacccggggaccgttaacgggaaccgaccggttaaaacccttaagttaccgtttaaacggtttacggtttaccggttaaacccgtttaacccggtttttaaacgttttccgtttaaacggggtttaacgtttcctttaacccgttaacccccggtttaaccggtttaacgttccccgggtaaacccggg

SEQ ID NO: 116897 - DNA, 717 bp, Homo sapiens
  misc_feature: GYAE6OF01DA8PZ.36.35.D02.1.454.CMB.1.raw
  modified_base (166)..(166): a, c, t, g, unknown or other
  misc_feature (166)..(166): n is a, c, g, or t
  modified_base (216)..(216): a, c, t, g, unknown or other
  misc_feature (216)..(216): n is a, c, g, or t
  modified_base (394)..(394): a, c, t, g, unknown or other
  misc_feature (394)..(394): n is a, c, g, or t
  modified_base (459)..(459): a, c, t, g, unknown or other
  misc_feature (459)..(459): n is a, c, g, or t
  modified_base (486)..(486): a, c, t, g, unknown or other
  misc_feature (486)..(486): n is a, c, g, or t
  modified_base (520)..(520): a, c, t, g, unknown or other
  misc_feature (520)..(520): n is a, c, g, or t
  modified_base (651)..(651): a, c, t, g, unknown or other
  misc_feature (651)..(651): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctcgtggtatctctagttactacgaggtcgccgtacggggacngtcgtggatcgaccctagtcctaccagacctccgtggctgtcgtctcggngggcgaggacggacctagaacgtcaacgtcgacgtacgtccgaggtcggtaaggtttagttttaaaccaacctaacctaaacgtaaagtaaacgttaacgttacgtttacgtttaacgccggttaggtaaccaacgtaccgaaacgaaacccgtacggaaccaccgtcctaacgtacncgtacgtccttagttacgccggtcctaaccggacggtaccgtccgggtaccaaggactggtacgnggtcgggcggtacggtgtacgggaacncgtttactcacccgttcactaccgatacacgacncggtcgtacggtcggagttaggaatcgggttagcgggtttagtttacgtacgtgtccgtaagtcgtagttacgttacgttaccgttaccttcgtaacgttaagttccggttacgggaccggtaacgggtanacgggtacccgtaggtaaccgtcgtaacccgaagttaccggtacttaggacgttcgacgcgttacg

SEQ ID NO: 116898 - DNA, 744 bp, Homo sapiens
  misc_feature: GYAE6OF01BE7KQ.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctcttgttactacgaggtgccgtacggggacagtcgtagactcgaccctagtctccgagtacctcccgtggctgtctcgtcgtgggacgaggacgggaccacgtactacaacgtgaccaacgtccgaggccggtagtttacgtttaacaacctaaactaccgaaagtaaagtaaacgtagtttcctttaaggaccgtttacgggtaacccagaccgtaaagaaaccctacgaacgccgtacccttacgtaagaccgtgtaccgttcgttacgtcggtcccgttaccggtaaccgggtacgtcccgggtacctagtaacgtgttcggaggtcgggccggtcgggtcgtaggacagtcttacactctccaacctgacgtacgcgtacgtacccgtgggaccggtacgtagtaacggtaggtcggttaggtttaccggtttattacgtacgtacgtaggttacctaagtttacgttagttaccttaaccttcgttaccgttaccgttacgggttcggacccgggtaaccgggtaacgtacgggtacggtacggtaacggtaccgacccggtaaccggaaccgttaggtccggttacggtctaccggtacctaccgg

SEQ ID NO: 116899 - DNA, 645 bp, Homo sapiens
  misc_feature: GYAE6OF01D05Z2.36.35.D02.1.454.CMB.1.raw
  modified_base (181)..(181): a, c, t, g, unknown or other
  misc_feature (181)..(181): n is a, c, g, or t
  modified_base (256)..(256): a, c, t, g, unknown or other
  misc_feature (256)..(256): n is a, c, g, or t
  modified_base (312)..(312): a, c, t, g, unknown or other
  misc_feature (312)..(312): n is a, c, g, or t
  modified_base (477)..(477): a, c, t, g, unknown or other
  misc_feature (477)..(477): n is a, c, g, or t
  modified_base (636)..(636): a, c, t, g, unknown or other
  misc_feature (636)..(636): n is a, c, g, or t
tcagtacgctgtctcacgaccggtgctcgatttagcacacgatagttggggtttgggggagctacaacaggcaggcaggggcagcaagatggtgttgcagacccaggtcttcatttctctgttgctctggatctctgttactacgaggtcgccgtacgggacatcgtgatcgacctagtcnccgagcctcctggctgtgtctcgtgggcgaggcgggccagatacgacgtcgactaacgtccgaggtcgtagtttnttaacacctaactacgaaagtaagtacgtagtttactttacggtcttacggaccgngtacgaacgaaccacgacgacgtcctaccgtacggtcttagtccgttacgttacgtccggaccgttaccggtaccgggtacgttccgggtacctagtaacgtacttacggaggtcggcgggtcggtacggtacggactacggtactttccacgttcactaccgtntacgacgcacgtcgtcggcggtcgagtacgtcggttgtcggttactttacgtctacggtacgacgtactaagttacgttacgttacttccgtactacgtacgttcggtcgacggtacggacgtacgtcgagactcgacggacacggtacgtcgcggtcncgtcgtacg

SEQ ID NO: 116900 - DNA, 778 bp, Homo sapiens
  misc_feature: GYAE6OF01CQKN2.36.35.D02.1.454.CMB.1.raw
  modified_base (236)..(236): a, c, t, g, unknown or other
  misc_feature (236)..(236): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagcgtggtctttttcttgtggcttaattttaaaggtctcctgtgaagcctctggattctacctttgacaagtgtgccatgacctgggtccncgaggcctccggaggggaaggggctgggaggtgggtctcgtagtttattaggtggttaggtggtagtagcaacgagtacgttacgcagtaccgttccggtaggaacggggtcccgttacaaccgtacttccgtaccgaaggaacgtaacctaaacgttacccaaagaccgacctaacgtcgttacgttaacgtttcggaacctaacgtacgtaacgaaaccgtacggtcccgtaaggaacggtaccggacccgggaacggtaccgaaccgggaccttaagttaacgttaatttaacgtacggttacgtaaccgttaaacgttttccgtttagacgtttaggttactttactacccgttagtacgtacccgtacggtaccgggaccgtaaccggtaacccgttcggtaccgttacccgtccgtcccgtaccgtaccgtaccccgaccgaaccggaaccggtccctaccggttccccggttccccttccccgtacgaccccctaaccccgttacccaaccggtaaccgccggccctaacccggg

SEQ ID NO: 116901 - DNA, 1020 bp, Homo sapiens
  misc_feature: GYAE6OF01CV44N.36.35.D02.1.454.CMB.1.raw
tcagtacgctgtctcacgaccggtgctcgatttagcacacgatagttgggtttggggacaacaggcaggcaggggcagcaagatggtgtgcagacccaggtcttcatttctctgttgctctggatctctgttactacgacggtgccgtacggggacagtcggtagactcgaaccccgtagtccctaccgaacgtaccccgttccccgtggtaccgttggtcggttaccctcgggtcgggggacggaacgggaccggggtacccaacggaacgttaaccaacggtacgaaccgtaacggtcccggaagggttaccgggttattttacggttttaaaccaaccgtaaaaaccgttaccgtaaaaaaggtaaaagtttaaaggtttaccggtttttaccgttttaacgggtaccgttttaaccggggaaaccctaagaaaccgaaaaccgggtaaaaaccccacggaacccgttaaccgtaccccttaacgtaacggccgttacgttaccggttaccggttttaaccggcccgggtacccttaacccggggtaaccgggtacccggttacccggggtaaccctaggtaaccgttacgtaccggaggggttccggggacggggtacgggttcgtaacggggacttaaaacgggtttcctaaccgtaccgttacccgtaacccgtaacgtaccgtaccgacgtaacccgaccggtccggtaaacgggtccggtaaacgtaacgggaaaccgttggggtttaacggttacgggtttaaccgtttaacgtacgtacggtaccgtaacgttaacggttaacgttttaacgttaacccgggttccttaaaccccggttccccgtttaaggttaaccgggtttacccggggttaaccgggaacccggggtaaaagggtaccccctaagggtacccgtagggtaaacctacgggaccgtaaacgggtaccccggttaaagggttcggaacccgggttacttaaccggccccctaaagttccgtttacccgg

SEQ ID NO: 116902 - DNA, 778 bp, Homo sapiens
  misc_feature: GYAE6OF01B44V3.36.35.D02.1.454.CMB.1.raw
  modified_base (270)..(270): a, c, t, g, unknown or other
  misc_feature (270)..(270): n is a, c, g, or t
  modified_base (475)..(475): a, c, t, g, unknown or other
  misc_feature (475)..(475): n is a, c, g, or t
tcagtacgctgtctcacgaccggtgctcgatttagcacacgatagttgggtttgggggagctacaacaggcaggcaggggcagcaagatggtgttgcagacccaggtcttcattttctctgttgctctggattctcgtggtgccgtggcggggacagtcgtgatcgacctagtcctaccagaccttcccgtggctgtcgtctcggtagggcgagcggcccactataccaactcggacgacggtccacgccgaggttacgttacgttttanacgtacgtaccttaaccaaataaaacgttaaacgtaaaccgttaaaccttttaacgttacggtaacccgaagaccgtaaaccggaaaccgacggaaccaccgtcccttaacctaacgtcgtacctacgttacgtttacgacggtacctaacgttacccggtacccggtaacggttcccgggtaccgtacgaacgtacgttacggnggtacggacgtacggccggttgacggagtacgttacttacgctacccactacctaacgtcacgtaccgacctccgtacgcgtacggtactagaacgtggttccgttaggtacgttttaacgtttacgttacgtacgtacgtaacgtaaccgtttaattaaccgtttaaacgtcgtttaacccgttccgtaccgtttaccggttaacccgggttcggggaaccgggtaacgggtaacggtaacggggtaggtaacgttaaaccgaacgtaaacgggtactccgggttacgaccgtcgtaacccg

SEQ ID NO: 116903 - DNA, 908 bp, Homo sapiens
  misc_feature: GYAE6OF01A3MG0.36.35.D02.1.454.CMB.1.raw
tcagtacgctgtctcacgaccggtgctcgatttagcacacgatagttgggtttgggacaacaggcaggcaggggcagcaagatggtgttgcagacccaggtcttcatttctctgttgctctggactctctgttactacgaggtcgccgtacgggacatcgtgatcgacccagtcctaccacgtacctcccgtggccttgtcgtctcggtgggacgaggacgggaccacgtactacaacgtgacctaacgtccgacggtaccggttagttttagttttaaccaacctaaccttaacgaaaagtaaacgttaaacggttacgtttactttaacggtcgttaacgggtaaccagaccaaacgtaaaccgtacggaacctaccggtacctaacgtacgtccgtcgtaccgtttacggttacggtaccggtacccgttaaccggtaacccggggtaaccggttcccgggtaccaacggtaaccgtacgtttacggagggtccggggtaaccgggtcggttaccggtaacgggacttaacgggttacctttaccgtaccctacgttacccgaacctacgtaaccgtacgtaccgacgtcccgggtacgggtaccggttacggaacggtaaaggttcgggttagggtttaccccgggtttaagtttaccgttaccgttacggtaccgtaacgggtttaaccgttaggttttaaacccttttacgggttacccttaacccgtttcccggtaattttaaccggggtttaacccgggtacgggttaacccggaaaccggggtttaccaaacgggtttcccggaagggtaacccttacgggaccgttaacccggtaaccggtaccggtttaacgggttcccggaacgttaccggaaccctttaggtaccccggttttcg

SEQ ID NO: 116904 - DNA, 788 bp, Homo sapiens
  misc_feature: GYAE6OF01CM2FX.36.35.D02.1.454.CMB.1.raw
tcagtacgctgtctcacgaccggtgctcgatttagcacacgatagttgggtttggggagctacaacaggcaggcaggggcagcaagatggtgttgcagacccaggtcttcatttctctgttgctctggatctctgttactacgaggtgccgtacggggacagtcgtgatcgaccctagtctaccagtacctcccgtggctgtcgtctcgtgggcgaggacggccacgactacaacgtgacgacgtaccgtacggtccggtagtttgtttaacaacaccgttacgaaagtaagtaacgttagtttacgtttaacgtcgttacggaaccgtacgacgtaaacgaaacccgtacgaaccgtacgtaccctaccgtaagccgttacgttccggtttacgttaccgtcggtacccttacgggtaaccggaccggttcccgggtacctacggaacgttacgttcggacggtccgggtcgggtccgggtacggtacggaccgtaaagtcctttaaccgacctttcgaccgtacgtcgtaaccggactaccgacgggtaccgtcggtaccgggacttaaggaagttaccggtaggttacggttttaccggtttagttaccgtaccgtacgtaacgttcgttaaacggtttatttacgttccgttaaccttccccttaagtacggtttaccggttcgggaaccgtacgggtacctacggtcggttaacggacttccggcggtaaaacccgtcggtaaaccgtttggggaacccttccgtaggtaaccccttaaccgg

SEQ ID NO: 116905 - DNA, 892 bp, Homo sapiens
  misc_feature: GYAE6OF01APXXM.36.35.D02.1.454.CMB.1.raw
  modified_base (223)..(223): a, c, t, g, unknown or other
  misc_feature (223)..(223): n is a, c, g, or t
tcagtacgctgtctcacgaccggtgctcgatttagcacacgatagttgggtttggggacaacaggcaggcaggggcagcaagatggtgttgcacgacccaggtcttcatttctcttgttgctctggatctctgttactacgaggtcgccgtacggggactagtcgtagtactcgacctacgtcctaccacgtaccgttcccgtgtcttgtcgttccgttcggngggcgaaggcgggaccacggtactactaacgtgacctaacgtccgacggtaccggttacgttttagtttaaactaaccgtaaacgttaccgaaagttaaaacgttaacgtttacgttttaccgttaacggttccgtttaaccgggaacctaacggtaacctaaaccgaaaacccggaccgtaacgttaaccggtcccttaaccgtaagttccgttacgttccgttttaccggtttacggtcccgggtacctttaaccccgggtaacccggttaccgggttacccgggtaccttaaggtaaccgttacgttaccgggtacgggttacggggtccgggttacgggacggtacgggtacttaacgtttaccttccgtaacttccgtactaacccgatacgacggtacccgcgtacccggtcgggacggttacggtaagtaacggttcggttacgggttacgttttacgtttaacgttcgtacggttcacggtttacttaacggtttctttaacgggttccttacctttaacgtacggttttaaccggttacggttaccgtaaccggggtaaccgtaacgtcgggtaacgggttcaaaccggccgtttaaaccggtcgttaacccggtggttaccggtacggaccttaaccgtcccggttagtccgttacccg

SEQ ID NO: 116906 - DNA, 928 bp, Homo sapiens
  misc_feature: GYAE6OF01DS054.36.35.D02.1.454.CMB.1.raw
tcagtacgctgtctcacgaccggtgctcgatttagcacacgatagttgggtttgggggacgctacaacaggcaggcaggggcagcaagatggtgttgcagacccaggtcttcgatttctctgttgcctctcggatctcctgtactacaggttgacctacggggacatcgtgatgacccagtcctcagacctcccgtggcctgtcgtactcgtgggccgtaggacgggccaacggatactaaccgtggtaccaacggtcccaagggtaccgggtaagtttacgtttttacaacctaaacgttcccgtaaaaggtaagttaaaaccggttacgttttaccgtttttaacggtccttttaacggggtaaccccgtaacgaccgtaaccgggaaaaaacccttacccgggaaacctaacggggtacccccttttaaccgtaaaaccggttcccgttacggttacccggtttttaccggggtttttaaacccccggttcgggggtacccccgtttaaccccggttaacccccgggggaaccgtttcccggggggttaccccctttaaggggaaaccctttacccggtttacgaaccggggttacgggggtccggtaaccggggttccggtaaccggggggtaaacctacggggtaacctttttaccacggtttaccctacgtaacccgacgttaaccacggtaccgtaccgtccggtacgggtaccgggtaaccgtcgggaacgtacgttacgggttacgggttaacggtttttaaccgtaccggtttaccggtacgtaccgaacgtttacgttaacgtttccgttacggtttaaccttccgttacgacgtttacggttaccggagttaccgggactacggtaacgtgtacgttacgcgtagaccgtactaccgtggaactcgtaccgtaccg

SEQ ID NO: 116907 - DNA, 625 bp, Homo sapiens
  misc_feature: GYAE6OF01D03Z5.36.35.D02.1.454.CMB.1.raw
  modified_base (146)..(146): a, c, t, g, unknown or other
  misc_feature (146)..(146): n is a, c, g, or t
  modified_base (325)..(325): a, c, t, g, unknown or other
  misc_feature (325)..(325): n is a, c, g, or t
  modified_base (415)..(415): a, c, t, g, unknown or other
  misc_feature (415)..(415): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
  modified_base (582)..(582): a, c, t, g, unknown or other
  misc_feature (582)..(582): n is a, c, g, or t
  modified_base (588)..(588): a, c, t, g, unknown or other
  misc_feature (588)..(588): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctcttgttactacgnggtcgccgtacggggacatcgtgatcgaccagtcctcagtacctccgtggtctgtcgtctcgtggggcgaggacggccacgataccaactggacaacgtccgaggccggtattgtttacaacaacctacaaagtaataagtcgtttctttagcttacggaccagacaaacgtaaacccngaaccgcgaccctacaaggtctacgtccgttacgtttacgcggtaccctccggtaaccgggacgttcccgggacctagaacgtcttacgnggtcgggcggtcggtcgagctagttacttccactccgtacactacncgacgctacgcgtacgggcgtntaggattgtggttgtttacgttntacgtgacgtagtacttagttacttntccgttacttcctgtacgtttggtaccgacggacggtaagacgtcggtanacgggntacccggagaacgttcgtaggtccggactgtccgtac

SEQ ID NO: 116908 - DNA, 738 bp, Homo sapiens
  misc_feature: GYAE6OF01EINVH.36.35.D02.1.454.CMB.1.raw
  modified_base (684)..(684): a, c, t, g, unknown or other
  misc_feature (684)..(684): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctggagtcggtgggggagcgttggtacgacgggtcccgggggggtccctggacggaccttcgttcccgttgtaggaacgtcccttcgtgggtactttacctaacccttttgaacctaaggtgtacgacctagtcgtaccgtcgggtcccgccgaggtccgtaccggaggggaacgggcgtggagtcggtctacgtagttagttaggtaggttacgtggtaagtagcgtacgagtatacgcgagtaccgtcggtaggtaacgggtcccgttacgacctacttcctaccgaaggtactaactaaacgttacccaaacgacgaccgtacgttacgttgttacgtttcgactaacgtacgtacgaaacccgtacgtacccgaggtaaccgtacggacccggaaggacccgaaccgggtacctaagtacctttaagtttacgttacggtacgtaacccggtttaaaccttttccggtttaanaccggttttacgtttaaccttacccgttccccgtttaaggtcccggtaacccgg

SEQ ID NO: 116909 - DNA, 775 bp, Homo sapiens
  misc_feature: GYAE6OF01BD1LC.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagttgggctgagctggtctttttcttgtggtcttaattttaaaggtgtccagtgtgagtgcagctgcgtggagtcggtggggaggtcgttggtaccgcgggcccggggggtccccagacctcgtaccgtgtacgacgccctgtcggtacttctaccttagacgaagttgtacgaccgtagtcggtcccgtacggggtcccgaccgtacggaccgtaccggtaacgggggaacgggtcgtagggaaggttcgggttccgttacgttaaggtttacgtttaagggtcgggttaaggtagggttaaggagtacgtacgtaagttacgtacggactacgtaccggttacgggtaacggtacgggtcccgtactaaccgtgttacccaacgaacgtactaaacgtaacctaaccaagtaccgaccgtacgtcgttacgtttagttcgacgtaaacgtacgtaagtaaccgtccgacgtaacggacggaaccggtacggaaccggaaccgtccgggtaaataccggttaatttagttaacgggttacgtaaccgttaccgtttaactttccggtttaacttacggtttaaacgtttaccgttacccgtaacccttacggtaccggaaccgttaaccggggg

SEQ ID NO: 116910 - DNA, 925 bp, Homo sapiens
  misc_feature: GYAE6OF01BN7ID.36.35.D02.1.454.CMB.1.raw
  modified_base (277)..(277): a, c, t, g, unknown or other
  misc_feature (277)..(277): n is a, c, g, or t
tcagtacgctgtctcacgaccggtgctcgatttagcacacgatagttgggttggggacaacaggcaggcaggggcagcaagatgggtgttgcagaccctaggtcttcatttctctgttgctctggatctctgttactacgaggtcgccgtacggggacatcgtgactcgaccctagtctaccagtaccctccgtggtctagttcgtctcggtcgggcgaggacgggaccagactacaactgacgaacgtccgaacggtcggtaagtttcgttttaanaaccgaacctacgaaagtaactaaagttcgtttacgttagtcgttacggtaacacgtacaaacgaaaccgaaccgacgtacgtaccgttaaccgtaacgtccgtagttaccgtttaccggttacggtccgggtacccttaccgggttaaccccggggtaacggttccccggggtaaccgtacggtaaaccggtttacgtcggtaaacggggttcccggggtaccggggtcgggttaccggtagggtaaccgtacggtttaaccttaccggttaaccttacccgtacccgtaacgtaaccgtaccggacggtacccgtaaccggtcccggttacggggacccggtagttaaacggaacggttaacggttcgggttacgggttttacggtttaaccgtttaccgtacggtttaaccgacggttaacgttaacggttttaacgttttaaccggtttacgtttaccccgttttaacccgttaccggtttaacccgtttacgggttttaacccggggaaacccgggtttacgggggtaaacctaaaccgggtcgggttaacgggtaaaccgttacgtaccccgggtaaacgtaaccggttaaccggtgggttacccgtacgttaccggaaacccttcggttaacgttccccgg

SEQ ID NO: 116911 - DNA, 657 bp, Homo sapiens
  misc_feature: GYAE6OF01DKVXD.36.35.D02.1.454.CMB.1.raw
  modified_base (257)..(257): a, c, t, g, unknown or other
  misc_feature (257)..(257): n is a, c, g, or t
tcagtacgctgtctcacgaccggtgctcgatttagcacacgatagttgggtttgggggagctacaacaggcaggcaggggcagcaagagtggtgttgcagacccaggtcttcatttctctgttgctctggatctctgttactacaggtcgcctacggggacatcgtgaatcgaccctagtctccagactcctggctgtgtctcgtgggcgagacggccagatcaactgacgaacgtccgaggccggtagttgtttanaacaactcaaagtactaagtcgtttactttagcttaggaccaggacaacgaaaccgagaacacgtccctaaccgaagtcctcgtacttcggttttaacgcgggtaccctccgtaaccccggggtattccccggggtccaggtaacctagttccgaggttcgggccgggtacgggtctacggggaactagttaccgtttacacctacgtaccaacctagtccgaagcgacgtaccggtggaccgggtatagggaagtacgttggttcggttaggttttacttacgtactcgagtctaagttactttagttacgttacctcgtactacgttaacggttcggaccgaaggggtaaccaggccgtaggacgactaccgcaacgtgtacgtaggctcgcctaacg

SEQ ID NO: 116912 - DNA, 757 bp, Homo sapiens
  misc_feature: GYAE6OF01AKVU4.36.35.D02.1.454.CMB.1.raw
  modified_base (365)..(365): a, c, t, g, unknown or other
  misc_feature (365)..(365): n is a, c, g, or t
  modified_base (637)..(637): a, c, t, g, unknown or other
  misc_feature (637)..(637): n is a, c, g, or t
tcagtacgctgtctcacgaccggtgctcgatttagcacacgatagttgggtttggggagctctgagagaggagcccagccctgggattttcaggttgttttcatttggtgatcaggactgaacagagagaactcaccatggtagtttggctgagcgtgtcgttttctagtgcttaatttaaaggtgtcagtgtgagtgcagctgcgtggagtcgtggggagtcgttggtacgcgggtccggggtcagacgtctcgtcgtagtagactccgtcgtagttacttaccgtacgttagaacgtagtcggtcacctacggtccgtccggtaccggtcccgacgtacggtaccgacggggaggggtacggngtaagggtcggttcggtacgttagttacgttagttggtagttggtaggtaagtacgacgtaagtagttacgacgtacgtaccggttaccgtcgggtaacgggtaccggttacccgttacacgtaccgttaccaacgaaggtacctaaaaccgttactaaccgacctacgtaccgtaccgtttagttacgttacgttacaacgtttacgtaacgaaacgtacgtaccgtccggaagtaaccggcggaaccggacgtaacccgacccgtaagtntttaaagttaccggttagttaccgggtaacccttttaacgttaaaccgtttttcggttaaacttacgggttttaaccctttaaccggtaccccgtacgttaaggtcccctaaaaccgggg

SEQ ID NO: 116913 - DNA, 836 bp, Homo sapiens
  misc_feature: GYAE6OF01DDH34.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatcgacccagtcctcagactccctggctgtgtctcgtgggcgagacgggccaacgtatcaactgacaacgtccgacggtccggtagttagttttacaacaactccgaaataagtaagtctttacgtttagcgttagtaccagacgaacggaaacccacgtaccagtacccttacgtaacgccgtagtccgttacggtttaccgtccgggtaccccgtacccggttaaccccggggaaccgttccccggggtaccccttaggtaaacccggttacgttaccgtaggggtacggggtccggggtccgggttcggtaacggggtaccttaaggttaccgtttccgtaccttacccttccggaaaccctacgttaccacgggtaccaaccgggttccccggtaagggcccggggtactaacgggtaaggttagtttacggggtttacgggttacggttttttaaccttagcggtttaccgtaaggcctttaaaggtttacccgtttattaccgggtttacccttcccgttaaggtttaccggtttaacgggttttacccggggaaccccgggttaaggggaaccttaaacgggcggttaacggggagtaacccgttcccgggaaaccctaacgggtttaacggttcgggacgttccccggtggtaccctaacccg

SEQ ID NO: 116914 - DNA, 770 bp, Homo sapiens
  misc_feature: GYAE6OF01ES7NH.36.35.D02.1.454.CMB.1.raw
  modified_base (160)..(160): a, c, t, g, unknown or other
  misc_feature (160)..(160): n is a, c, g, or t
  modified_base (181)..(181): a, c, t, g, unknown or other
  misc_feature (181)..(181): n is a, c, g, or t
  modified_base (227)..(227): a, c, t, g, unknown or other
  misc_feature (227)..(227): n is a, c, g, or t
  modified_base (263)..(263): a, c, t, g, unknown or other
  misc_feature (263)..(263): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggaggtttgggctgagcgtgtntttctgtggctatttaaaggntcagtgtgagtgcagctgcgtggagtcgtggggagtcgttggtacncgccggtcgggggtccctaggagccttcgtcctgtncgacgtcctcgtggacttcaaccgtttgcagtctatgcctatcgtacctgggtccgccgacggactaccggagggtaaggccgtggaacggttggtccgttcgtattacgttaggtggtagggttaggttaggttaactaaaccgaaacgttaccgacggtacccgtaccgtaccggttaggaacgggtcccgtccgtttacctacccgaaccttcgttaccccaaggaaccgttaacttacgttaaacccaacgggtactaccggtaaccttaccgttaggtactttacgacgtaaagtaaaccgttaacgaaccgtaacgtaccgttacggtaaacggttaccgtacccgggaacgggtacccgttaacccggtacctttaaaacgttacgttttaccgggttagttcccgggtaaaacggtacggggtttagggaacggggggggttaagggttccggggttaaaccgtttcccggttaacccgggttccgggttttaacccgg

SEQ ID NO: 116915 - DNA, 636 bp, Homo sapiens
  misc_feature: GYAE6OF01C6KFE.36.35.D02.1.454.CMB.1.raw
tcagtacgctgtctcacgaccggtgctcgatttagcacacgataggtttggggtttgggggagctacaacaggcaggcaggggcagcaagatggtgttgcagacccaggtcttcatttctctgttgctctggatctctgttactacgaggtgccgtacggggacatcgtgatcgacccagtcctccagaccttcccgtggcttgtgtcgtcgtgggcgaggacgggccacgatcaactgacaagtccagcggtagttgttttacacgaactacaaagtaataagtagtttcttagcgtttacggaccagtacaacgaaaccacgacacgcctacagctgtcttcgttacgcggacctcgtaccgggactccgggtacctgaacgtcttcgaggtcggcgggtcggtcgtacggactagtacttcgacctctacactactcacgtacacgtcgtcgcggtacgtaggagtacggtggttacggtcgttttaacttcgtagtccgtacgtcttaagttaacgtttagttacgttacttaccttacgtacgtttaacggtttcggacggtaacgggacctacgggtacgtaggtactacgtacgacgtaacggtacgtacggtcgcgtcgaccgtaccg

SEQ ID NO: 116916 - DNA, 801 bp, Homo sapiens
  misc_feature: GYAE6OF01AJGNW.36.35.D02.1.454.CMB.1.raw
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtcgccgtacgggacagtcgtgatcgaccctagtcctcgaacgtcctccctggcttggtcgtcgtcggtcgggacgaggacgggaccacggtataccgtaacgtgaccgtaacggtacccgaggtacccggttagttacgttttaacgtaaccgtaaccttaacccggaaagttaaacgtaaggtttacgttttacccgtttaacggtccgtttaacgggtacccaaggtaccgaacggtaaaacccgaccgaacccgtaccggtacccttacctaacggtccttacgggtccgtttacccggtttacggttccgggtaccccgtaccgggtaaccggtaaccggttccccgggtacctagggtaaacctagttccgtaacgggtccggacggggttaccggcgttacggaacgttacggttacttccgtaaccgttcacgtacgactacgcacgtcgtacgtgtcggtacgtcggaagtcgaggttcggttacgttacgtacgttgtacgacgtacgttaagttaccgttattaaccgttaccgttccctaacgttacgggttaccggtttaccgacggtaacggaccacggtacgtcggtacgtagtaccgtaccgtacgggtacttacggttcgacaccggtaactcgttaacgttcg

SEQ ID NO: 116917 - DNA, 793 bp, Homo sapiens
  misc_feature: GYAE6OF01CAROL.36.35.D02.1.454.CMB.1.raw
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
tcagtacgctgtctcacgaccggtgctcgatttagcacacgatagttgggtttgggggagagaggagcccagccctgggattttcgaggttgttttcatttggtgatcaggactgaacagagagaactcaccatggagtttgggctgagctggtctttttcgtgtggacttaatttaaaacggtctcctgtagaacgcctctggtattctaccttgacagtntgcagtgaccgtggccgccgagcctcgagggacggctggngtggtctgtagttagttagtggtagttaggtagtacgacacgtagtacgttacgacgagtaccgtcggtgggaaccgggtcccgtccaaccgtacttcccgtaccgaagtaacgaaacctaacgtttaacccaaaacgccgtaccgaccgtacgttagggtttaatttcgaccgtaaaccgaacgttaacgtaaacccgtacgggtacccgttaggaaaccggcggaaacccgggaacggaacccgggtaacccgaaccgttaaaccttagtttaaacctttggttaagtacggttaaaccctttaacgttttacccgttttacgtaagtttacggttttactttaccgttaccccgttagtaccgtaacccgacgggttaccggacccggtaacccgggtacccgttaccgtaccgttccgttaccctccgtaccacccgcccgtacccaccggaaccggcccgtacgttccccgtcccgttccccgtacggtcccctccctacctaccgaacgtccgtacccgtacggg

SEQ ID NO: 116918 - DNA, 892 bp, Homo sapiens
  misc_feature: GYAE6OF01BEHLZ.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagctgcgtggagtcggtgggggagcgttggtacgcgggcccggggggtcctggacgacctctccgtgtcgaacgccgttcgtggtacttcctacctttgaaccgtaagttcgtacggccctatccggtacccggttcgggggtaccccgcccgtacgggtacccgtacccggggaacggggggtaacgggggtccggttagggggtacgggtttaggggggttccctttacggggtaaaggtttttaaggtttagggtttacggggtttaaggttaggggttaaacgttacggtaccgaaacggtaacggtaaacgttaccggaccgtaacggtaccgttcccgggtaagggtaacccgggggttccccggttaccgaccccgtaactcccgtaacccgaacggtaacgtaaaccctaaaccgtttaccccaaaccggacgacccgtaccgttacgttacgtttaacgtttccgacctaacgtaacgtaacgtaaaccgtacgtacccgtacgggaagaaccccgggaccggaaaccgggaacccggaacccgggtactaaaccgtttaagttaaattttacgttacggttaccggttaacccggttaaacctttttccggtttaacgttaccggttttaacgtttaaccgtttaacccgttcccgttaacgggtcgttaaccccggg

SEQ ID NO: 116919 - DNA, 926 bp, Homo sapiens
  misc_feature: GYAE6OF01BS34S.36.35.D02.1.454.CMB.1.raw
  modified_base (733)..(733): a, c, t, g, unknown or other
  misc_feature (733)..(733): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaaccagtggtaggtttgggcttagcgttggttctttttcttggtggtacttaattttaaaaggtgttccagttgtggtaggtgacgaggctagcgttaggaggttcggtggggggtagtcggttagggtaccggacgggggtccccgggggggttacctagggacgaccgtttcctacccgttagtacggtaacgtcccttcgtacggttactttaccgtacccgtttttaggaaccgttaagttggaccaccgttaacgtttccgggaccgtttccggggacccccgaccggtaccgggtacccgttaaccggggaaagggggggtaaccgggggtacggtaagggggttcggttacggggttccgttaacggttttaaaggttttaacggtttaggttaggggttaagggttagggttaacggtacgtccgaagtaacggttagttacgacgaccgtaccggttaccggtagggaacccgggttcccgttaccaacgtacttccgtaaccgaacgtacctaacgtaaacccgttaccgaaaccgacgtacccggaacccttggtttaacttacggtttcaacgtaactagtacgaacncggtacgaggtaaccgggacggtaccgaacggcccggtaacgtcccgttaaattacggttttaaccgtaggttttcgtaacccggttaacgttttaaaccccgtttttcggttaaccgttttaggttaaccgtttttaacccttaccccggtttacccgtaaccggttaccgggtaccccggtaaaccggggg

SEQ ID NO: 116920 - DNA, 797 bp, Homo sapiens
  misc_feature: GYAE6OF01C99AJ.36.35.D02.1.454.CMB.1.raw
  modified_base (144)..(144): a, c, t, g, unknown or other
  misc_feature (144)..(144): n is a, c, g, or t
  modified_base (287)..(287): a, c, t, g, unknown or other
  misc_feature (287)..(287): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcacatggagtttggctgngctggtcttttctgtggacttaagttttaaacggctccgtgtgaacgccttgtggtacttcctaccgtttgaactaaggtgtcgccatccgtaccgtcgggtcccgaccgtacggcctccggaggggaacggggtcgtagggnggttcgggtcctaggtaagttttaagttggttacgggttaggtgggttaagttaccggacaaccgtagtaacgttacgaccgtagtaccgttccgggtacgggaacggggttcccgttacaacccgtaatcccgtaccgaagaaacgtacttaaacgtaccccaaagtcgactaaccgtcgttagtttacttcgaaccgtacagttaaccgaacgcgtccgttagaacggtacggacccggaaggtacccgacggtacctaagttaactttagttagttacggttacgtaaccgtttaaacttttccgtttaagtacgtttacgtaacttttcccgtacccgttacgtaccgtacgtaccgggtccggtaacccgtaccgggtacccgtgtccctacccgttcctccaccgtcccgtaccctaccgaccggaccggtacccgtaccgttcccgttcccccgtcccgtaccgcccctaccccttaccaccgaacggtccaccgtccccggg

SEQ ID NO: 116921 - DNA, 890 bp, Homo sapiens
  misc_feature: GYAE6OF01A9DU7.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtcgccgtacggggacatcgtgactcgacccagtcctccagacctccctggcctgtgtctcgtggggcgaggacgggccacgactacaactgacgaacgtccaggccggtagttcgttttaacaacctaactaccaaagtaaagtaaagttagttccttttaaggtccttacgggtaccagccaaacgaaacccacgaccacgtaccctaccgtaacgtcgtacgtccttaccggttttaccgtcggggtacccttacccggttaacccggggacgttacccccgggggtccctaacggtaaaccgttacgttcccgagggttccggggcccgggtaccgggtcgtacgggggtaaccaacggtttacttacccgtaccgtttcctaccgtaaacccctataccggaaccgtccggaaccggtccccgggttacggacccggggtacgttaacgggaaccgttaagggtgggttttaccggggttacccgggttttaacgtttacccgttacgggttacccgaaggtttaccggttaacgttttaacgttttacggtttaccggtttaccccttacccggttaacgttaacccggttttcgggtttacccggggtaacccgggtaaacccgggtaaaccgtaaccgggtccggttaacggggtataacccgggttacccgtaaacgaccccgggtttaaagggtccgggttacggtaccccggttaccgtacccggttaaccccg

SEQ ID NO: 116922 - DNA, 864 bp, Homo sapiens
  misc_feature: GYAE6OF01B12B8.36.35.D02.1.454.CMB.1.raw
tcagtacgctgtctcacgaccggtgctcgatttagcacacgatagttgggtttggggacaacaggcaggcaggggcagcaagatggtgttgcagacccaggtcttcatttctctgttgctctggatctctgttactacgaggtcgccgtacgggactagtcgtgatcgacctagtcctccacgtacctcccgtggtctgtcgtctcgtgggacgaggacggaccacgataccaactcgacaacgtccgacggccggttagtttacgttttaacaaccgtaacctacgaaaagtaagtaacgttacgttttactttagtacgtttacggtaaccagaaccgtaaacgaaacccgaccgtaactaccgtacccttaccgtaagtccgttcgtaccgtttaccggtttacggccggtaccccgtaccgggtaaccccgggtaaccggttccccgggtacctaacggtacgttacgtacggacgggtcggggccgggttacgggtcgacgggtaactacgtttcctttaccgacttaccgtacctaacgtcgtacgacgaccgtaccgtcggttacgggtacggtaccgtaagggtaaacgttcggtttagggtttaaccgggtttaaccggtttaacgtttacccgtaggttaaccgttacgttaaccgttaaggtttttaacctttacggtttacccggtttaacccttccgttacggttaacggtttaccgggtttacccgggtaaaccgggaaccggggttaacgtaccgggttaggtaacgggtaccgtaaccgtaccggtaccgtaaaccgggttaggttaccggtccggtaccgtaccgtacccgttacgttacgttcccg

SEQ ID NO: 116923 - DNA, 788 bp, Homo sapiens
  misc_feature: GYAE6OF01A5ZL3.36.35.D02.1.454.CMB.1.raw
  modified_base (272)..(272): a, c, t, g, unknown or other
  misc_feature (272)..(272): n is a, c, g, or t
  modified_base (370)..(370): a, c, t, g, unknown or other
  misc_feature (370)..(370): n is a, c, g, or t
  modified_base (768)..(768): a, c, t, g, unknown or other
  misc_feature (768)..(768): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacgaggtcgccgtacggggacacttcgtggtatacgaccctgtctcccgaaggtacccttcccggtaggccgttaggtcgtaccgttccggtcgggaccgagggtacgggacccaaccgtactaccgttaaaccgnggaaccaacgtcccgcggtaccgggttagttcgttttaacacctaacgtacctaaaggtaagtaacggtcgttttcgttaacgtacgtttacgaaccngtaaaccgaaccgaactacggtaccaacgtccgttaccctagtaccgtcgtccgttaactttcgaccggtcctaccggtaacccggcggttcccgggacctataccgggatccgggtagtcgggcgtcgggtacgtcggacacgtactttccgcttaccgcgtaaccgacgttacgacgtacgtacgtcccgggtaggtccggtaacagggttaaaccgtggttaccgggttacgttaccgggtttaactccggttaagtcgtaagtcgtaacgttaacgtttgttacgttacccttagtaccgttacggttacggttaccggtaggaacccggtacggtaccgtacggtaccggtaagacccttaccggaacgttacgcgggtaccgtcgaccgtanacccgttagtcccgttacgg

SEQ ID NO: 116924 - DNA, 713 bp, Homo sapiens
  misc_feature: GYAE6OF01C0W47.36.35.D02.1.454.CMB.1.raw
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
  modified_base (579)..(579): a, c, t, g, unknown or other
  misc_feature (579)..(579): n is a, c, g, or t
  modified_base (701)..(701): a, c, t, g, unknown or other
  misc_feature (701)..(701): n is a, c, g, or t
  modified_base (708)..(708): a, c, t, g, unknown or other
  misc_feature (708)..(708): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtcgccgtacgggacatcgtgatgacccagtcctccagacctccnggctgtgtctgnggcgagaggcacgtanacactgactaaggtccaggccggtaagttagttttaanacgaacctacaaaagtaataaagtagtttacgttaagtacgttacggtaacagtaccaaagaaacccacgaacgtacgtacccctacaaacgtctacgtaccgttacgttttaaccggcgggaccccttaccggtaaaccccgggtaaccgtcccggggtaccctagaaaccgtagttcaaggggttcgggccggtccgggtagtacgggaacctagttacctttgaaccttacgtaacaaccctagtacaaggcctaacgcccgtaggccgggtacgtaggaaacgtgttacgggtaggttaccggtttattacgtcgtactaacgngttaagttaaacgttagttacgtttaacctcctaccgttagttaccgggttttacgaccgggaaaccgggtaacccgaggtaccgtaaggtacgtacgcggtaacacgtacgtggtcgactnactacgngttcg

SEQ ID NO: 116925 - DNA, 508 bp, Homo sapiens
  misc_feature: GYAE6OF02HWHBH.36.35.D02.1.454.CMB.1.raw
  modified_base (245)..(245): a, c, t, g, unknown or other
  misc_feature (245)..(245): n is a, c, g, or t
tcagtacgctgtctcacgaccggtgctcgatttagcacacgatagttgggtttggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttactgggcctctacccgggaatccggggtcctgacgattcagtgcggcggtctgggacagatttcactctcaccatcagcagcctgcgggctgaagatgtggcggtttattactgtcagcagtattatgttactcctcactagtttggcctaggggaccaagcgtggagatcgcacgactgtggctgctaccg

SEQ ID NO: 116926 - DNA, 175 bp, Homo sapiens; identical to SEQ ID NO: 116796
  misc_feature: GYAE6OF02GTDKA.36.35.D02.1.454.CMB.1.raw
  modified_base (173)..(175): a, c, t, g, unknown or other
  misc_feature (173)..(175): n is a, c, g, or t

SEQ ID NO: 116927 - DNA, 513 bp, Homo sapiens
  misc_feature: GYAE6OF02H1XE0.36.35.D02.1.454.CMB.1.raw
  modified_base (242)..(242): a, c, t, g, unknown or other
  misc_feature (242)..(242): n is a, c, g, or t
  modified_base (352)..(352): a, c, t, g, unknown or other
  misc_feature (352)..(352): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctcctaagctgctcgtttactgggcctcgtacccgggaatccggggtccctgaacgnttcagtggcggcgggtctgggacaggatttcacttctcaccatcagcagcctgcgggctgagagtggtggtcgtttattacgttgtcagctagtattattcgttactcctcactgtttgcgagggacagcgtggagatcgcacgatggtgctgcaccatcg

SEQ ID NO: 116928 - DNA, 563 bp, Homo sapiens
  misc_feature: GYAE6OF02F4DQC.36.35.D02.1.454.CMB.1.raw
  modified_base (312)..(312): a, c, t, g, unknown or other
  misc_feature (312)..(312): n is a, c, g, or t
  modified_base (552)..(552): a, c, t, g, unknown or other
  misc_feature (552)..(552): n is a, c, g, or t
tcagtacgctgtctcacgaccggtgctcgatttagcacacgatagttgggtttggggagctctgagagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcagtctttgatgattagtggcatgcacgtgggtccgnaagctccgaggggacggcctggagtgggtctcgaggttattaggttggaactaggtggtaaggatagggctagtggcggtactcgtggtaggaagggccgtattcgagcattcctaccgagacgaccaacgaccaaagtaacttcccgtagttactactaacaaattagaaactagtctagagagcgtaggaacggaccaccgggtccttagttacttacgtggtagaactaaaaggttnttttaggtaag

SEQ ID NO: 116929 - DNA, 555 bp, Homo sapiens
  misc_feature: GYAE6OF02IKLAM.36.35.D02.1.454.CMB.1.raw
  modified_base (152)..(152): a, c, t, g, unknown or other
  misc_feature (152)..(152): n is a, c, g, or t
  modified_base (367)..(367): a, c, t, g, unknown or other
  misc_feature (367)..(367): n is a, c, g, or t
  modified_base (490)..(490): a, c, t, g, unknown or other
  misc_feature (490)..(490): n is a, c, g, or t
  modified_base (532)..(532): a, c, t, g, unknown or other
  misc_feature (532)..(532): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagcgtgngtttctaggtggctattttaaaggtctctgtgaagcctctggattcacctttgacaagtgtgccatgacctgggtccgccaggctccaggggaagggctggagtgggtctcagttattagtggtagtggtagtagcacagattacggcagactccgtgaagggccggttcaccatctccagagacaattccaacagacacgctgtatttgctacntgaacagcctagagagccgaggacacggcccatatatttatgtgcgtaaacttccttttgacttggttattactcccctagttcaccacgttgggaccaggtaaccctgtcaccgtctcctcngccctcaccgtacggccctactccggtccttccccgcgcccnccctcctccaacgcgcctacccg

SEQ ID NO: 116930 - DNA, 556 bp, Homo sapiens
  misc_feature: GYAE6OF02I3QBY.36.35.D02.1.454.CMB.1.raw
tcagtacgctgtctcacgaccggtgctcgatttagcacacgatagttgggtttgggggagagaggagcccagccctgggattttcaggtgttttcatttggtgataaggactgaacagagagaactcaccatggagtttgggctgagctggctttttcttgtggctattttaaaaggtctcctgtgaagcctctggattcacctttgacaagtgtgccatgacctgggtccgccaggctccagggaaggggctggagtgggtctcagttattagtggtagtggtagtagcacagattacgcagactccgtgaaggccggttcaccatctccagagacaattccaacagcacgctgtatttgcacatgaacagcctgagagccgaggacacggccatatattattgtgcgtaaacttcctttgacttggttattatcccctagtcgtaccactgggccagggaccctggtcaccgtctcctcacgcctaccaccaacgggcccatccggttccttcccccgtcggcccacccctcctcccaagacgccaccctccgg

SEQ ID NO: 116931 - DNA, 507 bp, Homo sapiens
  misc_feature: GYAE6OF02GZDTR.36.35.D02.1.454.CMB.1.raw
  modified_base (246)..(246): a, c, t, g, unknown or other
  misc_feature (246)..(246): n is a, c, g, or t
tcagtacgctgtctcacgaccggtgctcgatttagcacacgatagttgggtttggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctacccgggaatccggggtccctgaacgattcagtggcggcggtctgggacagatttcactctcaccatcagcagcctgcgggctgaagatgtggcggtttatactgtcagcagtattatgttactcctcacagtttgccaggggaccaagctggagatcgcacgaactgtggctgcacc

SEQ ID NO: 116932 - DNA, 179 bp, Homo sapiens
  misc_feature: GYAE6OF02I7ITW.36.35.D02.1.454.CMB.1.raw
  modified_base (173)..(179): a, c, t, g, unknown or other
  misc_feature (173)..(179): n is a, c, g, or t
tcagtacgctgtctcacgaccggtgctcgatttagcacacgatagttgggtttgggggaagaggaagactgacggtcccccaggagttcaggtgctgggcacagcggccctgggctgcctggtcaaggactacttccagacagcgtactgagcgggctggcaaggcgcatagnnnnnnn

SEQ ID NO: 116933 - DNA, 150 bp, Homo sapiens
  misc_feature: GYAE6OF02GP0TN.36.35.D02.1.454.CMB.1.raw
  modified_base (150)..(150): a, c, t, g, unknown or other
  misc_feature (150)..(150): n is a, c, g, or t
tcagtacgctgtctcacgaccggtgctcgatttagcacacgatagttgggtttgggattcacgttgcagatgtaggtctgggtgccctgggctgcctggtcaaggactacttccagacagcgtactgagcgggctggcaaggcgcatagn

SEQ ID NO: 116934 - DNA, 706 bp, Homo sapiens
  misc_feature: GYAE6OF02H70AX.36.35.D02.1.454.CMB.1.raw
  modified_base (157)..(157): a, c, t, g, unknown or other
  misc_feature (157)..(157): n is a, c, g, or t
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcggngtggttctaggtcggctatttaaaggtcagtgtgnggtgcagctgctggagtctgggggaggcttggacngccggggggtcctgaggactctcctgtgaagcctctggattcncctttgacaagtgtgccatgactgggtccnccaggctccgagggaggggctgggagtggggtcctacgagtttattaggtggtagtggttaagtcgacgacgagtacgtacgcgagtacgtcggtaggacgggtcccgttacaccgtactccgtaccgaaggaacgtaacctaaactacccgaaacgtacgacgtaccgtaccgttacgttacgtttacgtacgtacgtacgtacgtaaccgaaccgtaccgtacggtacggaaccgggtaccgggaaccgggaaaccggaaccgggtaccgtaacgttaacgttaacgtttacggtttacggttacggttaaccggttaaaccgttttaccgttttacggtttaccggtttacggttttaaccgttttaacccgtttaccccgtttaccggttacggtaacccgg

SEQ ID NO: 116935 - DNA, 555 bp, Homo sapiens
  misc_feature: GYAE6OF02IHDRI.36.35.D02.1.454.CMB.1.raw
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctccaagctgctcgtttacngggcctcgtacccgggatccggggtcctgaacgattcgagtggcggcgggtctgggacaggtatttcactctcaccatccagcacgcctgcgggctagaagtagtggttggcggttttaattacgtgtcagtctaagttattattcgttactccttctacgttgttttacggtcgtacggggacctacggtcgtggagattccggactacggtaactggtacggctcgacctacg

SEQ ID NO: 116936 - DNA, 608 bp, Homo sapiens
  misc_feature: GYAE6OF02GSYNL.36.35.D02.1.454.CMB.1.raw
  modified_base (247)..(247): a, c, t, g, unknown or other
  misc_feature (247)..(247): n is a, c, g, or t
  modified_base (335)..(335): a, c, t, g, unknown or other
  misc_feature (335)..(335): n is a, c, g, or t
  modified_base (380)..(380): a, c, t, g, unknown or other
  misc_feature (380)..(380): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctctgggcgagagggccacgatcaactgcaagtccagccggagtgtttanacaactccaagaataagagttactttaagcttggtaaccaggccaaggaaacccacgacagtcctacctaaagctagcttcgtttacngggtccctcgtacccgggaacttcccggggtaccctggaaccgtnttcgaggtcggccggcgggtctggggacaggtactttcgactctcgaccatcagcacgccgtgcggctgaagtagtggtgtcgtttagttaccgtgtcaggctaggttatttagtagttacctccgtcgtacgtaggtttcggaccgtacggggacctaaggtccgtacgggtacgacgttaccggaccgtaccggtaacttcggtcgtaccgtcggaccctaacccg

SEQ ID NO: 116937 - DNA, 558 bp, Homo sapiens
  misc_feature: GYAE6OF02GW6LQ.36.35.D02.1.454.CMB.1.raw
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (535)..(535): a, c, t, g, unknown or other
  misc_feature (535)..(535): n is a, c, g, or t
  modified_base (551)..(551): a, c, t, g, unknown or other
  misc_feature (551)..(551): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggctttttctgtggctattttaaaaggtctcctgtgaagcctctggattcacctttgacaagtgtgccatgacctgggtccgccaggctccagggaagggctggagtgggtctcagttattagtggtagtggtagtagcacagattacgcagactccgtgaagggccggttcaccatctccagagacaattccaanagcacgctgtatttgcacatgaacngcctgagacgccgaggacacggccatatattattgtgacgtaaactttcctttagacttggttattactccctagtcaccacgtcgggaccacgggaccctggtccaccgtcctcctcacgtcctcccaccgacgggcccacgtccggtcccttccccgtgcccnccctcctaccaacgcncctaccg

SEQ ID NO: 116938 - DNA, 519 bp, Homo sapiens
  misc_feature: GYAE6OF02IRSIE.36.35.D02.1.454.CMB.1.raw
  modified_base (246)..(246): a, c, t, g, unknown or other
  misc_feature (246)..(246): n is a, c, g, or t
  modified_base (417)..(417): a, c, t, g, unknown or other
  misc_feature (417)..(417): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttactgggcctctacccgggaatccggggtccctgaacgattcagtggcggcgggtctgggacagatttcactctcaccatcagcagcctgcggctgaagntgtggcgtttatactgtcagcagtattatgttactcctcactagtttgccgagggaccagctaggacgtatcgacacgaacgtggtcggccgtcgacctacg

SEQ ID NO: 116939 - DNA, 516 bp, Homo sapiens
  misc_feature: GYAE6OF02H2DPX.36.35.D02.1.454.CMB.1.raw
  modified_base (247)..(247): a, c, t, g, unknown or other
  misc_feature (247)..(247): n is a, c, g, or t
  modified_base (495)..(495): a, c, t, g, unknown or other
  misc_feature (495)..(495): n is a, c, g, or t
  modified_base (507)..(507): a, c, t, g, unknown or other
  misc_feature (507)..(507): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctcctaagctgctcgtttactgggcctctacccgggaatccggggtcctgaacgattcagtggcggcgggtctgggacagatttcactctcaccatcagcagcctgcgggctgaagattggtggtcggtttaattactgcagcaagttattatgttactcctcaactgtttcgcctaggggaccaaggctggagntcgcacgactgnggctgcacc

SEQ ID NO: 116940 - DNA, 619 bp, Homo sapiens
  misc_feature: GYAE6OF02J0H4V.36.35.D02.1.454.CMB.1.raw
  modified_base (241)..(241): a, c, t, g, unknown or other
  misc_feature (241)..(241): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcagagggccacgatcaactgcaagtccagccggagtgtttanacaactccaagaataagagttcttagcttggtaccagcagaaccacgacagcctactaagctgctcgttacgtggcctcgtaccggacgtccggggtcctgaacgattcgagtggcggcggtctaggacagatttcactctacaccatcagcacgccgtggacggtctacgaaggtagtaggtcgggtacggttttagttaccgttgtacgtacgtacgtacgttatttacgtacgtttaccttaccgttaccgttaaccgttaggtttttacggaccgttaacggggaccgtaacggtcgttacgggaacggtaacgtccggtaaccgtaccggtaacgttcggtacggtaccgtcggtacctaccgttacttccgg

SEQ ID NO: 116941 - DNA, 552 bp, Homo sapiens
  misc_feature: GYAE6OF02II57W.36.35.D02.1.454.CMB.1.raw
  modified_base (246)..(246): a, c, t, g, unknown or other
  misc_feature (246)..(246): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaaagaataagagttcttagcttggtaccagcagaaaccacgacagcctcctaagctgctcgttactgggcctcgtacccggaatccgggtcctgaacgattcagtcggcggcgggtctggggacagtatttcactctacaccatcagcacgcctgcgggctaggagagtgtggtcgtttattactgtacgagctagttatttatcgtttactccttctacgtacgttttcgaccgtacggggacctaaggtcgtaggacgaagtcgaccgacgtaaccgtggtcggctacggctaccg

SEQ ID NO: 116942 - DNA, 572 bp, Homo sapiens
  misc_feature: GYAE6OF02GYWSW.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtgtcgtttctaggtggctatttaaaggtctctgtgaagcctctggattcacctttgacaagtgtgccatgacctgggtccgccaggctccagggaaggggctgggagtgggtctcagttattagtggtagtggtagtagcacagattacgcagactccgtaggaagggccggttcaccatcctccagagacaatccaaacagcacgctgtatttgctacatgaacagcctgagagccgaggacacggccatatattattgtgcgtaaacttctttgtacttgttattactaccctagtacgaccacgtgggccacgggaaccctggtcctacccgtctcctcaccgtccctaccgaccgaaccgggcccacgttccggttccctttacccccgtcggccctaccccctccctacccg

SEQ ID NO: 116943 - DNA, 507 bp, Homo sapiens
  misc_feature: GYAE6OF02FUYGU.36.35.D02.1.454.CMB.1.raw
  modified_base (247)..(247): a, c, t, g, unknown or other
  misc_feature (247)..(247): n is a, c, g, or t
  modified_base (456)..(456): a, c, t, g, unknown or other
  misc_feature (456)..(456): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctacccgggaatccgggtccctgaacgattcagtggcggcggtctgggacagatttcgactctcaccatcagcagcctgcggctgaagatgtggcggtttatactgtcagcagtattatgttactctnactagtttgccagggaccaagctggagatcgcacgaacgtgtggctgcacc

SEQ ID NO: 116944 - DNA, 541 bp, Homo sapiens
  misc_feature: GYAE6OF02JF8JZ.36.35.D02.1.454.CMB.1.raw
  modified_base (371)..(371): a, c, t, g, unknown or other
  misc_feature (371)..(371): n is a, c, g, or t
tcagtacgctgtctcacgaccggtgctcgatttagcacacgatagttgggtttgggggagagaggagcccagccctgggattttcaggtgtttcatttggtgatcaggactgaacagagagaactcaccatggagtttgggctgagctggcttttcttgtggctattttaaaaggtctcctgtgaagcctctggattcacctttgacaagtgtgccatgacctgggtccgccaggctccagggagggctggagtgggtctcagttattagtggtagtggtagtagcacagattacgcagactcccgtgaagggccggttcaccatctccagagacaagttccaacagcacgctgtatttgcacatgaacancctgagagccgaggacacggccatatattatgtgcgaacttcctttgactggttattatccctagtcgacactgggccagggaaccctggtcaccgtctctcagcctccacaacggcccatcgtccttcccctcggccacccgtccttcccgaacgacgtcctaacccgg

SEQ ID NO: 116945 - DNA, 600 bp, Homo sapiens
  misc_feature: GYAE6OF02J1WWC.36.35.D02.1.454.CMB.1.raw
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
  modified_base (454)..(454): a, c, t, g, unknown or other
  misc_feature (454)..(454): n is a, c, g, or t
tcagtacgctgtctcacgaccggtgctcgatttagcacacgatagttgggtttggggtaggctctgagagaggagcccagccctgggattttcaggtgttttctatttggtgatcaggactgaacagagagaactcaccatggagtttgggctgagctggcttttcttgtggctattttaaaaggtgtccagtgtgaggtgcagctgctggagtcgtgggggaggcttggtacgaggccgggggggtccctgagactctcctgtgaagcctctggattcacctttgacaagtgtgccatgacctgggtccgccaggctccgagggaaggggctggagtggggtctcgagttatagtggagtgggtagtgcanagacttacgnagactccgtggaacgggccgttnaccatcacagagacaattccaanagcacggctagtattgacactagtanaacagaccctgaacggacgccgaacgggaccacgggccctaagttactaagttttacgttggtaccgtacggtaaacctttttacccggtttagttaaccgtttgggttaacttttaacctcccccgtttaaggtcctaaccccgg

SEQ ID NO: 116946 - DNA, 536 bp, Homo sapiens
  misc_feature: GYAE6OF02IYC6W.36.35.D02.1.454.CMB.1.raw
  modified_base (245)..(245): a, c, t, g, unknown or other
  misc_feature (245)..(245): n is a, c, g, or t
  modified_base (373)..(373): a, c, t, g, unknown or other
  misc_feature (373)..(373): n is a, c, g, or t
  modified_base (416)..(416): a, c, t, g, unknown or other
  misc_feature (416)..(416): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttanacaactccaagaataagagttctttagcttggtaccagcagaaaccacgacagcctcctaagctgctcgttactgggcctcgtacccgggaactccggggtccctgaacgattcagtggcggcgggtntgggacagattcactctcaccatcagcagcctgcgggctgagntggtggtcgtttatctgtcagctagttattattcgttactccttcgacttaggtttcggccgacggggaccaaggtcgtaggagtatccgacgacgaacgttggtcggcgtgacctaccg

SEQ ID NO: 116947 - DNA, 598 bp, Homo sapiens
  misc_feature: GYAE6OF02J00ZQ.36.35.D02.1.454.CMB.1.raw
  modified_base (246)..(246): a, c, t, g, unknown or other
  misc_feature (246)..(246): n is a, c, g, or t
  modified_base (450)..(450): a, c, t, g, unknown or other
  misc_feature (450)..(450): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagataagattctttagcttggtaccagcaagaaccacgacacgtccctacctaagctgcttcgtttacgtcggcctaccgtacccgggtaagtcccggggttacccaggaacgtcttcgaggtcgggcggtcggtcgtcggggacaggtactttcactctacaccatcgacgcacgtcctcggcggtctagaagtntggttgggtcgtttatacgttcgtactacgcgtaagttattagttacgttacttaccttctaacgtttggtttcggaccgtaggggtacctacggtcgtaggaagtacgtacgacgtaacggtacgttggacggtctacgcctaaccg

SEQ ID NO: 116948 - DNA, 595 bp, Homo sapiens
  misc_feature: GYAE6OF02FWUNQ.36.35.D02.1.454.CMB.1.raw
  modified_base (465)..(465): a, c, t, g, unknown or other
  misc_feature (465)..(465): n is a, c, g, or t
  modified_base (490)..(490): a, c, t, g, unknown or other
  misc_feature (490)..(490): n is a, c, g, or t
tcagtacgctgtctcacgaccggtgctcgatttagcacacgatagttggggtttgggggagctctgagagaggaggcccagccctgggattttcaggtgttttcatttggtgatcaggactgaacacgagagaactcaccatggagtttgggctgaggccgtggcgttttccttggtcggcttattttaaaggtgtccagtgtgaggtgcagctgccttgggacgtctgggggaggtcgttgggtacgaggccgggggggtccctggaggactctccgtgtgaacgcctcgtggtacttcacctttgacaagtgtgccatgaccgttgggtccgccgaggcctccgaggggaacgggctgggaggtcgggtctcgaggttactagtggtagtggtagtagcacgacgtattacgcagactcggtggaacgggtccgttcaccgatcctcagagacaattccaacngcacgctgttattcgcacatgaacngcctgagagccgaggacacggccattacgtattagttgtagtacgttaaacctttccgttttaggactttgggtttaactttactccccgttagtccgtaacccg

SEQ ID NO: 116949 - DNA, 622 bp, Homo sapiens
  misc_feature: GYAE6OF02I5364.36.35.D02.1.454.CMB.1.raw
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtggcttttctggtggctatttaaaggtgtcagtgtgaggtgcagctgctggagtcgtgggggaggcttggtacgaggccgggggggtccctgagctctcctggtgaacgcctcgtggattcacctttgactaagtgtgccatgacctgggtccgccaggcctccgagggaagggctggagtgggtctgagttatagtggtagtggtagtagcagagattagcagacgtccgtaggaaacgggtccgttacaccgatctaccgacgagaactaacttaccgaacagcacncgttatagtttcgacctaanatacgaacgacgtaccgtagaacggacgaccggaacggaaccgaaccggactaagttacttaagttagttcggtacgtaaccgttaaccgttttacgttttacggttaacgtttacggtttaaccttacccgtttacccgttacggtacccgtaaccg

SEQ ID NO: 116950 - DNA, 514 bp, Homo sapiens
  misc_feature: GYAE6OF02FR8JA.36.35.D02.1.454.CMB.1.raw
tcagtacgctgtctcacgaccggtgctcgatttagcacacgatagttgggttggggagctacaacaggcaggcagggcagcaagatggtgttgcagacccaggtcttcatttctctgttgctctggatctctgttactacaggtgcctacggggacatcgtgatgacccagtctccagactccctggctgtgtctctgggcagagggccacgatcaactgcaagtccagccggagtgttttatacaactccaagaataagagttctttagacttggtaccagccagaaaccacgacagcctcctaagctgctcgttactgggcctctacccgggaatccggggtcctgaacgattcagtggcggcggtctgggacagatttcactctcaccatcagcagcctgcggctgaagatgtggcgtttatactgtcagcagtattatgttactcctcactagtttgcctagggaccaaggctaggacgacgttcgcgacgaactgtacggctgtcaacc

SEQ ID NO: 116951 - DNA, 581 bp, Homo sapiens
  misc_feature: GYAE6OF02JEHTJ.36.35.D02.1.454.CMB.1.raw
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagcgtgcgttttctaggtggctatttaaaaggtctcctgtgaagcctctggattcacctttgacaagtgtgccatgacctgggtccgccaggctccagggaaggggctggagtgggtctcagttattagtggtagtggtagtagcacagattacgcagactcgtgaggcgttcacatctccagagacaattccaaangcacgctgtatttgcaanatagacngctagagacgcgagacgacgactatatattatgngtactaacttcgttgattgttacttactccgtagtcgaccgtacgcgggacgacggtacccgtcggtccgtaccgttcctcctaccgtacgtccctaccgaaccgtaaccggtccctacgttcccgttcccttacccgtcgtaccctaccctaccgtaccgaacgtaccgacccgtaccg

SEQ ID NO: 116952 - DNA, 589 bp, Homo sapiens
  misc_feature: GYAE6OF02FNQUS.36.35.D02.1.454.CMB.1.raw
  modified_base (379)..(379): a, c, t, g, unknown or other
  misc_feature (379)..(379): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcggtgtgttctaggtcggctatttaaaggtgtcagtgtgaggtgcagctgctggagtctgggggaggcttgggtacaggcccgggggggtccctgagactctcctgtgaagcctctggattcacctttgacaagtgtgccatgacctgggtcccgccagggcctccgaggggaacggggctagggaggtgggtcctgagtttattaggtggtagtggtagtagcanagatacgcagactcgtagacgggtccgttacaccatctccagganaccaattcccaaancgccaacggtctagttacttcgactacgtatagaacagtccctagacgtagccgaaggaccacggcctaatatagttattggtcgaaccgttaaaccgttttcctttaggacctttaggtttacttaccgtccccgtaagtcgtaacccgg

SEQ ID NO: 116953 - DNA, 543 bp, Homo sapiens
  misc_feature: GYAE6OF02GQCOX.36.35.D02.1.454.CMB.1.raw
  modified_base (413)..(413): a, c, t, g, unknown or other
  misc_feature (413)..(413): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggagcttggtacagccgggggggtccctgagactctcctgtgaagcctctggattcacctttgacaagtgtgccatgacctgggtccgccaggctccgagggaagggctgggagtgggtctcgagttatagctggaatagtggtagtagtgggttatggcggactcgtggtgaagggcgattcaccatctccaganacaacgccaaagactccctgtatctgacaaatgaaacagtctagagagcttggaaggacacggtccttgttattactggtagacaaagggtatacaagttactacgaacgttggacttaggtactaaacg

SEQ ID NO: 116954 - DNA, 528 bp, Homo sapiens
  misc_feature: GYAE6OF02G6COM.36.35.D02.1.454.CMB.1.raw
  modified_base (242)..(242): a, c, t, g, unknown or other
  misc_feature (242)..(242): n is a, c, g, or t
  modified_base (411)..(411): a, c, t, g, unknown or other
  misc_feature (411)..(411): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctcctaagctgctcgtttactgggcctctacccgggaatccggggtccctgacgattcagtggcggcgggtctgggacagatttcactctcaccatcagcagcctgcggctgaagntgtggtcggtttattactgtcagcagttattatgtttactcctctactaggttttggaccgtaggggacctaggcgtaggagatcgcgtacgaacgtgtcggctgctaccgtatccg

SEQ ID NO: 116955 - DNA, 709 bp, Homo sapiens
  misc_feature: GYAE6OF02G76TP.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcggtgtcgttttctaggtcggctaattttaaaggtgtccagtgtgaggtgcagctgctggagtcgtgggggaggcttgggtacacggccgggggggtccctggagactctcctgtgagcctcgtggattctaccttgactaagtgtcgccatcgaccgtgggtccgccagggcctcccgaggggaacggggcgtagggagtggggtctcgtaggtttattaggtggttaggtgggtaacgttaggctaacgagtagttaccggacaacggtacgtacccggttgggaaacggggttcccggttaccaaccgtatacccgtacccgaggtaacgacctaaacttacccaaacacggccaacggtcttagttactttcggaacctacacgttagaaacctcggtcccgtaggaacgacggcccgggaaacggaccgaaccgggtacctagtttaattaacgtttagttcggtacggaacctttaaaccgttttccggttttatacccggttttaggtttaacctttacccgtaccccgtttaagtcccggtaacccgg

SEQ ID NO: 116956 - DNA, 548 bp, Homo sapiens
  misc_feature: GYAE6OF02FGODB.36.35.D02.1.454.CMB.1.raw
  modified_base (232)..(232): a, c, t, g, unknown or other
  misc_feature (232)..(232): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggctttttcttgtggctattttaaaaggtctcctgtgaagcctctggattcacctttgacaagtgtgccatgacctgggtccnccaggctccagggaggggctggagtggggctcagttatagtggtagtggtagtagcacagattacgcagactccgtgaagggccggttcaccatctcagagacaattccaacagcacgctgtatttgcacatgaacagcctgagagccgaggacacgcatatattatgtgacgtaaacttcctttgacttggttattatcccctagtcgaccacgtcgggccagggaaccctggtctaccgtctcctcacgcctccaccgaacggcccacgtccggtccttccccgtggcctaccctcctccgacgacgcctaccg

SEQ ID NO: 116957 - DNA, 540 bp, Homo sapiens
  misc_feature: GYAE6OF02HKGGP.36.35.D02.1.454.CMB.1.raw
  modified_base (156)..(156): a, c, t, g, unknown or other
  misc_feature (156)..(156): n is a, c, g, or t
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (183)..(184): a, c, t, g, unknown or other
  misc_feature (183)..(184): n is a, c, g, or t
  modified_base (186)..(186): a, c, t, g, unknown or other
  misc_feature (186)..(186): n is a, c, g, or t
  modified_base (188)..(191): a, c, t, g, unknown or other
  misc_feature (188)..(191): n is a, c, g, or t
  modified_base (194)..(195): a, c, t, g, unknown or other
  misc_feature (194)..(195): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
tcagtacgctgtctcacgaccggtgctcgatttagcacacgatagttgggtttgggagctctgagagaggagcccagccctgggattttcaggtgttttcatttggtgatcaggactgaacagagagaactcaccatggagtttgggctgagcggngtgttctaggcgcatttaaagngcngnngngnnnntgnngntnggngctgcngcgggtcngagctnctgnagcctngattcnctttgataagtntgccatgccgtggccncgngcncaggaggcggngngtgtntgtgtagtagtgtgtagtagagacagagtagtacgacgacgtacgtacgacggacggtccgtactacctactacgtaccgacgacgaacaactaacgaacacgacgacgacgttacgttacgttacgtactactatacgaacgacgtacgtagacgacgacgacgacgacgacgatatattagtgtacgtacgttaacgttacgtttacgttacgttacgttacgttaccgttaccgttacgtacgtacg

SEQ ID NO: 116958 - DNA, 520 bp, Homo sapiens
  misc_feature: GYAE6OF02FIC78.36.35.D02.1.454.CMB.1.raw
  modified_base (515)..(515): a, c, t, g, unknown or other
  misc_feature (515)..(515): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaaccacgacagcctcctaagctgctcgtttactgggcctctacccgggaatccggggtcctgaacgattcagtggcggcgggtctgggacagatttcactctcaccatcagcagcctgcggctgaagatgtggtcgtttattactgtcagctagtattatgttactcctctactagtttggccaggggaccagctaggagagtcgacctacgaactggtggctggccaccnttccg

SEQ ID NO: 116959 - DNA, 570 bp, Homo sapiens
  misc_feature: GYAE6OF02IZ6EY.36.35.D02.1.454.CMB.1.raw
  modified_base (488)..(488): a, c, t, g, unknown or other
  misc_feature (488)..(488): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttgggtacaggccgggggggtccctggagactctcctgtgaagcctctggattcacctttgactaagtgtgccatgacctggggtccgccaggctccgagggaggggctgggagtgggtctcgagttattagtggtagtggtagtgcacgagattacgcagacctcgtaggaacgggtccggtcaccatctaccagagacaattaccaacacgcacgctagttatttcgacacatacgaacacgcctagagacgaccgaggaccncgggaccatatatttagtaggtcgaacgtaacctttcctttagtaccgttaggtttacttacttacccgtagtcgtaacccg

SEQ ID NO: 116960 - DNA, 697 bp, Homo sapiens
  misc_feature: GYAE6OF02I7XYD.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggctattttaaaggtgtccagtgtgaggtgcagctgctggagtcgtgggggaggcttggtacgaggcccgggggggtccctggagacctctccgtgtgaacgcctcgtggattcctacctttgacgtaagtgtgccagtcgaccgttcgggtccgccgaggcctccggaaggggaggggcctgggagtgggtcctcgtagttagttaggtggtagtggtagtagcagagattacgcagactccggtaggaacgggtccgttacacctatcctaccaggacgtactaacttaccaaacgacgacctacgtcgtttgttacgtttacgcctaacaacgttacgaacgtacgtacccgtaaggacggtaccggtacccgggaagggtaaccccgaccggggtacccttaagttacgttaacgtttaacgttacggttacggtaacccggtttaaacccgttttcccgtttttacggtaccgtttacggttttaacctttaccgtttacccccgttaggtacccgtaacccgg

SEQ ID NO: 116961 - DNA, 643 bp, Homo sapiens
  misc_feature: GYAE6OF02GGRGK.36.35.D02.1.454.CMB.1.raw
  modified_base (384)..(384): a, c, t, g, unknown or other
  misc_feature (384)..(384): n is a, c, g, or t
tcagtacgctgtctcacgaccggtgctcgatttagcacacgatagttgggtttgggggagctacaacaggcaggcaggggcagcaagatcggtgttgcagacccaggtcttcatttctctgttgctctggatctctgttactacaggtagcctacggggacatcgtgatcgacccagtctccagactccctggctgtgtctcgtgggcgacgacgggccacgatcaactgcaagtccagccggagtgtttacacaactccaagaataagattactttagcttggtaccagccaaggaaacccacgacagtcctacctaagctgccttcggtttacgtcggccttcgaaccccggggtaatccccggggtacccttaggaacgtnttccaggtgggaccggcgggtctaggggactaaggtctttaccgacgtctaccaaccgacgtcacgctacgccgtaggccgggtctaggaacgtagttcggtacggttacgttttattaccgtggtacagtcgtaagtttatttaacgttcgtttaaccttccgttactacgtttaggttttcggacgtacggggacctaaggtcgtaggacgtactaccggacgtaccggtacgttaggtcgtcgtacggcctaacgg

SEQ ID NO: 116962 - DNA, 508 bp, Homo sapiens
  misc_feature: GYAE6OF02F21PW.36.35.D02.1.454.CMB.1.raw
  modified_base (242)..(242): a, c, t, g, unknown or other
  misc_feature (242)..(242): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctacccgggaatccggggtccctgaacgattcagtggcggcgggtctgggacagatttcactctcaccatcagcagcctgcggctgaagatgtggtcggtttattactgtcagcagtattatgttactcctcactagtttggccagggaccagctggagatcgcacgacgtgtggctgcaccatc

SEQ ID NO: 116963 - DNA, 563 bp, Homo sapiens
  misc_feature: GYAE6OF02G3E33.36.35.D02.1.454.CMB.1.raw
  modified_base (246)..(246): a, c, t, g, unknown or other
  misc_feature (246)..(246): n is a, c, g, or t
  modified_base (320)..(320): a, c, t, g, unknown or other
  misc_feature (320)..(320): n is a, c, g, or t
  modified_base (427)..(427): a, c, t, g, unknown or other
  misc_feature (427)..(427): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctaccaagctgctcgtttacnggcctcgtacccggaatccgggtccctagaacgattcagtgggacggcggtcgtagggacaggtactttcgactcgtacaccactcagcacgcctgcgggctggaanagttggtggtacggtttattacgtgtcagcagttattagttcgttaccttcctacctactagttttcgaccgtacgggaccgtaacggcgtaggagtacgtcgacgtacgtaacgtcggtcggcgtcgcgtaaccg

SEQ ID NO: 116964 - DNA, 538 bp, Homo sapiens
  misc_feature: GYAE6OF02GFX42.36.35.D02.1.454.CMB.1.raw
  modified_base (243)..(243): a, c, t, g, unknown or other
  misc_feature (243)..(243): n is a, c, g, or t
  modified_base (353)..(353): a, c, t, g, unknown or other
  misc_feature (353)..(353): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgttttanacaactccaagaataagagttctttagcttggtaccagcagaaaccacgacagcctcctaagctgctcgtttactcgggcctcgtacccgggatccggggtcctgaacgnttcagtggcggcggtctggacagtatttcactctcaccatcagcagctggcggctggaagagtggtggtacggtttattacgtgtcagtctagttattagtgttactcctctacgttagtttcggacgacggggaccagtcgtggacgatcggacgacgtaacgtgtcggctgactactataccg

SEQ ID NO: 116965 - DNA, 592 bp, Homo sapiens
  misc_feature: GYAE6OF02HU63R.36.35.D02.1.454.CMB.1.raw
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagttttggctgagctggcttttcttgtggctattttaaaaggtctcctgtgagcctctggattcacctttgacaagtgtgccatgacctgggtccgccaggctccgagggaaggggctggagtgggtctcagttattagtggtagtggtagtagcacagattacgcagactccgtgaagggccggttcaccatctccagagaccaattcccaangcacgctgtatttncacatgaacagcctagagacgccgaaagacacgcttagtttattactgtgcgagaggagggctacgtttggtagtggttatcgtcctttgacgtacgtacggggccacgggtaacccgtcggtccttccgtcgtcccttcgtgtccttacccacccggtaaccggacccgtacgtcccgttccccgtttcccccgcggtccccgtcccctcgtccctacccgaggtaccg

SEQ ID NO: 116966 - DNA, 542 bp, Homo sapiens
  misc_feature: GYAE6OF02FH9U7.36.35.D02.1.454.CMB.1.raw
  modified_base (349)..(349): a, c, t, g, unknown or other
  misc_feature (349)..(349): n is a, c, g, or t
  modified_base (412)..(412): a, c, t, g, unknown or other
  misc_feature (412)..(412): n is a, c, g, or t
  modified_base (437)..(437): a, c, t, g, unknown or other
  misc_feature (437)..(437): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaaccacgacagcctctaagctgctcgtttactgggcctcgtaccgggatccggggtcctgaacgntcagtggcggcgggtctgggacaggtactttcactctcacatcagcagcctgcgggctgaagngtggtggtacggtttagttactgtnagctagtattattacgttactcctactacgtagtttcggaccgtagggacctagcgtggaagagtccgctaacgaacgtcgtacggtcgtacgcgtacctatccg

SEQ ID NO: 116967 - DNA, 558 bp, Homo sapiens
  misc_feature: GYAE6OF02GAE3D.36.35.D02.1.454.CMB.1.raw
  modified_base (241)..(241): a, c, t, g, unknown or other
  misc_feature (241)..(241): n is a, c, g, or t
  modified_base (349)..(349): a, c, t, g, unknown or other
  misc_feature (349)..(349): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactcaagaataagagttcttagcttggtaccagcagaaaccacgacagcctctaagctgctcgtttactggcctcgtacccgggaatcccggggtcctgaacgtnttcgagtggcggcgggtctgggacagtactttcactctcaccatcagcagcctgcggctgaagatggtggtacgtttattactgtcagctagttattattgttactcctactacgttagtttcggaccgtacggggaaccacggtcgtagggtaagtacgtaccgacgtaacgtaacgttcggtacggcgtacgccctacctattaccg

SEQ ID NO: 116968 - DNA, 606 bp, Homo sapiens
  misc_feature: GYAE6OF02IQANB.36.35.D02.1.454.CMB.1.raw
  modified_base (249)..(249): a, c, t, g, unknown or other
  misc_feature (249)..(249): n is a, c, g, or t
  modified_base (325)..(325): a, c, t, g, unknown or other
  misc_feature (325)..(325): n is a, c, g, or t
  modified_base (436)..(436): a, c, t, g, unknown or other
  misc_feature (436)..(436): n is a, c, g, or t
tcagtacgctgtctcacgaccggtgctcgatttagcacacgatagttgggtttgggggagctacaacagggcaggcagggggcagcaagatggtgttgcagacccaggtcttcatttctctgttgctctggatctctgttactacaggtgcctacggggacatcgtgatgacccagtctccagactccctggctgtgtctctgggcgaggagggccacgatcaactgcaagtccagccggagtgtttanacaactccaaagaataagagttcttagcttggtaccagcaagaaaccacgacacgcctccaagctgctcgtttacngggcctcgtaccggaactccgggtcctagaacgattcaggtcggcggcgggtcgtgggacagactttcgacctctcaccactacagcacgccgtggcgggactggaaacgngttggttgggtacggttttaattacgtacgtcgaggtacctaagttattagttacgtttaccttcccgttacacgttacggttttcgggaccgtacggggaacctaacggcgttacgggagtaaccgtacggaccgaaccggtactagggtcggacctcggactaacccg

SEQ ID NO: 116969 - DNA, 555 bp, Homo sapiens
  misc_feature: GYAE6OF02GEAWT.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgctggagtcgtgggggaggcttggtacaggcccggggggggtccctggagactctcctgtgaagcctctggattcaccttttgacaagtgtgccatgacctgggtcccgccaggcctccgaggggaacggggctgggagtgggtctcaggttattagtggtagtggtagtagcacagattacgcagactcgtagaacgggccgttcacatctaccagagacaattccaacagcacgctgtattgctacatcgaacacgtcctgacgacgccgaaggacacggaccatatattattgagtaccgtaactttcgtttagaccttggttacttactccctagtcgtaacccg

SEQ ID NO: 116970 - DNA, 629 bp, Homo sapiens
  misc_feature: GYAE6OF02H74VY.36.35.D02.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (460)..(460): a, c, t, g, unknown or other
  misc_feature (460)..(460): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtgtcttttctgtggtctattttaaaggtgtccagtgtgaggtgcagctgctggngtcgtgggggagnttggtacgaggccggggggtcctggagactcgtcctgtgaagcctcgtggattcacgtttagacctaaggttgtcgccattcgaccgtggtccgcacggcctcgagggaggcgtggagtcgggtctcgtagttagtacgttggagtggtagtacgctagagtattacgacagtaccgtacggtggtaacggtccggttacacctacgttcaccgtaggactactaacttaccgaaacncgtacaccgttgtacttagtttcgactaagaacgtacggaaactaacggtcctgaagacgttacccgaaggaccgtacggccttagtacttattcgtagtccgtaattaaacccgtttcgtttacgacgtttacggttacctttacgaccccgttagacgttaacccgg

SEQ ID NO: 116971 - DNA, 647 bp, Homo sapiens
  misc_feature: GYAE6OF02F1OHH.36.35.D02.1.454.CMB.1.raw
  modified_base (152)..(152): a, c, t, g, unknown or other
  misc_feature (152)..(152): n is a, c, g, or t
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagcgtgngtttctagtggctatttaaaggtctctgtgagcctctggattcacctttgacaagtgtnccatgacctgggtccnccaggctccgagggagggctggagtgggtctcagttattagtggtagtggtagtagcacagattacgcagactccgtgaagggccgttcaccatctccagacgacaattccaacagcacgctagtatttgctacatgaacagcctgagagccgaggacacggccatatattattgtgtacgtaaacttccgtttagtacttggttatttactccccgttaagtccgtaccgtacgtcgggggtacccacggggtaaccccttgggtcccgtaacccgttcccttacccgttaccgtacggtcccctaccccgtaacccgtaaccgggggccccctaacgtttcccgggttcccccttttaccccccgtcgggaccccttaccccttacccgtacccctaacggaccgtccgtaacccccg

SEQ ID NO: 116972 - DNA, 516 bp, Homo sapiens
  misc_feature: GYAE6OF02GGW0N.36.35.D02.1.454.CMB.1.raw
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
  modified_base (438)..(438): a, c, t, g, unknown or other
  misc_feature (438)..(438): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttacngggcctctacccggggaatccggggtccctgaacgattcagtggcggcgggtctgggacagatttcactctcaccatcagcagcctgcggctgaagatgtggcggtttatactgtcngcagtattattgttactcctcactagttttggcctaggggaccaaggctggagagtcgcacgacgtgtggctgctacc

SEQ ID NO: 116973 - DNA, 555 bp, Homo sapiens
  misc_feature: GYAE6OF02GVMBZ.36.35.D02.1.454.CMB.1.raw
  modified_base (230)..(230): a, c, t, g, unknown or other
  misc_feature (230)..(230): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggcttttctgtggctattttaaaaggtctcctgtgaagcctctggattcacctttgacaagtgtgccatgacctgggtccnccaggctccgagggaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattatgtgacgtaacttcctttgacttggttattacttccctagtcgacctacgtcgggaccacgggaccctcggtccaccgtcctcctcacgcctccaccgacggcccactccggtccttccccgtgccctaccctcctaccacgaccgcctacccg

SEQ ID NO: 116974 - DNA, 175 bp, Homo sapiens; identical to SEQ ID NO: 116796
  misc_feature: GYAE6OF02HBS26.36.35.D02.1.454.CMB.1.raw
  modified_base (173)..(175): a, c, t, g, unknown or other
  misc_feature (173)..(175): n is a, c, g, or t

SEQ ID NO: 116975 - DNA, 603 bp, Homo sapiens
  misc_feature: GYAE6OF02JB44K.36.35.D02.1.454.CMB.1.raw
  modified_base (231)..(231): a, c, t, g, unknown or other
  misc_feature (231)..(231): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggctttttctgtggctattttaaaaggtctcctgtgaagcctctggattcacctttgacaagtgtgccatgacctgggtccncaggctccgaggggaggggctgggagtgggtctcagttattagtggtagtggtagtagcacgagattacgcagacctccggtggaagggccggttcaccatcctccagacgacaattccaangcacgctgtatttgacanatagaacagcctagagacgccgagaccacggccatatattatgtgacgtaacttcctttagacttggttacttactccctagtcgacctacgtcgggaccacgggtaccctggtacctaccgttccgtccctacacgtccctaccaccggaacgggcccctaacgttccggttacccgttcccccgtcggtacccctacccgtacccgtaccgaacggtccgccctacccgg

SEQ ID NO: 116976 - DNA, 579 bp, Homo sapiens
  misc_feature: GYAE6OF02GR3DK.36.35.D02.1.454.CMB.1.raw
  modified_base (242)..(242): a, c, t, g, unknown or other
  misc_feature (242)..(242): n is a, c, g, or t
  modified_base (356)..(356): a, c, t, g, unknown or other
  misc_feature (356)..(356): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactccaagaataagagttcttagcttggtaccagcagaaccacgacacgcctacctaagctcgctcgtttactcgggcctcgtacccgggaatcccggggtcctgaacgtnttcgaggtggcggcgggtctgggacagtcttcactctcacntcagcagcctgcggctagaagntgtcggtcgttttatacgtgtacagtacgtagttattacgttacttaccttcctacgttaacgtttcggtttacggaccgggtaacggtacgtacgtcggtacggtacgtacgtccgtaacgaaccgttgtacggtcgtacgtcgaaccctagccgttcg

SEQ ID NO: 116977 - DNA, 773 bp, Homo sapiens
  misc_feature: GYAE6OF02HOW0A.36.35.D02.1.454.CMB.1.raw
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggtcttttctgtgctattttaaagctctgtgagcctctgattcactttgacaagtgtgccatcgaccgtggtccgccaggctccgagggagggcgtggaggtgggtctctagttattaggtggtagtggtagtagcaacgagtattcgcgaagaccgtccggtaggaacggggtcccggttacaacctactccgtacgagacgtaactaacttaccaaacgacgaccacggtcttaggttattttcgacaacgtatacgaaacctgtacccgtaggaacggaccggccgtaacgggacccgacgacctaattaactttattagttacgtacgtaacgttaaccgttttcgttttagacgtttacggttttaactacgtttccctagtaccgacccgtacggtccggggaaccgttaccgggtaaaccccgttggtacccgtacccgtttcccgtacccgtaccgtaacccgtacccccgttaccgaaacccgggttaacccgggtccccttaaaccgggtttccccgggtttaccccccttttcccccggacccggttaaccccgttacccccccgttacccggtaacccccgtaacggttaccccgaccccggttaccccggg

SEQ ID NO: 116978 - DNA, 151 bp, Homo sapiens
  misc_feature: GYAE6OF02GBCCC.36.35.D02.1.454.CMB.1.raw
  modified_base (150)..(151): a, c, t, g, unknown or other
  misc_feature (150)..(151): n is a, c, g, or t
tcagtacgctgtctcacgaccggtgctcgatttagcacacgatagttgggtttgggattcacgttgcagatgtaggtctgggtgccctgggctgcctggtcaaggactacttccagacagcgtactgagcgggctggcaaggcgcatagnn

SEQ ID NO: 116979 - DNA, 560 bp, Homo sapiens
  misc_feature: GYAE6OF02HINDD.36.35.D02.1.454.CMB.1.raw
  modified_base (272)..(272): a, c, t, g, unknown or other
  misc_feature (272)..(272): n is a, c, g, or t
  modified_base (408)..(408): a, c, t, g, unknown or other
  misc_feature (408)..(408): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggctaattttaaaaggtgtccagtgtgaggtgcagctgctggagtcgtgggggaggcttgggtacaggccgggggggtcctgacgactctcctgtgaagcctcnggattcacctttgacaagtgtcgccatgacctgggtccgccaggcctccgagggaaggggctagggagtgggtctcagttattagtggtagtggtagtagcacagattacgcagactcgtgaacgggcgttcacanctccagagacaatccaacagccacgctgtattgacacatagaacacgcctagacgagaccgaaggacgacgaccattagtatttagtcgtagtacgtaaactttccgtttagtaccgttaggttacttacttccccgttagtccgtaacccg

SEQ ID NO: 116980 - DNA, 632 bp, Homo sapiens
  misc_feature: GYAE6OF02H80EA.36.35.D02.1.454.CMB.1.raw
  modified_base (247)..(247): a, c, t, g, unknown or other
  misc_feature (247)..(247): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgaggagggccacgatcaactgcaagtccagccggtatgtttanacaactccaaagataagtagttctttagcttaggaccagcaagaaacccacgacacgccctacgtaacgctgtccttcgtttacgtcgggcccttaccggtacccgggacgttccccggggtcctacgaacgtattacgagggtcgggcggtcgggtctaggggacctagtctttacgctctcaccgtatcaagcacgccgtgggccggtctaggaacgtgttgggtacggttacggtttaatcgtagttaccgagtcgttaagtttacttagttacgttacctccgttatacccggtttagtttaccgggacggtaccgggtaacaggtcgtaaggacgtacgtaccgaccgtacggtacgtggtagtccgtcggacctaccgg

SEQ ID NO: 116981 - DNA, 760 bp, Homo sapiens
  misc_feature: GYAE6OF02IAPEG.36.35.D02.1.454.CMB.1.raw
  modified_base (257)..(257): a, c, t, g, unknown or other
  misc_feature (257)..(257): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacgggacatcgtgatgacccagtctccagtacctccctggctgtgtctcgtgggcgagacgggccagactacaactgacaacgtccaggccggagttcgttttaanaccaactaccaaagaataacgtagtttacttagctttaggaaccagacaacgaaacacgtacacgtcctacaagctcgacttacgtttacgcggtaccttacgtaccgggaagttccggggtacctaggaacgtattcgaaggtcggccggtcgggtacgtcggggaactacggttacttttccaacgtttacctacgtaacctaacgtaccgtaacgacctaacggtaccgttacgggaccgggtaaccgtaggtaaacgtaacgttacgggttacggttacggttttaacgtttaacgtacgtaccgtaaggttaccgtaaagtttaacgtttaacgttacggttaacccttaccgttaaccgtaaccgttacgggtttttaccggacccggtaacggggtaacccgtaacgggtaacggttaacgggtaacggtaccgtaaccggaccgtaaccggtaaccggttacgggttaccggtaccgtacggtaccctaacccgg

SEQ ID NO: 116982 - DNA, 786 bp, Homo sapiens
  misc_feature: GYAE6OF02IKMVU.36.35.D02.1.454.CMB.1.raw
  modified_base (230)..(230): a, c, t, g, unknown or other
  misc_feature (230)..(230): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggctttttcttgtggctattttaaaaggtctcctgtgagcctctggattcacctttgacaagtgtgccatgacctggtccnccaggctccaggggaagggctggagtggtctcgagttagttagtggtagtggtagtagcacagattacgcagactcggtagaagggtccgttcaccatctccaagagacaattaccaacgagcacgcttgtattttcgacgtaacaattcgtaaaacgcgtaccctagggaacgtacggacccggaacgggaaccgaaccgggaccctaaattaaacgtttaactttaaagtttcggttaaggtaacccggttaaaaaccgtttttccgtttttacggtaacgtttacggttttaaacgttaacgtttcccccgttaagtaccggtaaaccctacggtaccgggggtaccgtaacccggggtaacccgttaccgggtaccgtaacccgttacccttacccgtcccgacgttaccccgttaccccgaaacccggtaacccgggaccccgttaaccggtcccggttaccccgtttacccccccggtacggggtaccccctaacccccgtttcccccgtaaacccggaaaccgttacccggaacccgtttaacccccgg

SEQ ID NO: 116983 - DNA, 587 bp, Homo sapiens
  misc_feature: GYAE6OF02IUU36.36.35.D02.1.454.CMB.1.raw
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
  modified_base (509)..(509): a, c, t, g, unknown or other
  misc_feature (509)..(509): n is a, c, g, or t
tcagtacgctgtctcacgaccggtgctcgatttagcacacgatagttgggtttgggggagagaggagcccagcccctgggattttcaggtgttttcatttggtgatcaggactgaacagagagaactcaccatggagtttgggctgagctggctttttctgtggctatttaaaaggtctcctgtgaagcctctggattcacctttgacaagtgtgccatgacctgggtcccgccaggctccaggggaggggctgggagtgggtctcagttattagtggtagtggtagtagcacagattacgcagactccgtggaagggccggttnaccatcctccagagacaattccaacagcacgctgtatttgcacatgaacngcctgagacgccgaggacaccggccataatattattgtgacgaaactttcctttgacttggttattacttcccctagtctaccgacgtcgggaccacgggaaccctgggtccaccgttcctcctccacgtcccnccaacccgacgggccccacttccggtcccttccccgtaccggccctacccgttccccaccaacgtccgcctaccccgg

SEQ ID NO: 116984 - DNA, 782 bp, Homo sapiens
  misc_feature: GYAE6OF02F7N6D.36.35.D02.1.454.CMB.1.raw
  modified_base (237)..(237): a, c, t, g, unknown or other
  misc_feature (237)..(237): n is a, c, g, or t
  modified_base (392)..(392): a, c, t, g, unknown or other
  misc_feature (392)..(392): n is a, c, g, or t
tcagtacgctgtctcacgaccggtgctcgatttagcacacgatagttgggtttgggggagagaggagcccagcccctgggattttcaggtgttttcatttggtgatcaggactgaacagagagaactcaccatggagtttgggctgagcgtggtcttttctgtggctaattttaaaaggtctcctgtgaagcctctggattcacctttgacaagtgtgccatcgaccgtgggtcccncaggcctccgaggggaaggggctgggaggtggggtctacgtagttagttaggtaggtaggtggtagtagcagagattacgcagacctccggtaggaacggggtcccggttcaaccctatccttaccgaaggacgtaactaacttacccgaaaccngacctaccgcgtttagttacgtttcgcctagaacgtagaaccacgtccgtacgaaggacggacccgggaggaccgtaccggactaattaacgttattaattggtacgtaaccgtaaacttttccgtttagtaccgtttagttacttacctacccgttagtccgtaacctacgggtcgggacccgtaacggggtacccgttcggtacccttaacccgtccttacccgtacccgtaccggtcccccttacccgaaacccggtaaccccgggtaccccttaaccgggtttcccccgggttacccccttttccccccgggtaaccggttccccccgtacccccgtttaacccccgtcccggaaaccgttaccggacccccgtttaacccccggg

SEQ ID NO: 116985 - DNA, 773 bp, Homo sapiens
  misc_feature: GYAE6OF02IS6BV.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatgacccagtctccagacctccgtggcttgtgtctcgtgggcgagacgggccacgatcaactgacacgtccaggccggtagttagttttacaacctaaacccgtacaaagtaagtaagttacgtttacgttagtcgttacggtaacagaccgaaacgaaaccgtacgacacgtacctacgtacgtcgtcgtaccgtttacgtttaccggccggttacctacccgggtaacccgggtaaccggttccccggggtaccgtaacggtaaaccgtcttacgggtacgggtcgggtacggggtcggttacgggttacgggaactacggttactttaccgaccgttactaccgtaacctactaccggagtaccgaccggttccgtggggtacgtacggtaacggaaggttagttacggggtttacgggttaacgtttttacgttacgttcgtacgtaacggtcgtttaagttacgttttacgttacgtttacccgtaccttacggttacgtttacgggttaccgaccggggtaacgggtaaccgagggtcggtaacggagtaccggtcccgtaaggtaccggtaggttccggcgtacgtacccgcccgtaacg

SEQ ID NO: 116986 - DNA, 615 bp, Homo sapiens
  misc_feature: GYAE6OF02HXZT5.36.35.D02.1.454.CMB.1.raw
  modified_base (245)..(245): a, c, t, g, unknown or other
  misc_feature (245)..(245): n is a, c, g, or t
  modified_base (263)..(263): a, c, t, g, unknown or other
  misc_feature (263)..(263): n is a, c, g, or t
tcagtacgctgtctcacgaccggtgctcgatttagcacacgatagttgggtttgggggagctacaacaggcaggcaggggcagcaagatggtgttgcagacccaggtcttcattttctctgttgctctggatctctgttactacaggtgcctacgggacatcgtgatgacccagtctccagactccctggctgtgtctctgggcgagagggccagatcaactgcaagtccagccggagtgtttanacaactccaagaataagngttacttagcttggtaccagacagaaaccacgacagcctacctaagctgctcgtttacgtcgggcctacgtacccgggaagtcccgggtcctagacgtattcgagtcgggcggcgggtcgtgggactagtactttcactctcacctatcacgcacgcctggcgggctaggaacgtagttggttggttacggtttattaacgtggtacaggtactaagttatttagttacgttaccttccttactacgttacggttttacgggacccgtacggggtacctaaggtccgttagggaacgtaacgtcccggactaaccggtaacgttcggttacgggccgtacggacctaacccg

SEQ ID NO: 116987 - DNA, 628 bp, Homo sapiens
  misc_feature: GYAE6OF02GFZKF.36.35.D02.1.454.CMB.1.raw
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtcctctgggcgagacgggccacgatcaactgaccaagtcccagccggtagttgttttacacaactccaaagaataagagttcttagcttggtaccagacagaaaccacgacagcctacctaagctgtcctcgtttacgtcgggtcctaccgtacccgggtactcccggggtccctgaacgtacttcgaggtcgggcggcgggtcgtgggaactaggtacttttcgacttctccacctatcgacgcagccctggcggctagaagagtggttacggtcgtttagttacgtgtacgacgtacgtattacgttattacgtttacctccgttacttacgttacgttttcggaccggtaacggggacctaacggtcgttagggaacgtagtcccggtaacaccggtaacgttcggtacggtaccgttgaccctacctgttaccg

SEQ ID NO: 116988 - DNA, 598 bp, Homo sapiens
  misc_feature: GYAE6OF02IOCLO.36.35.D02.1.454.CMB.1.raw
  modified_base (182)..(182): a, c, t, g, unknown or other
  misc_feature (182)..(182): n is a, c, g, or t
  modified_base (395)..(395): a, c, t, g, unknown or other
  misc_feature (395)..(395): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtgctttctaggtcggctatttaaaggngtcagtgtgagtgcagctgctggagtcgtggggagcttaggtacaggccggggggtcctggacgtactctcctgtgaacgccgtactggattctaacctttgaacaagtgtgcctatcgacctgggtccgcgaggcctaccggaggggaacgggctgggaagtcgggtctagtagttaattaggtggtagtggtagtagcagagtactacganacgactcgtaggaacgggtccgttacaccgtatccgacaagaagtaaccaaacttaccaaacacgacacggtctagttactttgactaacgatacgaactacgcctagagacgacgacgactaaccgactagtactattagtgtcgaacttaacgttactttagtaccgttagttaacgttcctacccttagtacgaacccgg

SEQ ID NO: 116989 - DNA, 659 bp, Homo sapiens
  misc_feature: GYAE6OF02GHMZB.36.35.D02.1.454.CMB.1.raw
  modified_base (253)..(253): a, c, t, g, unknown or other
  misc_feature (253)..(253): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatgacccagtctccagacctccctggctgtgtctcgtgggcgaggacgggccacgatcaactgacaagtccagccggagttgtttanacaactccaagaataagtagttacttagcttaggtaccagcaagaaccacgacacgacctaccgtaagcctagtcttcgtttacgcgggtacccttccggtaaccccggggtaatcccgggggtccctaggaaccgtacttcgaggtcgggcggcggggttcaggggactaggtactttccgacctctaccgtaccactcgacgcgacgtccgtacggcgggtacgtaggaagtagttcggtagggttacggttttaacgttacgtacgtacgaacgtacgtaggttactttagttaccgtttacctccgttacgtacgtttacggtttacggaccgtagggaacccgtaaggtcgtaggacgtacgtacgacgtaacgtacgtggtcggtacgtcgaccgtaccg

SEQ ID NO: 116990 - DNA, 622 bp, Homo sapiens
  misc_feature: GYAE6OF02HQ8IW.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcgttgggtacgaggccgggggggtccctggacgactctcctgtgaacgcctctggattctacctttgactaagtgtgccatcgacctgggtcccgccagggcctccgagggaacgggctgggagtggtctcgagtttataggtggtagtggtagtagcagtagattaacgcaagacgtccgtaggaacgggtccgttacaccacttcaccagacgactaaacttccaactacgacaacgtcttagtactttcgactacagtaacgaacacgcctaggacgaacgtccgaaggtccaaccgggcaagtattagttaacgtggttccgtaacgtaaaccttttccgttttaggtactttaggtttaacttaccgttaccccgttaggttcccgtaacccgg

SEQ ID NO: 116991 - DNA, 748 bp, Homo sapiens
  misc_feature: GYAE6OF02GVJDY.36.35.D02.1.454.CMB.1.raw
  modified_base (418)..(418): a, c, t, g, unknown or other
  misc_feature (418)..(418): n is a, c, g, or t
tcagtacgctgtctcacgaccggtgctcgatttagcacacgatagttgggtttgggggagctacaacaggcaggcaggggcagcaagatggtgttgcagacccaggtcttcattttctctgttgctctggatctctgttactacgaggtgccgtacggggacatcgtgatcgaccctgtctccagacctccctggctgtgtctcgtgggcgaggcgggccacgactcaacgtcgacaacgtccgaggccggtagttgttttacacaacctacaaagtaataaggtactttcttagcgttacggtaccagacaacgaaaccacgacgacgtccctaccgtaagtccgtacgtcttaccggtttacgcgggtcccttaccggtaccccggggtaacgttccccgggtacctagaaccgtntttcgacgggtcgggccgggtcgggtcgtacggggaacctagttacctttaccgaccttaccgtacctacccgtattaccgaacgcgtaccggtacccgtgggtcccgggtagtaacggaaaggttcggttagggtttacccggggtttacgtttttaacgttccgtggttaccgtaagttacgttaagtttactttacgtttaccggtttacctcccgttacggttaacgtttacggttaccgggacggtaacggggtacctagggtacggtaggacgtaccgtaccgtacgtaacggttaccgttcgggacgtacgtccgacctaccg

SEQ ID NO: 116992 - DNA, 584 bp, Homo sapiens
  misc_feature: GYAE6OF02F85UK.36.35.D02.1.454.CMB.1.raw
  modified_base (248)..(248): a, c, t, g, unknown or other
  misc_feature (248)..(248): n is a, c, g, or t
  modified_base (330)..(330): a, c, t, g, unknown or other
  misc_feature (330)..(330): n is a, c, g, or t
  modified_base (360)..(360): a, c, t, g, unknown or other
  misc_feature (360)..(360): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgactcaactgcaagtccagccggagtgtttanacaactaccaagaataagagttctttagcttaggacctagcaacgtaaaccacgacgacgcctacctaagctgctcgttacncggcctcgaccggagtccgggtcctgaacnttcgagtcggcggcgggtctagggacagtacttcacctctacaccatcagcacgccgtggcgggtctaggaagtgttggtcggtcggttttaattcgtgtcacgtgtaagttatttattcgttaccttccgttactacgttacggtttcggaccgtaggggacctaaggcgttagggactacgtccgacgtaacgtagttcgggcggtacgtcggacctaaccg

SEQ ID NO: 116993 - DNA, 619 bp, Homo sapiens
  misc_feature: GYAE6OF02JEM34.36.35.D02.1.454.CMB.1.raw
  modified_base (257)..(257): a, c, t, g, unknown or other
  misc_feature (257)..(257): n is a, c, g, or t
  modified_base (342)..(342): a, c, t, g, unknown or other
  misc_feature (342)..(342): n is a, c, g, or t
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
tcagtacgctgtctcacgaccggtgctcgatttagcacacgatagttgggtttgggggaggctacaacaggcaggcaggggcagcaagatggtgttgcagacccaggtcttcatttctctgttgctctggatctctgttactacaggtgccgtacggggacatcgtgatgacccagtcctccagacctccctggctgtgtctcgtgggcgaggcgggccacgatccaactgacaagtccagccggtagttgttttanaccaactaccaaagaataagagtttctttagcttaggtaccagcaacgaaaccacgacacgcctacctaagctgccttcgttacncgggcctcggtaccggacgtcccgggtcccagaacgtnttacgaggtcgggcggcgggtcgtagggacagtatttccacttccnccaccatcgacgctacgccgtggcgggtactacggaagtgttggtcggttacggtttatacgttgacgagtcttaagttatttacgttgttacctaccgtactacgttacgggtttcgacccggacgggtaaccaaggtccgtaaggctaacgtaccgtacgaacggtactggacggtacctcggaccctacg

SEQ ID NO: 116994 - DNA, 703 bp, Homo sapiens
  misc_feature: GYAE6OF02IUMKQ.36.35.D02.1.454.CMB.1.raw
  modified_base (248)..(248): a, c, t, g, unknown or other
  misc_feature (248)..(248): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacagtcgtgatgacccagtctcagactcctggctgtgtctcgtgggcgagacgggccacgatcaactgcaagtccagccggagttgtttanacaactccaaagaactaagtagtttacttacgtcttggtaaccctagacctaaaggaaaacccacgaacgacgcccttacctaaagctcgtccttacggtttaccgtcgggcctaccgtaacccggggaacgttcccggggtccctagaaccgtagttacgaggttcgggcgggtccggggttcgtacggggtactaggttactttcgaccttaccgtacacctacgtacgacgtaccgtacggcctcgggtcggtcgtagaagtagtcggttagggttacgtttaagttaccgtcgtacgacgtacgttaagttacttacgttcgttaccgttaccttacgttaacttacgggttttaccggaccggtacgggaaccgtaacggtcggtaggacgtaccgttaccggaaccgttaaccggacgttaccggtcggtaccgttcgaccgtaacccg

SEQ ID NO: 116995 - DNA, 587 bp, Homo sapiens
  misc_feature: GYAE6OF02G1SQY.36.35.D02.1.454.CMB.1.raw
  modified_base (243)..(243): a, c, t, g, unknown or other
  misc_feature (243)..(243): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccagatcaactgacagtccagccggagttgttttaanacaactccaagaataagtagttctttaagcttaggtaccagacaagaaacccacgacacgcctacctaagctgtcctcgtttacgtcgggccctcgtaacccgggaagttccccgggggtccctagaaccgtacttcgaggtggccgggcgggtcgtgggacagtactttcactctccacatcacgcacgccgtggcggctgaagtgtcggtggttcggttttattacgtgtacgagtcgtagttattacgttgttacctccgtacgtacgtagtttcggacgtacggggaccaggtcgtagggaagacgtcgacgacgtacgtgtcggctcgactaccattcg

SEQ ID NO: 116996 - DNA, 641 bp, Homo sapiens
  misc_feature: GYAE6OF02JBLUG.36.35.D02.1.454.CMB.1.raw
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggctttttcttgtggcttattttaaaggtctcctgtgaagcctctggattcacctttgacaagtgtgccatgaccgtggtccgcaggctccgagggagggctggagtgggtctcagttattagtggtagtggtagtagcacagtattacgcagactcgtaggaagggccgttacaccatcctccgagagactaataccaanagcaacgctagtactttgcaantacgaacncgtcctaggacgacgaccggacggacgacggacctaagttataattacgttgtacgtaccgttaaactttccgttttagacgttgtttaacttacttacccgtaagttcgaccgtacggtcggggtaccgacgggtaacccttcggtaccaccgttacctacctacgaccgtccctacccacccggaacggtcccctaacgttcccggttaccccgttcccccggtggtaccccctaccccctacccttaacccg

SEQ ID NO: 116997 - DNA, 693 bp, Homo sapiens
  misc_feature: GYAE6OF02GR894.36.35.D02.1.454.CMB.1.raw
  modified_base (592)..(592): a, c, t, g, unknown or other
  misc_feature (592)..(592): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatcgacccagtctccagacctcccgtggctgtcgtctcgtgggcgaggacgggccagactcaactgacaagtccgaaggccgggtagttgttttaacacctaacctaccaaagaataagtacgtttactttagtcttaggtaccagtaccaagaaaccacgacacgcctacctaagcctgtccttacgtttaacgcggtacctaccggtaacccgggaacgttcccgggtacctagaacgtacgttcgaggtcgggtccggcgggttcgtacgggaactagttacgtttactacgtttccaccgtaactacttcgacgtacctacggtcccgttagggaccggttccgtaaggtaacggtagttcgggtacgggtttacgtttacttacgtacgtacgagtacctagttactttagttccgttaccnccgtactacgttaggttccggaccggtacggtaccaacggtcgtaggtaactccggtccgaaccgtaccggtaacttcggtacgtctaccggacctaaccg

SEQ ID NO: 116998 - DNA, 875 bp, Homo sapiens
  misc_feature: GYAE6OF02IRP1F.36.35.D02.1.454.CMB.1.raw
  modified_base (233)..(233): a, c, t, g, unknown or other
  misc_feature (233)..(233): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggctttttcttgtggctattttaaaaggtctcctgtgaagcctctggattcacctttgacaagtgtgccatcgacctgggtccncaggctccgagggagggctggagtgggtctcagttattagtggtagtggtagtagcacgagattacgcaggtacctcggtaggaacggggtcccggttcaacctatccgtaccaaggtacgactaaattcccaaacgtaagccaacggtccttaggttactttacggcctaacagttacgaaacctacgtaccctaggaacggaccggacccggtaaacggggaacccgtaaccggggtacccctaaagttaacgtttaaacgtttaacgtttacggttacggtaaccggttaaaaacccgttttacccgttttttacgggtaaccgttttacggggttttaaaccttttaaccgttacccccgttaacggttaaccgtaacccgtaccggttaccgggggtaacccggtaaccggggtaaaccccgttcgggttaccccgtaacccggttacccgttaccccgtaccgtaaccgttcccccgtaccccggtaaaccccggtaaaccccggggacccccgttaacccggttaccccgggtttacccccgtttaccccccccggtttcgggaccccctttacccccccggttaccccgttaccccggtaaaaccgggtacccgtacccgttaaccccccgggg

SEQ ID NO: 116999 - DNA, 600 bp, Homo sapiens
  misc_feature: GYAE6OF02GDP5L.36.35.D02.1.454.CMB.1.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (402)..(402): a, c, t, g, unknown or other
  misc_feature (402)..(402): n is a, c, g, or t
tcagtacgctgtctcacgaccggtgctcgatttagcacacgatagttgggtttggggacaacaggcaggcaggggcagcaagatggtattgcagacccaggtcttcatttctctgttgctctggatctctgttactacaggtgcctacggggacatcgtgatgacccagtctccagactccctggctgtgtctctgggcagagggccacgatcaactgcaagtccagccggagtgtttanacacncaagaataagagttctttagcttggtaccagcaagaaaccacgaccagccctactaagctgctcgtttactggtcctctacccgggaactccggggtcctggactacttcaggtggcgggtcgggtctgggacagtatttcacttcctcaccatcancgacgccgtggccggctaggagtagtcggtacggttcggtttacttacgtgtcgtagtcgtagttagttagttcgtttaccttccgttacttacgttaagttttcgggacccgttacggggaaccgtacgcgtacgggtaacggtacgtccgaccgtaacggtacgtcggtcggtaccgttcgcgtaccgtacttccg

SEQ ID NO: 117000 - DNA, 1019 bp, Homo sapiens
  misc_feature: GYAE6OF02HXOX5.36.35.D02.1.454.CMB.1.raw
  modified_base (181)..(181): a, c, t, g, unknown or other
  misc_feature (181)..(181): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttacacgaggtcgccgtacggggacatcgtgatcgacccagtccnccagacctcccgtggctgtcgtctcgtgggcgaggacgggccacgataccaactgacaacgtccgacggccgggtagtttacgttttaacaaccaacctacccgaaaagtaaacgttaaaggtaacgttttccgtttaacggtccgtttacgggttaacccgaacggtaccgtaaaacgaaaaacccgtacccgaaaccgtaaccgtacccctacccgtaaaggtcccgttacgtacccgttttaccggtttaacggtccgggtaccccgttacccgggttaaccccgggggtaaaccggttcccccgggggttacccaacggtaaaccggttaacgtttccggaaaggggttccggggaccggggtaccgggggttaccgtaaccggggtaaccaacgggtttacgttttaccccgaccgttttcccgtacccctaacggtaaccgttccgtaaaaccggggtccctaaacccgggtccccggtttcggggaaccccgggggtccgttaaacgggtaaaacggtaaccggggtttacggggttttacgggggttaacccggttttttaaacgtttacccggtcggtttaaccggtaacgggtacccggttaaaaggtttacgtttttaaccgttaccggttttaaccccgttacccgtttaacggtaccggtttttaaaccggggttttcccggggaaacccccgggggaacgggggtttaacccgtaacggggttccggttaaccgggggtaagtaccccgttaaccgggaacccgggtttaaccgtaaccgggttcgggttccgggtaacccgttccggaccccgtttaaaccgg

SEQ ID NO: 117001 - DNA, 616 bp, Homo sapiens
  misc_feature: GYAE6OF02IWZOY.36.35.D02.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
  modified_base (425)..(425): a, c, t, g, unknown or other
  misc_feature (425)..(425): n is a, c, g, or t
  modified_base (608)..(608): a, c, t, g, unknown or other
  misc_feature (608)..(608): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggcttttcttgtggctatttaaaggtctcctgtgagcctctggattcacctttgacaagtntgccatgacctgggtccgccaggctccgagggaagggctggacgtgggtctcgagttattagtggtagtggtagtagcacagattacgnacgtactccgtgaacgggccggttcacctatctaccagacgactaattccgaacagcaactcctgttaattcncgaactagtagaacacgtctagacgagccgaagtccaacggcaatactaattntagtcgtacgtaactttaccgtttgtaaccttggtttacttacttccccgtagttacgaccgtactacggggtccgtaaccgggaacctcgggtaccaccgttccgtaccttccgacgtccctaccgaccgtaacggcctacgtccgtccctaccctcggcctccctaccgtccacggtaccnctaacccg

SEQ ID NO: 117002 - DNA, 732 bp, Homo sapiens
  misc_feature: GYAE6OF02I6GRL.36.35.D02.1.454.CMB.1.raw
  modified_base (191)..(191): a, c, t, g, unknown or other
  misc_feature (191)..(191): n is a, c, g, or t
  modified_base (257)..(257): a, c, t, g, unknown or other
  misc_feature (257)..(257): n is a, c, g, or t
  modified_base (653)..(653): a, c, t, g, unknown or other
  misc_feature (653)..(653): n is a, c, g, or t
  modified_base (689)..(689): a, c, t, g, unknown or other
  misc_feature (689)..(689): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacgaggtgccgtacggggacatcgtgatcgacccagtctccagactcccnggctgtgtctgtggcgagacggccacgatacaactgacaacgtccgaggccggtagttacgtttanaaccaacctaaccaaagaataaacgtagtttcttagtaccgttggtaaccaggaccaacggaaaccctaccggaacacgtacctaccgtaagcctacggacctttcgttaacgtcgggtaccttaccggtaaccccggggtaacgtccccggggtacccctaaggtaaaccgtacgtttacggaacggttcggggtacccgggtcggggttaccggtacggggtaaccgtaaccggttaacgtttcccgtaaccgtttccgtacccgtaaccgtacgtaccgaacggtcgtaaaccggtcccgtacggggccgggtacgtaggtaaacgtggttacgggttcggttacgtttacgtacgtgtacgagtcgtaagttagttattaccgttacttacnctacgttacgttggtaccgtacgggactacggtcgnggtactcgtaacgcgtacgtacgtcgtcggtctcgaccgtaac

SEQ ID NO: 117003 - DNA, 740 bp, Homo sapiens
  misc_feature: GYAE6OF02IPSR5.36.35.D02.1.454.CMB.1.raw
  modified_base (167)..(167): a, c, t, g, unknown or other
  misc_feature (167)..(167): n is a, c, g, or t
  modified_base (254)..(254): a, c, t, g, unknown or other
  misc_feature (254)..(254): n is a, c, g, or t
  modified_base (308)..(308): a, c, t, g, unknown or other
  misc_feature (308)..(308): n is a, c, g, or t
tcagtacgctgtctcacgaccggtgctcgatttagcacacgataggttgggtttagggggagcctacaacgaggcacggcaggggcagcaagatggtgttgcagacccaggtcttcatttctcttgttgctctggatctctgttactacaggtgccgtacggggacntcgtgatgaccgagtctcagactcccgtgctgtgtctcgtgggcgagacggccagatcaactgcaacgtccagcggtagttgtttanacaactcaagtaactagtagttcttagacttaggtaccagacgacgtaaaccgngaacacgtccctacgtaagcctgtcttaccgtttacgtcgggtcctaccggtaacccgggtaacgttccccggggtacctacgtaacgtaacttcggacggtacgggccggcgggttcgtacgggacgtagttaccgtttaccacgttccgtacctaacctacgtacacggtaccgaacgtcccgtcgggtacgggtcgtaacggtaaggacgtttcgggttcggttaacggttttaccgttaacgttggtaccgtaacgtacgttacggtttaatttacgttaccgtttaaccttcctacggtttacgtaacgggttttcgggaaccggtacggggtaacctaacgggtaccggttacggacggtaaccgttccgtaacggtaccggttaaccggtgggttacccgttacggtacccggtacctaacccgg

SEQ ID NO: 117004 - DNA, 636 bp, Homo sapiens
  misc_feature: GYAE6OF02G6Z80.36.35.D02.1.454.CMB.1.raw
  modified_base (231)..(231): a, c, t, g, unknown or other
  misc_feature (231)..(231): n is a, c, g, or t
  modified_base (382)..(382): a, c, t, g, unknown or other
  misc_feature (382)..(382): n is a, c, g, or t
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggcttttcttgtggctattttaaaaggtctcctgtgaagcctctggattcacctttgacaagtgtgccatgacctgggtccnccaggcctccgaggggaacgggctgggagtgggtctcgagttattagtggtagtggtagtagcacgagattacgcagactccgtgaacgggccgttcaccgatcctccagagacaacttccaacagcacgctgtatttcgcacatcgaacncgcctgagacgccgaggtacacggacactatacttattgtgacgtaaacttcgtttagacgttggttactttactcccgttaagtacgtacctacgtcggggacctacgggtaacccgtggtacccaccgttcctcccttacgaccgtccctacccgaaccggtaaccggaccccgtacgtaccggttcccttacccccgtggtaccccgtaccccgttacccgtacccgaacggtaccgtacccgtaacccgg

SEQ ID NO: 117005 - DNA, 536 bp, Homo sapiens
  misc_feature: GYAE6OF02FFI4P.36.35.D02.1.454.CMB.1.raw
  modified_base (247)..(247): a, c, t, g, unknown or other
  misc_feature (247)..(247): n is a, c, g, or t
  modified_base (309)..(309): a, c, t, g, unknown or other
  misc_feature (309)..(309): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagtcttttagcttggtaccagcagaaaccacgacagcctcctaanctgctcgttactgggcctctacccgggaatccggggtccctgaacgattcagtggcggcgggtctgggacaggatttcgactctcacctatcagcagcctgccgggctgaagatgtggtcggtttattactgtcagctagtattattgttactcctactacgtagttttcggcctaggggacctaaggtctaggacgtagtcgacacgtacgtgtggctgctaaccg

SEQ ID NO: 117006 - DNA, 709 bp, Homo sapiens
  misc_feature: GYAE6OF02F4QLD.36.35.D02.1.454.CMB.1.raw
  modified_base (254)..(254): a, c, t, g, unknown or other
  misc_feature (254)..(254): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccagactcaactgcaacgtccgagccggtagttgttttaanacaactaccaaagtaactaagtagtttactttagcttaggtaccagcaacgaaaccacgacacgcctactagctcgcttcgttacgcggcctaccgtaccggagtcccgggtacctagaacgtcttcgagggtcggcggtcgggtcgtcgggaactagtactttaccacctcctaccaaccgtataccgacggccacgtcccggtgggtccgggactaggaaacggttggttacggtacgggttttacggtttaacctttacggttacggtctaacggttacgtaagttttactttaacgtttaccgttaaccgtttaccgtaactaacggttttacgggtttccggaaccgggttacggggtaacccgaagggttcccggttaaggggtaactaccgttacgggaacccgtaaacggttccggttacgggtacggtaccgtccgtaccgtaccg

SEQ ID NO: 117007 - DNA, 857 bp, Homo sapiens
  misc_feature: GYAE6OF02JHSMW.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagcggccacgatcaactgcgaacgtccagccggagttgttttacacaactaccaagaataagtagttctttagtcttaggtaccagacaaacggaaacccacggaacctacggaccccttaccgtaaacgtcgtacgtaccgtttacggttttaccgtaccggggtacccttcccggttaaaccccggggtaaacgttcccccggggggttccccttaacggaaaccggttaaaccttttaccggacgggttacggggtacccggggttccggggttaccgttaacgggggtaccgtaaacggttaacgtttccccgtaaaccggttttcccctaaccgtaacccgtaaccgtttaccggaccggtacccgtaaccgggtccccgtttaacgggggccggggaccgttacgggtaaaacggttcggttacgggtttaccgggtttaacgggtttttacgttaacgtttaccggtacggtaaccggtaacggtacggtttaaactttcgttttaaccgttttacccgtaccttaccgtaacgtttacgggtttccgtaaccggtacccggggaacctacggtacggtacggtaacggtaaccgtcggtaaccgtaacggtaccgttcggtccggtactacgtacctaaccgg

SEQ ID NO: 117008 - DNA, 660 bp, Homo sapiens
  misc_feature: GYAE6OF02HHHVI.36.35.D02.1.454.CMB.1.raw
  modified_base (365)..(365): a, c, t, g, unknown or other
  misc_feature (365)..(365): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (489)..(489): a, c, t, g, unknown or other
  misc_feature (489)..(489): n is a, c, g, or t
tcagtacgctgtctcacgaccggtgctcgatttagcacacgatagttgggtttggggagctctgagagaggagccccagccctgggattttcaggtgttttcatttggtgatcaggactgaacagagagaactcaccatggagtttgggctgagctggtcttttctgtggcttaatttaaaggtgtccagtgtgaggtgcagctgctggagtcgtgggggagtgttggtacgaggccggggggtccctgagacctctcctgtgaacgtccttcgtggtacttcctacctttgacaaggtgtcgaccagtcgacgtcgggtccgccgaggccgtccgaggggaacgggtcgtgggagtcgggtctntagttagttaggtggtagtcggtagtagcacgagtatacgnagtactcggnggacggtccgttnaccactcgactaagcgaacaacttaccgaacgtacgaccgactcgtgtaattcgactacngtaacgaacgtacgtactagaacggtacgacccgtaaacgggaccgtaacggaccttaagtacgttaacgtttcggttacggtacgtaacccggttaaacccttttcccggtttaagtaccgtttacgggtttaacctttaaccgtccccgtttaggtacccgtaacccgg

SEQ ID NO: 117009 - DNA, 686 bp, Homo sapiens
  misc_feature: GYAE6OF02GGVYA.36.35.D02.1.454.CMB.1.raw
  modified_base (154)..(154): a, c, t, g, unknown or other
  misc_feature (154)..(154): n is a, c, g, or t
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (433)..(433): a, c, t, g, unknown or other
  misc_feature (433)..(433): n is a, c, g, or t
tcagtacgctgtctcacgaccggtgctcgatttagcacacgatagttgggtttgggggacgagaggagcccagccctgggattttcaggtgttttcatttggtgatcaggactggaacagagagaactcaccatggagtttgggctgagcgtgngtttctaggtcgctatttaaaggctctgtgagctntcgatcncttgactagtgtgcagtcgaccttgggccacgaggtctccgaggggaaggggtctgggaggttcggtactcgtaggttagttaggtcgttaggtacgtagtacgcgacaggtacttacggctaaggtacctacggtaggtaaccgggtcgtttacgacctactctccgaagaacgtacaacgttaccaagcgtacacgcttgtattcgactacatacgaactcgaccttgaaggacncggtaagactacggaccatacgtattaccgttgtcgtacgttaaactttcgttacggtacgtttcggttacttaccgtaccccttaggtacgtaaccgtacggttgggtaccgtaaccgggttacccgtggttaacccaccggttacctccttaacaccgggtccctaccggacgaaacccggtccgtaagtccccggttaccgtaccccgtacgccccgttacttccccgacgtaaccgaccgccctaccgg

SEQ ID NO: 117010 - DNA, 676 bp, Homo sapiens
  misc_feature: GYAE6OF02FT5DZ.36.35.D02.1.454.CMB.1.raw
  modified_base (186)..(186): a, c, t, g, unknown or other
  misc_feature (186)..(186): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (423)..(423): a, c, t, g, unknown or other
  misc_feature (423)..(423): n is a, c, g, or t
  modified_base (484)..(484): a, c, t, g, unknown or other
  misc_feature (484)..(484): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcggtgtgtttctaggtcggctaattttaaaggngtcagtgtgagtgcagctgctggagtcgtgggggaggtctttggtaccaggtcccggggggggttaccctggganaccgttcncccgttggtagaacgtccctcgtggaattctaaccgtttgaacgtaagtgtcggcctagcgtacccgttgggtcccgccgtacggccgttaccgaagggggaagggccttgggaggtcgggtctcgagtttagtagtggttaagtgtacgtagnaacgtagattacggactagactccggtaggaacgggtccgtacctaccagttccaccgaanaacactaactaccgaaacgacgtcgtaacgtcgttagttcttacgcatacgtagtaacgacgtacgtacgagacgtacgacggacgaccggaccgacttagttaagttagttagtacgtaaccgttaaccgttttaccgtttacgttacgttacggtttaacgtttaccgttacccgttacgttacgtaccg

SEQ ID NO: 117011 - DNA, 699 bp, Homo sapiens
  misc_feature: GYAE6OF02GOKQX.36.35.D02.1.454.CMB.1.raw
  modified_base (259)..(259): a, c, t, g, unknown or other
  misc_feature (259)..(259): n is a, c, g, or t
tcagtacgctgtctcacgaccggtgctcgatttagcacacgatagttgggtttggggacaacaggcaggcagggcagcaagatggtgttgcagacccaggtcttcatttctctgttgctctggatctctgttactacaggtgccgtacggggacatcgtgatcgacccagtctccagactcccgtggctgtcgtctcgtgggcgaggacgggtcccaacgatcaactggacaacgtccaggccggtagttcgttttaanaacctaactaccgaaaagtaaacgtaaagtacgtttacgttagctttacggtaaccagtaccaagaaacccacgacacgccctactaagtcctagccgttcgttacgcggtccctacggtacccgggtacgtcccggggtacctagaaccgtatcgaggtcgggcgggaccggttctacgggactagtacgttcacgtccacgaccatcgagctacgccgtggaccggtctaggaagtacggttaggtacgggtttcgttttaacgttacgttcgtaacgtacgtagttaacggttagttacgttccgtttaaccgtccttaccgttacggtttacgtttccggaaccgggaacgggtaacctacggtcgtacgggtacgtaccgtacggaaccgtacggtaacgtcgtaccggtcgtaccggtacctacgtcgttaccg

SEQ ID NO: 117012 - DNA, 626 bp, Homo sapiens
  misc_feature: GYAE6OF02JTA9C.36.35.D02.1.454.CMB.1.raw
  modified_base (434)..(434): a, c, t, g, unknown or other
  misc_feature (434)..(434): n is a, c, g, or t
  modified_base (466)..(466): a, c, t, g, unknown or other
  misc_feature (466)..(466): n is a, c, g, or t
  modified_base (502)..(502): a, c, t, g, unknown or other
  misc_feature (502)..(502): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggtccagatcaatgacaagtccagccggtagttgtttacaaccaactaccgaaagaataagagtttctttagcttacggtaaccagactaacgaaacctacggacacgcctactaagctgtccttcgttacgtcgggcctaccggtaacccgggagtcccggggtccagaacgtgttacgaggttcgggcggcgggtctaggggactagtctttccgacttcnccgtaaccatcgacgtcacgccgtggccggtntacgagtgtggttcgggtacgtttaatcgtctacgngtcttaagttcttacgtgttacccgtacttccgtaagttcggtttacggacggttaacggccgtaagtcggtaggactacgtacgtaacctacggtactggtaaccgcgtaccgtacccgtacg

SEQ ID NO: 117013 - DNA, 718 bp, Homo sapiens
  misc_feature: GYAE6OF02IBNW5.36.35.D02.1.454.CMB.1.raw
  modified_base (455)..(455): a, c, t, g, unknown or other
  misc_feature (455)..(455): n is a, c, g, or t
  modified_base (495)..(495): a, c, t, g, unknown or other
  misc_feature (495)..(495): n is a, c, g, or t
  modified_base (515)..(515): a, c, t, g, unknown or other
  misc_feature (515)..(515): n is a, c, g, or t
  modified_base (659)..(659): a, c, t, g, unknown or other
  misc_feature (659)..(659): n is a, c, g, or t
tcagtacgctgtctcacgaccggtgctcgatttagcacacgatagttggatttgggggagctacaacaggcaggcaggggcagcaagatggtgtgcagacccaggtcttcatttctctgttgctctggatctctagttactacgaggtcgccgtacggggactatcgtgtatcgacccagtctccagcctccgtgctgtctcgtcgtggcgacggacggacctacgataccgaactgacgtaacgtccgaacggtcggtagtttagtttaacacgtaacctacgaaaagtaatagtagtttacgtagtacgttacggacctagaccaaagaacccacgaacgtacggaccctacgtacgccttacgtaccttcggtttacgcggtcccttacggaaccgggtacggtcccgggtacctaaggtactacgttccgagggtccggcggtaccgggtntacggggactacgttacttcctaaccgtcgtaccaccgtntaccgacgcctacggtccgngggaccgtggtagaacggttacgttcggttggttaaccgggttttactagtacggtgaaccgttacttaggttatttacgcgttttacctcgtaccgttaagtttaaccgggttcggaccggtacggtacccaaggttaccggngtaaacgtacgtcccgtaagttaaccccggggtatttacgggcggtaccctggtaaccc

SEQ ID NO: 117014 - DNA, 999 bp, Homo sapiens
  misc_feature: GYAE6OF02I23MQ.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggtctattttaaaaggtgtccagtgtgaggtgcagctgcgtggagttcgtgggggagtcgttggtacgacgggcccgggggggttcccctggacgtaccttcctccgttggtacgaacgtccgttctgggtactttccgtaaccttttgaacgtaaggttcgtgtacccgaagttccggtaacccgttcgggggtaccccggtacccggacgggtcccgtacccgggaaaggggggaaccgggggtcggttagggtacgggtcggggttaccttacgtaaggttttaagtttagggttaggggttaaggttgggttaaggttaacggactaaacggtaaggttaacgtttaaccggaccgtaaacgtacccgtttacccggggttaacgggtaaacgggggttaccccggtttaccgaacccgtttaaccgttacccgttacccgaaacggtaacgtaaacccgttaaaaactttaccccgaaaaccgaaccggtacccgtaaacccggttactttacggttttaacgtttacgacccgtaaactaacggttaccggaaaacgtaccggttacccgtaagggtaaaccggaaccgggtaacccgggtaaaccgggaccccggtaaaacccgggttacctaaacggtttaaagttttaacggtttttaaacgggtttccgtttaaccgggtaaaaccccggtttttaaaacccgtttttttcccccgtttttaaccgggtttaacccggtttttaacggttttttaaacccgttttaaccccccgtttaaaccccggttttacccgggtaacccgttaacccccccggggg

SEQ ID NO: 117015 - DNA, 904 bp, Homo sapiens
  misc_feature: GYAE6OF02IS9BG.36.35.D02.1.454.CMB.1.raw
  modified_base (60)..(60): a, c, t, g, unknown or other
  misc_feature (60)..(60): n is a, c, g, or t
  modified_base (223)..(223): a, c, t, g, unknown or other
  misc_feature (223)..(223): n is a, c, g, or t
tcagtacgctgtctcacgaccggtgctcgatttagcacacgatagttgggtttggggganctacaacaggcaggcaggggcagcaagatggtgttgcagacccaggtcttcatttctctgttgctctggatctcctgttactacaggtgcctacgggacaatcgtgatcgacccagtcctccacgacctccctggctgtgtctcgtgggcgagagggccacgntacaactgcaagtccaggccggtagttgttttactacaacttaccgaaagtaagtaagtagttttcgtttaacggcctttcgggtaaccctaggaccgaaacggtaaaacccaacggtaacctacggtaccccttacccgtaaacggtccgttacggtaccgtttaccggttttaccgtaccgggggtccccttaccggttaaccccccgggggtaaaccggtttcccccgggggttacccctacgggtaaaccgtacgtttacccggacggttaccggggccgggtaccgggggttcggttaaggggaaccgtaacgggttacctttccgaaccgtttaccctaccgtaacccgtaacgtaccgtaacggacccgtaaaccgggtcccgtacgggtaccggggtacgttaaccgggaaaggttacgggttacggggttttacggggttacccggggttttttaaacgttttaccgttaccgggttacgtaacggtaccggttaagttttaacggtttaaccgttttaccggtttaacccttccggtttaaccttaaccggttttagggtttacccgggaccgggtacggggtaacccgtaagggtccggttaaagggtacggtaccttacggaccgttaacgggaacgtttccgggtacggaccgttccgaccctaccgg

SEQ ID NO: 117016 - DNA, 702 bp, Homo sapiens
  misc_feature: GYAE6OF02HW5DB.36.35.D02.1.454.CMB.1.raw
  modified_base (117)..(117): a, c, t, g, unknown or other
  misc_feature (117)..(117): n is a, c, g, or t
  modified_base (176)..(176): a, c, t, g, unknown or other
  misc_feature (176)..(176): n is a, c, g, or t
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
tcagtacgctgtctcacgaccggtgctcgatttagcacacgatagttgggtttgggggagctacaacaggcaggcaggggcagcaagatggtgttgcagacccaggtcttcatttcnctgttgctctggatctctgttactacaggtcgccgtaacgggacatcgtgatcgacccngtctccagacctcccgtggctgtcgtctcgtcggcgagcggtccacgactacgacgtgacagccgagccggtagtcgttanacaactacaagtaatagcgtttatacgtcgttacgacagacaacgaaccagaaccgacnccctacgagtctgtccgttacgttacgcggtccctacggtaaccggacggtacccgggtacctacggaactcgttcncgggtcggcgggtcggttacggtacggaactggtaccttacaccttccgtccacctacnctacgcgaacgtccgtacgggcggtactaggagtagtacggttcggttacgttttacgttacgtcgtacgtacgtacgaacggttacgtaacgtacgtaccggtccgggtaccggttcccgggtacggtttacccgggacgggtaacgggtacggtaacggggtacgtaacgggttaaccgtaaccggtaaaccggtacgttaaccgggtacggacccgtaaccggtcgtaacccgttacggttaaccgg

SEQ ID NO: 117017 - DNA, 631 bp, Homo sapiens
  misc_feature: GYAE6OF02IQO5H.36.35.D02.1.454.CMB.1.raw
  modified_base (448)..(448): a, c, t, g, unknown or other
  misc_feature (448)..(448): n is a, c, g, or t
  modified_base (476)..(476): a, c, t, g, unknown or other
  misc_feature (476)..(476): n is a, c, g, or t
tcagtacgctgtctcacgaccggtgctcgatttagcacacgatagttgggtttggggacaacaggcaggcagggggcagcaagatggtgttgcagacccaggtcttcatttctctgttgctctggatctctgttactacaggtgccgtacggggacatcgtgatcgacccagtcctccagacctcccgtggctgtgtctcgtgggcgaggagggccacgactcactcgcaagtccgacgaccgggtagttgtttaactacaacctaccaaagtaataagtagtttacgtttagtcgttcggtaccagacaacgaaccacgaccagaccctacgtaacgctacgtcttacgttaccgtcggtccgtaccggtacccggtacgtcccgggtcctaggaactcgtacgagtcgggcggcggtcgaggactagtacttcgacctctacaccntcgagcgacgtcgcggcggtcagtacgngtcggttggttacgtttagtacgttgtacgagtacttagttattacgttacgttactcctacgtcgttacgtttacggaccgtaggtacgacgtggtacggtacgacgtaccggacgtaacgtaggtccggtcgtccgtcgaacctcctgtcccg

SEQ ID NO: 117018 - DNA, 728 bp, Homo sapiens
  misc_feature: GYAE6OF02I3VS5.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtggtcttttcttgtggctaattttaaaaggtgtccagtgtgaggtgcagctgctggagtcgtgggggaggcgttggtacgacgggcccggggggggtccctggacgacctctccgtgtacgaacgtcctcgtggtacttcctaccgttttgaactaagtgtgaccgatcggaccgtcgggtcccgccgtacgggctccggaagggggaacggggcgtagggtaggtcgggttctagtagtttaagttaggtgggttagtgggtaagtacgcaacgagtagttacgacgtacgtaccgttcggtaggaacgggtcccgttacgacctagtcctacgaacgacgtaactaactaccaactacgaccgacgtacttcgttaagtttcgacctactaagttacgaaactacgtcgtagacgtacggaccggaacggaaccgtaacgggacctaagttacgtttaatttaacgttgggttaaccgttaaccggtttaaaccgtttttccgttttaacgttaacgtttacgggttttaacctttacccttacccggtttaacggttaccgttaacccgg

SEQ ID NO: 117019 - DNA, 737 bp, Homo sapiens
  misc_feature: GYAE6OF02HD9OH.36.35.D02.1.454.CMB.1.raw
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgccgtacggggacatcgtgatgacccagtctccagacctccctggctgtcgtctcgtgggcgagagggccacgatcaactgacaacgtccagccggtagttagttttacaacaactaccaaagtaattaagtagttactttagcgtttacggtacccagcaacgaaaccacgacacgcctacctaagctgtcctcgtttacgnggcctacgtacccgggacgtccggggtccagtaacgnttcgaggtcgggcgggtcgggtcgtaggggactaggttacgtttccaaccgtctaccaccgtactacgacgtacgacgtccggtcggccgggtcgtaagggtaagtacggttagggttacgggttaccggttttaacgtttacgttcggtaccgtaacggtaccgttaaggttaacgttttacgtttaccgtttaaccgttcccgtttaccgtaaccggttacgggttttacgggaacccgggttacggggtaaccctagggtaccggtagggtaacggttaaccgtaccggaaccgttaacgggtaaccggttcgggttaccgggtcgttaccggtacccttaacccgg

SEQ ID NO: 117020 - DNA, 781 bp, Homo sapiens
  misc_feature: GYAE6OF02H74KO.36.35.D02.1.454.CMB.1.raw
tcagtacgctgtctcacgaccggtgctcgatttagcacacgatagttggggtttggggacaacaggcaggcaggggcagcaagatggtgttgcagacccaggtcttcatttctctgttgctctggatctctgttactacgtaggtcgccgtacggggacatcgtgatggacccagtcctccagactcccgtggctgtgtcgtcgtgggcgaggacgggccacgtactacgaacgtcgacgtaacgtccgaacggtccggtagttcgttttaacaccgtaacctaccaaagtaataagtcgtttacttagtccgttacggtaacagaccaagaaacccgacgtaacgacgtccctactaagctcgtacttacggtttccgacggtccttaccggaacccgggttacgtccccggggtacctaggtaacgtatttcggacggttcgggccggtccgggtcgtagggtactagttacttacgaccttcctactacctagtacgacgacgtacggtaccgtcgggtaccggtacggtaggtaaacgtcgggtttacgggttcggtttaaccggttttacgtttaaccgttacggttacgtaccggtaacgttacggtttaagtttacgtttaccgttttacctaccgtttaccggtaacgttttaaccggggttaccgggaaccggttaaccgggtaaccgacggttcggttaacgggacgttaccgacggtaccgaacggttaacggttcggtacgggtacctacggaccgttacctacgtacg

SEQ ID NO: 117021 - DNA, 717 bp, Homo sapiens
  misc_feature: GYAE6OF02IGKBV.36.35.D02.1.454.CMB.1.raw
  modified_base (251)..(251): a, c, t, g, unknown or other
  misc_feature (251)..(251): n is a, c, g, or t
  modified_base (548)..(548): a, c, t, g, unknown or other
  misc_feature (548)..(548): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccaagcctcctggctgtgtctctgggcgagacgggccacgatcaacgtgacaacgtccaggccggtagtttcgttttanaactaaacctccaaagtaaagtaaaggtaacgttttccgtttaggtaccgtttaggtaacccgaggtacaacgaaaaccaacggaaccacggtaccctaccgtaaagcctcggaccttccggtttaacgtcggggttaccctaccgtaacccgggtaaccgtcccggggggttaccctacggtaacgtacgttacgacgggttgggccgggtcgggtccgtagggaccgtagtaacgtttccaaccgttctacccgacaacgttcaacgcacgtccgtcggccggtgaggtaacgtntacggggtggttacggtttagttacgtagttccgagcgtaagttattaagtcttacctaccgtaccttaagttcggttcgtaaccggtacgggtaactacggttagacgtaacggataccggtaaccgaacggttacgtcgttcggaatccggactacccgtagttccg

SEQ ID NO: 117022 - DNA, 763 bp, Homo sapiens
  misc_feature: GYAE6OF02GGATD.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctggagtcgtgggggagtcgttggtacgagggcccgggggggtccctggacgaccttccttccgtggtacgaacgtcccttcgtggtacttacctaccgtttagaacctaaggttggtcgcctagtcggtacccgttacggggtccccgccgacggccgtaccggaagggggaaggggccgtagggaggttgggtctcgtaggtttaagttaggttaggttaggttggtaggtagacacgaagtaacgttacgacgacgtaccgtccggtaggaacgggtcccggttaccgaccgtactcctaccgaagacgtaactaacttaccaacgacgaccgtaccgcttagttatttcgactaacgtactacgaaacgacgtaccgtagaacggtaccggaccggacggaaccgaacccgggacctaagttaacgtttagtttacggttcgtaaccggttaccgttaaaacccgttttttccgttttaacggttaacgttttacgggttttaacctttttaacccggtaccccgtttacggttacccggtaacccccggg

SEQ ID NO: 117023 - DNA, 693 bp, Homo sapiens
  misc_feature: GYAE6OF02JGOIL.36.35.D02.1.454.CMB.1.raw
  modified_base (217)..(217): a, c, t, g, unknown or other
  misc_feature (217)..(217): n is a, c, g, or t
  modified_base (523)..(523): a, c, t, g, unknown or other
  misc_feature (523)..(523): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttggctgagcgtgttcttttctgtgtcttagtttaaagtcgtctagtgtgtggtgcgaggtgtacgaatcgggnggggacgtcgttggttcacggtccgggttcggggtcccgtggacgtaccttcctccgtgtcgcgtacgttcttcgtggtattagttactttagtagactatcgactagtcgattccggtacggtccctacgacgtccgtaccgggaaggggacgggtcgtaggtaggttcggtactcgagactaagttaaggtggggtagggtatacgtaccgacctaacgtacgtacggaccggtaccggttccggggacggggtccgtaccaccgtacgtccgaacgtagaccgaacctaccgtaccgagaacnccgacgtctaagttactctacgataagtcgaccacgtaccgactacggaagtcgtaaccgggacggacgtaaccggggtccgttatttacgtttcggtggtcggtaacgagggtaactacgggtaaccccgtagggtaccgaccgtacgttggttacggttgtttttacg

SEQ ID NO: 117024 - DNA, 938 bp, Homo sapiens
  misc_feature: GYAE6OF02GCGPH.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtggtcttttcgttgtggcttaagttttaaaaggtgtccagtgtgaggtgcagctgctggagtcggtggggagcttggtacacgggccggggggtcctggacgaccgtctccgtgtgaacgccctcgtacggtacttccgtaccgtttgaactaagttggtacgcctaagtaccggaacccgtttcggggtccccgaccgacgggtcccgtacccggaaggggggaacggggtccgttaggggtaacgggtttcggggttccgttacgttaagggttttaaacgttttaagggttacggggtttaagggtttagggttaaggttaacggtaccaaaccgtaagggttaacctttaccggtaccaaagggttaccccgttacccggggttaaggggtaaaccccggggggtttacccggtttaaccgaaacccgttaacgtttaccccgttaacccgggaaaacggtaaacccggtaaaccttaaaacccgtttaacccgaaaaccgtaacggaacccgttaacccggtaccgttttacggtttaaacgtttttcgaaacccgtaccgtaacgttaaccgaaaaccgtcgttaaccccgtagggtaacgaacccgggtaaccgggaaaccggtaacccgaacccggggaacctaagtttaacgttaacgttttacgttacggttaacggttaaacccgtttaaaccgtttttccgtttttaacgggacgtttttaacggtttacgttttaaccccgtttcccggttacgttaccggtaaccccgg

SEQ ID NO: 117025 - DNA, 611 bp, Homo sapiens
  misc_feature: GYAE6OF02G2HBA.36.35.D02.1.454.CMB.1.raw
  modified_base (421)..(421): a, c, t, g, unknown or other
  misc_feature (421)..(421): n is a, c, g, or t
  modified_base (425)..(426): a, c, t, g, unknown or other
  misc_feature (425)..(426): n is a, c, g, or t
  modified_base (448)..(448): a, c, t, g, unknown or other
  misc_feature (448)..(448): n is a, c, g, or t
  modified_base (465)..(465): a, c, t, g, unknown or other
  misc_feature (465)..(465): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagacgggcccacgatcaactgacaagtccagccggtagttgttttacacactaccgaaagtaataagtagttactttagtcttaggtaccagacaacgaaaccacgacacgcctacctaagctcgtcttcgtttacgtcggccctcgtacccgggacgttccccggggtcctagaacgtactcgacgtgggccggcggtcgtggacagtacttcactcncacnncagcacgctgcgacgctagagngtggtgtacgtagtttntacgtgtacgatactaattagttatacgttacgttcctacgttcgtaacgttccggacgggtacggaccggtaaggtagggtacgtaacgtaacgtaaaaccggtagttacgggacggtaccgtacgtaccgtacctagtttaccg

SEQ ID NO: 117026 - DNA, 911 bp, Homo sapiens
  misc_feature: GYAE6OF02HQ1SS.36.35.D02.1.454.CMB.1.raw
tcagtacgctgtctcacgaccggtgctcgatttagcacacgatagttgggtttgggggagagaggagcccagccctgggattttcaggtgttttcatttggtgatcaggactgaacagagagaactcaccatggagtttgggctgagctggtcttttcttgtggctattttaaaggtctcctgtgagcctctggattcacctttgacaagtgtgccatgaccgtgggtccgccacggcctccgagggaacggggcgtggaggtgggtctcagttattagtggtagtggtagtagcacagtatacgcagactccgtggaacgggtcccggttacaccgtaatcctacccgtaggacgaactaaactttccccgaaaacgtacgaccgaaccggtccgtttacgttaagtttttaccggcctaaacgtaacggttacgtaaaaaccgacggttaccccgtagggtaaacgggtaccggaaccccggggtaacggaaaccccggtaaccccgggggtaacccctaaactttaaacgttttaaagttttaaaccggttttacggttaaccggttaacccggttaaaaaccctttttttcccggttttttaacggttaaccgttttaggggtttttaaaccttttacccgtttaacccccgttaacgggtttaccggtaacccgtaaccgggttaccgggggttaccccgggtaaaccggggttaaacccccgtttccgggttaccccgtaaccccggtttacccgttacccctacccgttaaccgcccccgttaacccgaacccggtaaacccgggccccttaacggttccccggttacccctttccccccggttacgaccccgtaccccccgttacccttaccccggaaaccggtaccgacccctaacccccgg

SEQ ID NO: 117027 - DNA, 621 bp, Homo sapiens
  misc_feature: GYAE6OF02G9I7Y.36.35.D02.1.454.CMB.1.raw
  modified_base (247)..(247): a, c, t, g, unknown or other
  misc_feature (247)..(247): n is a, c, g, or t
  modified_base (617)..(617): a, c, t, g, unknown or other
  misc_feature (617)..(617): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgcaagtccagccggtagttgttttaanacaactccaagaataagagtttcttagcttaggtaccagtacaacgaaaccacgacacgccctactaacgctgcttacggtttacgtcgggtccttccgtaacccggggtaacttccccgggggtaccctaggtaaccgtacttcgagggtcgggccgggtcggggtcgtcgggactagtactttccacctctacactagtcacgcaacgccgtcggcgggtctagaagtagtcggttcgggttacgttttacttacgtcgtacacgtactagttacttagttcgttacttcctactacgttacgtttcggacgacgggtaccacgcgtggactagtacgacgtacgtacgtggtacgcgtcgacacgtntccg

SEQ ID NO: 117028 - DNA, 583 bp, Homo sapiens
  misc_feature: GYAE6OF02FVJSG.36.35.D02.1.454.CMB.1.raw
  modified_base (249)..(249): a, c, t, g, unknown or other
  misc_feature (249)..(249): n is a, c, g, or t
  modified_base (323)..(323): a, c, t, g, unknown or other
  misc_feature (323)..(323): n is a, c, g, or t
  modified_base (385)..(385): a, c, t, g, unknown or other
  misc_feature (385)..(385): n is a, c, g, or t
tcagtacgctgtctcacgaccggtgctcgatttagcacacgatagttgggtttgggggagctacaacaggcaggcaggggcagcaagatggtgttgcagacccaggtcttcatttctcctgttgctctggatctctgttactacaggtgccgtacggggacatcgtgatgacccagtctccagactccctggctgtgtctcgtgggcaggagggccacgatcaactgcaagtccagccggagtgtttanacaactccaaagataagagttctttagcttggtaccagcaagaaaccagacagcctactaagctgctcgttacngggcctcgtaccgggaactccgggtcctgaacgtattcaggtcggcggcgggtctggggacnggtattcgactctcaccatcagcagtcctggcggctacgaagtagttggtaggttcggttttatacgtcgtcgagtcaaggttattacgttcgtttacctccttactacgttagttttccggaccgtacgggaccaaggtcgtaggacgtacgttcggaccgtacggtacgttcggtacggtcgtacgaccgtaaccg

SEQ ID NO: 117029 - DNA, 811 bp, Homo sapiens
  misc_feature: GYAE6OF02HPLOF.36.35.D02.1.454.CMB.1.raw
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
tcagtacgctgtctcacgaccggtgctcgatttagcacacgatagttgggtttgggggagagaggagcccagccctggggattttcaggtgtttttcatttggtgatcaggactgaacagagagaactcaccatggagtttgggctgagctggtctttttcttgtggctaattttaaaggtctcctgtgagctctggattcacctttgacaagtgtgccatcgacctgggtccgccgaggcctaccgaggggaacgggggctgggaggtgggtctacgtagtttattaggtggtaggttggtagtagcaanagtattacgnacgactcggtaggacgggtccgtcaccatcctaccagaacgactaacttaccaagagaccacggtctagttaattttcgactaacgtagtaacgaaacctgtacctaggaccgacgtaccgggacggaaccgtaccggacctaattaacgttattagtttagtacggtaacgttaaaccttttccgttttacgtaacggtttacgttttaacttacccgtttaccccgttaaggttccgacccggttaacgggtaccgggggacccggtaacccggggtaaccccggttccgggtacccgttaaccccggttccccgttaccgtacccgtacccgggtaccccttaacccccggaaacccgggtaaacccggggttcccctaacccgggttttccccgggttacccccccggttttccccccggacccgttccccttaccccccggttacccgaaccccggtaaacggtccgacccccggttacccgggg

SEQ ID NO: 117030 - DNA, 805 bp, Homo sapiens
  misc_feature: GYAE6OF02GPAH8.36.35.D02.1.454.CMB.1.raw
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtggtctttttctgtggctattttaaaaggtgtccagtgtgaggtgcagctgctggagtcgtgggggaggtcgttggtacgagggcccgggggggtccctggacgtacttcctccgtggttagaacgccttcgtggtacttccgtacctttagactaagtgtcgaccagttacgacccgtcggggtcccgccggacggtcccgttacccgggaaacggggggaacgggggtccgttaggggaacgggttcgggttcgttaccggttaaggttttaagttttagggtagggtttagggttacggggttaaacggttacggaccgtaacgtaaggttaacgtttaacccggactaacgggtaaccttccgggtaacgggtaacccgggggtcccggtttaccacccgtaacccttcctaccgaagtaacgaaccgtaacgttacccaaacgaccggacctaacggtccgttagtttacttcggaacctactaatcgaaacctacgccgtagacggacgtaccggaaccggacgaacccggactacttaagttagtttaagttggtaccgtaacgttaaacccgtttttccgtttaagttaccgtttaggttttaaacctttacccggtacccgttagttcccgtaaccccggg

SEQ ID NO: 117031 - DNA, 779 bp, Homo sapiens
  misc_feature: GYAE6OF02H4TYH.36.35.D02.1.454.CMB.1.raw
  modified_base (261)..(261): a, c, t, g, unknown or other
  misc_feature (261)..(261): n is a, c, g, or t
  modified_base (296)..(296): a, c, t, g, unknown or other
  misc_feature (296)..(296): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacgggacatcgtgatgacccagtctcagacctcccgtggctgtgtcttcgtgggcgaggacgggccaacgactaccaactcgcaaacgtccgaacgccggtagtttcgttttaanaacctaactaccaaagtaataagtatttctttagnttcggtaccacgacaacgaaaccacgacaccgcctacctaagtctcggtccttcgttacgcgggtaccctaccgtacccggggtaacgtccccggggtcctaggaacgtcgttacgaggtcggggccggtcgggtcgtcgggaactcggttaactttaccgacttcctacctaaccgtactacgaacgtccgtccgtcccggtaccgggtccgggtacgtacgggaacgttacggttacggggttaccggttttacgggttttaacttttacggttacggtacgaaccggttacgttaaagtttaacgtttaacgtttaccgtttacccgtttacccgtaccgttaaccgttttacggggtttaccgggaacccgggtaacgggggtaaacctaccgggtcggtagggtaacgtaccgttaccggaccgttaaaaccggtccgttacgggtccggtagtacccggtactacccctgttacccg

SEQ ID NO: 117032 - DNA, 908 bp, Homo sapiens
  misc_feature: GYAE6OF02HP99V.36.35.D02.1.454.CMB.1.raw
tcagtacgctgtctcacgaccggtgctcgatttagcacacgatagttgggtttgggggagctacaacaggcaggcaggggcagcaagatggtgtgcagacccaggtcttcatttctctgttgctctggatcgtctgttactacaggtgcctacgggacagtcgtgatcgaccctagtctccagacctcccgtaggctgtgtctcgtgggcgtagacgggccacgataccaacgtcgacgtaacgtccacggtccggtagttacgttttaagacctaaaccttaccgaaaggtaactaaaggtacgttttaccgtttaacggtaccgttttacgggttaacccgaggtacccgtaaacggaaaacccccgtaaccggtaacccgacggtaacccccgttacccgttaaaacgggccctttaacgggttcccttttacggggttttacccggtacggggtaccccgttacccggttaaacccccgggggtaacggtttccccccgggggttaacccttagggtaaacccgttagtttaccggtacgggtttacggggcccggggttccggggtaccgttcggggaaaccttacggttaacttttccccggaacctttaccgtacccgtaacctaacgttccgtaaacggtcgtaaccggtccgtcgggtcccgggtacgtaacggtaacggtacgttacgggttcgggttacggttttaaccgtttcgtacgggtaccgtaggtacgttaaggttaacgttaacgtttaccggtttaccttacccgttacgtacggttaacggttttccgggaacccggtaggggtaaccgtaacggtacggttacggaacggtaacgtccggtaccgtaacggttacgtcgggtaccggtccgtcggtaccgtaaccgg

SEQ ID NO: 117033 - DNA, 829 bp, Homo sapiens
  misc_feature: GYAE6OF02FJ5K2.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctgatctctgttactacaggtgcctacggggacatcgtgatcgacccagtctccagactccctggctgtgtctcgtggcgagacgggccagatcaactgacaagtccaggccggtgtacgttttacactaactccgaaagtaataaacgtacgtttccgttttaagtccgttttacggtaaccgacggcctaaaccgaaaacccgaccggtaaccgtaacggtccccttaccggtaaacgtccgtacgggtaccttttaccgttttaacccgggttcgggtaccccctttacccggttaaccccccgggggtaaacggttccccggggggtacccctacggtaaacccggtactttacggtacgggttcggggacccgggttacggggggttacgtacgggggaacctaggttacgtttacctaccgtccctacaaccgtacgtaccacgggtacccgtacgtcccggtgggaccgggtacgtacggtaacggtaacggttgggtaccgggttacgtttaacgttacgtcgtaccgacggtactaacgtttatttacggtttactaccttaccgtacctaggtttacggtttaccggaccggttaccggggaacctacgggtaacgttacgggaacggttaaccgtaccgggtccgaagggttaacccgttgggttaacggtcccgtccggaaccttaacccgg

SEQ ID NO: 117034 - DNA, 879 bp, Homo sapiens
  misc_feature: GYAE6OF02F7E9A.36.35.D02.1.454.CMB.1.raw
tcagtacgctgtctcacgaccggtgctcgatttagcacacgatagttgggtttgggggagctacaacaggcaggcaggggcagcaagatggtgttgcaggacccaggtcttcatttctctgttgctcgtggatctcgtgttactacgaggtgccgtacgggacagtcgtgatcgacccagtctccgagacctccgtggctgtgtcgtcgtgggcgaggcggccagactcgaactgacaagtccgaggtccggtagttacgtttacacaacgtacgaaaggtaacgtaagtacgttttcgttaaggtccgtttacgggtaaccaggtaccaaacggtaaaccctaccgggaacaaccggtccccttaaccgtaacggtccgttacggtaccgttttacgttaccgggtaccggtaccctttacccgggtaaaccccggggttaaccggtccccgggggttaaccctaaggaaacccggttcgttacggtaacggggtccgggtcgggttaccggggtcggtaacggggtataccggttaacgtttacccgtacgtacccgtacacccgtgtacccgaagtcccggtacgtacccggtacggtaccggggtaccttaagggaaacgtttcggttcgggttacggggtttaaccgttttaacgttaccgtacggttccgtaaggttccgttaaacggtttacgttttacgttaaccgtttacccgtttaccgttaaaccggttcggttttaaccggggttttgggaacccggtttacggggaaacccttagggttaccggtaacggttacggtaaccggttaccggaaccgtttaccggtaacgggtttccgggttacgcccggttagaccccgttaaccgg

SEQ ID NO: 117035 - DNA, 842 bp, Homo sapiens
  misc_feature: GYAE6OF02ILDG0.36.35.D02.1.454.CMB.1.raw
tcagtacgctgtctcacgaccggtgctcgatttagcacacgatagttgggtttgggggagctacaacaggcaggcaggggcagcaagatggtgttgcagaccccaggtcttcatttctctgttgctctggatctctgttactacaggtgccgtacgggacagtcgtgtatcgacccagtcctccacgtacctcccgtggctgttcgtctcgtgggacgaggacgggaccacgtactaccaacgtcgacgaacgtccgacggtaccggtagttacgttttacaacctaacctacaaaagtaataacgtagtttacttagtcgttaggtaaccacggacaaacgtaaacccacgaacctaccggtacctaaccgtaagtcgtcgtaccgttacggtttaaccgcgggtccctaccggtaaccccgggtaccggttccccgggtacctaacggtaaccgtagtttaccggaacgggttcggggcccgggttaccgggtcggtaaccgggtaacgtacggttactttaccctaacccgtcctaaccgaacctaccgtacgtaccgtaccgtaccggtacccggtaggacccggggttctaaacgggtaacggtacggtttacggggtttacggttaacccggtttttaatttacccgggttacgaacggttacgttaaccggttaagtttaacttttacgttacccggttttacctacccggttacgttaacggtttcgggtttacccgaaccgggttacgggtaaccgaaggttcggtaggaacgttacccgtcgtaaccgtaacggtacttcgggtaccggtaccgtaccgtaccgttaacccg

SEQ ID NO: 117036 - DNA, 816 bp, Homo sapiens
  misc_feature: GYAE6OF02FJP2T.36.35.D02.1.454.CMB.1.raw
  modified_base (142)..(142): a, c, t, g, unknown or other
  misc_feature (142)..(142): n is a, c, g, or t
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctctggatctctgtactanaggtgcctacggggacatcgtgatcgacccagtcctccagtacctccctggctgtntctcgtgggcgagnggccacgatccaactgacagtccagccggagttgtttaacactaactaccaagtaactaagtacgtttctttaagcttaggtaccagcaacgaaccagaccacgtacctactaagcttcgtccttcggtttacgtcgggtccctaccggtaaccccggggtaacgttccccgggggtaccctagtaaacccggtctttaccgggacggttccggggaccgggtccggggttacgtacgggggtaacctaacggttacgttttacccgtaccttccgttaacccgtaacccgtaccgtacccgtaacgtaccgtaaccggttacccggtacgggtacccggggtaccggttaacggaaacgggttaaacggttcgggtttaccggggtttaacgggtttttaccggttaacttccgggtacggttaacgtaccggttaagtttaaacgttttacgtttaaccgtttaaccgttacccgttaccttaccggtttacggtttaccggggaccgttacgggaacccgtaacgggttaacgtcgggaacggttaccggtaccgaaccggtaacgttaccggttacggacggtccgtacggacctaaccg

SEQ ID NO: 117037 - DNA, 1008 bp, Homo sapiens
  misc_feature: GYAE6OF02F8OOX.36.35.D02.1.454.CMB.1.raw
tcagtacgctgtctcacgaccggtgctcgatttagcacacgatagttgggtttgggggagctctgagagaggagcccagccctgggattttcaggtgttttcatttggtgatcaggactgaacagagagaactcaccagtggagtttgggctgagctggtcttttcttgtggcttattttaaaaggtgtaccagtgtgaggtgcagctgcgtggagtcgtggggagtctggtacgacgggtcccggggggtccctaggacgtaccttcgtcctgtagaacgtccgtacgtggtactttcctaacgttttcgaacgtaaggtcgtcgtaccgtagtcggacccgttcggggtaccccgaccgtagggtacccgttcccgggaagggggaaagggggtccgttaggggaacgggtttcggggttcctaacggttaggtttaaacgtttagggttaggggttaacgggttaggttacggtaagtaccgtaaacgtacggtaaacgtttaacggactaaaccggacccggtttacccgggtaggggtaaaacccggggttccccgggtttaccgtaaacccgtaacgttttacccggaaaccccggtaaaggggtaaaccttaaaaccccggttaaaccgttttaaaccccgaaaacccgtttaaaccgggtaaccccggttaaccggttaaacggtttaccgggtttttaacggtttaacccgtacccggtaaaaccttacggttaaccgtaaaaccccggttacggtccccggttaaaggggaaccggtaaaccggaacccggggaaaacggaccccggtaaacccgacccggtttaaagtaccgttttaaaacgtttaacgggttttccggttaaaccggaaacccggtttttaaccctttttaaccggggttttacccgttaaacggtttaccgggttttttaaaacccgtttaaccccggtttaacccccgtttttaccggggtaaaccccgttaaccccccggggg

SEQ ID NO: 117038 - DNA, 605 bp, Homo sapiens
  misc_feature: GYAE6OF02F6CTN.36.35.D02.1.454.CMB.1.raw
tcagtacgctgtctcacgaccggtgctcgatttagcacacgatagttgggtttgggggagctacaacaggcaggcaggggcagcaagatggtgttgcagacccaggtcttcatttctctgttgctctggatctctgttactacaggtgcctacgggggacatcgtgatgacccagtcctccagactccctggctgtgtctcgtgggcgagagggccagatcaactgcaagtccagccggtagtgtttaacacaactccaaagaactaagagttctttagcttggtaccagcaagaaccacgacagcctacctaacgctgtctcgttactcgggcccttacgtaccccggggtaatccggggtccctagaaccgatttcgagtccgggcgggtacgggtctcgggacaggtactttcgacctctacacctacacacgtcacgtccgtggcgggtctacggaagagtgtgggttacgttacttacgtgtccagctagttattactcgttacgtccttccgtacttagtttcgggaccgtaggggaccgtacggtcggtacggagtccgtacgaccacgaacgttcggtacggcgtacgacgtaaccg

SEQ ID NO: 117039 - DNA, 980 bp, Homo sapiens
  misc_feature: GYAE6OF02GRD1Y.36.35.D02.1.454.CMB.1.raw
  modified_base (484)..(484): a, c, t, g, unknown or other
  misc_feature (484)..(484): n is a, c, g, or t
tcagtacgctgtctcacgaccggtgctcgatttagcacacgatagttgggtttgggggagagaggagccccagcccctgggtattttcaggttgttttcatttggtgatcaggactgaacagagagaactcaccagtggtaggtttgggctgagcgtggttctttttcgttggtggtacttaaagttttaaaacggtcctccgttgtagaacgtccgttcgtcggtacttcctacctttagaacgtaagtgtcgaccagtcgaccgtcgggtcccgccgaggtccgtccggaagggggaacgggtcgtagggtaggtcggtctcgtagtttattagggtggttaggttggtagtagactacgagtacgttacgctaaggtaccttaccggaggtaaccgggtcccgttaccgaaccctagtacccgtaccgaggtaactaacctaacctaaccaacgacgaccaccgtacttgttaacttcganaacccgtaagaccgtaaacgtacgaccgtaggaaacgtaccgggaccgaaacggggaccgaccggtaacctaagtttaaacgtttaagttttacggttacggtaccggttaaacccgtttaaaccttttacccggtttttaggttacccggttttaaacgtttttaaccgttttaaaccccgtttaccccggttaagttaccccggtaacccgttaaccggggttacccggggtaacccgggtaacccccgggttttaaacccggtcccgggttaacccccgttaccggttaccccccgttaccgttacccccgtaacccgggttaccccccttaccccccgggtaaaacccgggtaccccggtaaccccccgggtttaacccgtttccccccgggtttacccccccctttcccccgggtaccccgttaccccccgtaaccccccgtttccgaaacccccggttaccgtacccggtacccccggtaacccccgggg

SEQ ID NO: 117040 - DNA, 691 bp, Homo sapiens
  misc_feature: GYAE6OF02JG1R2.36.35.D02.1.454.CMB.1.raw
tcagtacgctgtctcacgaccggtgctcgatttagcacacgatagttgggtttggggagctctgagtagtaggagcccacgccctgggacttttccaggtgttttcagtttggtgatccaggactgaacagagagaacctacaccaatcggagtttgggcttggagcgtggtcttttctgtggctaatttaaaggtgtccagtcgtgaggtgcagtctgctggaggtccgtggggagcgttggtacgaggtcccggggggtccctagacgactcctaccgtgtagacgcctgcgacttcgacctttgactagtgtcgccagtcgccgtcgggtcccacgacggcctccggagggaacgggcgtacggacgttgggtctacgtaggtttattaggtcggttagtgggattagacagtagtattacgcgtaacgtaccgtcggaggtaacgggtcccgttacgaacccgtgtaccccgtacgaacgtaccgtaataacgttaacccaacgtacgaccgtacgtacctaggttacgttacgaccctaagtctaggtaaccttacggtaccttagggaaccgtcggtcccgaacgggtacgccggtaactaagttactaccgtttagttccgaccgtaacgttaccttttcgtagtctttagtttaccttacgtacccttaggtccctaacccgg

SEQ ID NO: 117041 - DNA, 774 bp, Homo sapiens
  misc_feature: GYAE6OF02JH6XO.36.35.D02.1.454.CMB.1.raw
  modified_base (245)..(245): a, c, t, g, unknown or other
  misc_feature (245)..(245): n is a, c, g, or t
tcagtacgctgtctcacgaccggtgctcgatttagcacacgatagttgggtttgggggagctacaacaggcaggcaggggcagcaagatgtgttgcagacccaggtcttcatttctctgttgctctggatctctgttactacaggtgcctacgggacatcgtgatgacccagtctccagactccctggctgtgtctctgggcgagagggccacgatcaactgcaagtccagccggagtgttttanacaactccaagaataacgagtttactttagcctttaggtacctagcaagaaaaccacggacaggcctaccaaggactggccttacggtttactgggtaccctacgtaccccggggaaacttcccgggggtaccctaggtaaaccgaacttttccgaaggttcggggcggtaccggggttcgttacggggaacctaaggacgttttacccaaccgtttctacccaacctaactacctaaggtaaccgaacgtcccgttacgggccggggtaccgtacggtaaacgtaacgttacgggtacgggttacgggttttaagtttaaccgttcgggtacctaaggtccgttaaggtttaagttacgtttacggtttaacctttcccgttaccgtaaccgttaccgggttttttacgggtaccccggtaacggggtaacccgtaagggtaccggttaagggtaaccggaacttaccgggtaaccctaaccggtaaccgttacggttacgggtaccttaccggcccgttaaacccgg

SEQ ID NO: 117042 - DNA, 678 bp, Homo sapiens
  misc_feature: GYAE6OF02I1D1U.36.35.D02.1.454.CMB.1.raw
  modified_base (268)..(268): a, c, t, g, unknown or other
  misc_feature (268)..(268): n is a, c, g, or t
  modified_base (513)..(513): a, c, t, g, unknown or other
  misc_feature (513)..(513): n is a, c, g, or t
  modified_base (541)..(541): a, c, t, g, unknown or other
  misc_feature (541)..(541): n is a, c, g, or t
  modified_base (560)..(560): a, c, t, g, unknown or other
  misc_feature (560)..(560): n is a, c, g, or t
  modified_base (569)..(569): a, c, t, g, unknown or other
  misc_feature (569)..(569): n is a, c, g, or t
tcagtacgctgtctcacgaccggtgctcgatttagcacacgatagttgggttggggagctacaacaggcaggcaggggcagcaagatggtgttgcagacccaggtcttcatttctctgttgctctggatcgtctgttactacaggtgccgtaaacggggcatcgtgactgaccctagtcctccagtcctcctggtctgtgtctcggtgggaccgaggtcggccagataccaacgtgacacgtaccaggtccggtagtttacttttaanaccaacgttaacccaaaggtaaacgttaacgttagttttccgttaagttccgttacggttaaccaggtaccaaaccggtaaaaccacggtaacctacggtacccttaaccgaacgtccgtacgtacgttcgttttacggcggtaccctacccggttacggaccggtccgggttcccaggtaacgtcttcgaagggtcggtcgggtacggtcgtacgatacgtacttccgacgtctcgactacgtnacgccgacgtcgtacgcgtacgtaacgntacgtgtcggttgtttacncgtgtaccngtactaggttaactctttacgtcctgtacgtgttaccgtgaccggccgtaaggcgtgggttacacgggtactccgacgtaacgttcgtcggtaacgcgttaccgctaag

SEQ ID NO: 117043 - DNA, 769 bp, Homo sapiens
  misc_feature: GYAE6OF02JNQF0.36.35.D02.1.454.CMB.1.raw
  modified_base (464)..(464): a, c, t, g, unknown or other
  misc_feature (464)..(464): n is a, c, g, or t
  modified_base (527)..(527): a, c, t, g, unknown or other
  misc_feature (527)..(527): n is a, c, g, or t
  modified_base (542)..(542): a, c, t, g, unknown or other
  misc_feature (542)..(542): n is a, c, g, or t
tcagtacgctgtctcacgaccggtgctcgatttagcacacgatagttgggtttgggggtagctacaacaggcaggcagggcagcaagatggtgtgcagaccaggtcttcatttctctgtgctctggatctctgttactacaggtgcctacggggacatcgtgagtcacccagtcctccacgacctcctggctgtcgtctcgtgggcgacgacggccaacgatacgtaacgcgtacaacgtccacggaccgtagttacgttttaacaactaactaccgtaaaggtaataaacggtagttttaccgttaaggttccttacggtaaccgacggtaccaaaccggttaaaacccgacggtaaaccaccggtccctaaacccgttacggaccttacggtaccctttacggttttaaccggtccggtaccctaccggttaacccgggggtaaacctccggggttaccccnggtaaaccgtcgtttaacgcggttcggggtaccggtcggggtacgtcgggtaacgtaacgttnttaacccgtctaccncgtaaccacgttacaccggccaacgtccggttcgaccgggtatacggaagttaacgggtgtccgggtttaacgttttaccgtacgttacgtcgacgtaccgttaacgtacgtttagtttactccccgttactacgttaacgttcgtttaccgggaccgtacgggactcgtaacggtcggtagacctacggacctacggtacgtcggtacggactacggctaacccgg

SEQ ID NO: 117044 - DNA, 848 bp, Homo sapiens
  misc_feature: GYAE6OF02I9HBA.36.35.D02.1.454.CMB.1.raw
  modified_base (142)..(142): a, c, t, g, unknown or other
  misc_feature (142)..(142): n is a, c, g, or t
tcagtacgctgtctcacgaccggtgctcgatttagcacacgatagttgggtttggggagctacaacaggcaggcaggggcagcaagatggtgttgcagacccggtcttcatttctctgttgctctggatctctgttactacnggtcgcctacgggacatcgtgatcgacccagttcctccagtacctcccgttggccttggtcgttctccgtggggcgacggtacgggcccaacggacttcaaacgttcgaccgtaaacgtccccgaggtacccgggtaggttttacgtttttaactaaccgtaaccgtttacccgaaaaggtaaacttaaggacgtttttacttttaacggtccgtttaacggtaaccgtaacggacctaaacggaaaaccccgaccggtaaactacccgtcccgttaacccgtaacgtaccttccggttcctttaaccggttttaccgtccggggtacccctttacccggttaaacccccgggggtaacgttcccccggggggttaccccttaacggaaacccggttctttaccggtacggggtccggggtaaccggggtcccgggttacggttacggggaccttaaggttaccgtttttacccgaaccgtttccctttaccgaacctcgttacccgagtacccgaacgtccggtacggtccggtactaaggtaccggtaacgttcggttcggtttacggtttacttaccgtggtacctagaacggttattactttggtactttaccgctaacgtcgttacggtttaccgacgggacggtactaggtcgttaacggacgctcgaactacggacttcggcgactccgacctactacc

SEQ ID NO: 117045 - DNA, 589 bp, Homo sapiens
  misc_feature: GYAE6OF02H8PLN.36.35.D02.1.454.CMB.1.raw
  modified_base (284)..(284): a, c, t, g, unknown or other
  misc_feature (284)..(284): n is a, c, g, or t
  modified_base (334)..(334): a, c, t, g, unknown or other
  misc_feature (334)..(334): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (452)..(452): a, c, t, g, unknown or other
  misc_feature (452)..(452): n is a, c, g, or t
tcagtacgctgtctcacgaccggtgctcgatttagcacacgatagttgggtttgggggagctacaacaggcaggcaggggcagcaagatggtgttgcagacccaggtcttcatttctcgtgttgctctggatctctgttactacaggtgccgtacgggggacagtcgtgtatcgacccagtctccagtacctcccgtggctgtgtctcgtgggcgaggacgggccacggatacaactgacaacgtccagccggtagttcgtttatacaactccaaagaataagngtttctttagcttaggtaccagacaaacgaaccacgacagcctcaagtcngctcgtttacgcgggacctacgtaaccggggacgtccgggtcctagaacgtacttgaggtcggcggcggtgcgganagtcttcactcgacacntcngacgcncgtggcggctaggtangttgtggttcgttagttctagacgagctagtattagttcgttacttacctctacgttcggttcggtacgtacggggactaacggcgtaggacgtacgtacgaccgtacggtaacgtcggtacgtacgtcgtactacg

SEQ ID NO: 117046 - DNA, 692 bp, Homo sapiens
  misc_feature: GYAE6OF02G1D3R.36.35.D02.1.454.CMB.1.raw
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
  modified_base (553)..(553): a, c, t, g, unknown or other
  misc_feature (553)..(553): n is a, c, g, or t
  modified_base (611)..(611): a, c, t, g, unknown or other
  misc_feature (611)..(611): n is a, c, g, or t
  modified_base (678)..(678): a, c, t, g, unknown or other
  misc_feature (678)..(678): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgtgctctggatctctgttactacgaggtcgccgtacggggactagtcgtgactcgacccgtagtcctaccgacgacctcccgtggtctgtcgttcgtcggtgggacgacggaccggccaacgtacgtaccaacgtgacgtaacgtaccgacggccggttagttcgttttaacacgaccgttaccctaaccgaaaactaacgttaaacgtaacctttaacgttaaccggttacggtaaccaacggaccaaaaccggaaaccgaggaaccgacttacccctaacgtaacgttccgactacgttacgttaccggcggtactaaccggtcccggtaacccgggtacgtcccgtacgcgtaacgtacgtcgacggtcgacggtcggtcggtagtgacgtgttacttcacctnacctaacncgagtacgccagtcgacgngtcggacgtagtcgtagtcggattatcgttattacgcgtacacgtattaagttacgtntaacggccttctacgtcgttaggtccggaacggttaacgcgtaggttacgataaccgtcgtagggtncggttaggctaacg

SEQ ID NO: 117047 - DNA, 747 bp, Homo sapiens
  misc_feature: GYAE6OF02F4H9C.36.35.D02.1.454.CMB.1.raw
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagcgtggctttttcttgtggctattttaaaggtgtccagtgtgaggtgcagctgctggacgtcgtgggggaggcttggtacgaggcccggggggggtccctgagactctcctgtgaagcctcgtggattcctacctttgacaaggtgtgccatcgacctgggtcccnccgaggcctccgaggggaacggggctagggagtgggtctntagttattggtggtaggtggtaggtagtcaacgagtaacttacggctaggacccttccggtagggaaaccggggcccgtttacgaacctacgttcctacccgaagacgaacctaaactttacccgaaacgacgacccacggtccgttacgttattttcggacctaacaagttacgaaacccgtacgtacccgtaggaacggaacgggaccccggaacgggaaccctaaccgggaccctaagtttaacgttaactttttaggtttacggttaacggttaaacccggtttaaaccgttttttccccgttttttaacggtttacccggtttaggttttttaaaccctttacccgttttaaccccccgtttaaggttacccggtaacccccgg

SEQ ID NO: 117048 - DNA, 654 bp, Homo sapiens
  misc_feature: GYAE6OF02IQ334.36.35.D02.1.454.CMB.1.raw
  modified_base (139)..(139): a, c, t, g, unknown or other
  misc_feature (139)..(139): n is a, c, g, or t
  modified_base (150)..(150): a, c, t, g, unknown or other
  misc_feature (150)..(150): n is a, c, g, or t
  modified_base (166)..(166): a, c, t, g, unknown or other
  misc_feature (166)..(166): n is a, c, g, or t
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (340)..(340): a, c, t, g, unknown or other
  misc_feature (340)..(340): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
  modified_base (476)..(476): a, c, t, g, unknown or other
  misc_feature (476)..(476): n is a, c, g, or t
  modified_base (500)..(500): a, c, t, g, unknown or other
  misc_feature (500)..(500): n is a, c, g, or t
  modified_base (562)..(562): a, c, t, g, unknown or other
  misc_feature (562)..(562): n is a, c, g, or t
tcagtacgctgtctcacgaccggtgctcgatttagcacacgataggttggggtttgggggagctacaacaggcaggcgaggggcagcaagatggtgttgcagacccaggtcttcatttctctgttgctcgtggactctntacgttacagnggtcgacgtacgggantcgtgntcgaccngtcncagcctcgngngtntcgtcncgagggacaaggcggaccttaacgatacggactgacaacgtccgagtccggaagtttntttaacgaactaccggtacaaaagtagtaaggttctttcgtgtaaccgtggaaacaggtacaaaccggaaacttcgaanccgtaccctaagtacgctaacgtcgtttagttaaccggcgacccgtttacgaaccgggaacgtcccgggttanacgataccgngttcggaaggtcgacggttnaaggtctaaaggtcttcccgatgaaccgtcaancgaatcgtacgcgtaggaccggtnagtagcgtagttcgtatacgtcaggtccgaagtctattaaccgttccggtataccgtcgtanacgggttgaacccgagggtaactccgcggtaagtcgtcccggtacgaaaccggtcaccgggttaacgttcccgggaatcgggaacccctttg

SEQ ID NO: 117049 - DNA, 634 bp, Homo sapiens
  misc_feature: GYAE6OF02J1GQL.36.35.D02.1.454.CMB.1.raw
  modified_base (315)..(315): a, c, t, g, unknown or other
  misc_feature (315)..(315): n is a, c, g, or t
  modified_base (377)..(377): a, c, t, g, unknown or other
  misc_feature (377)..(377): n is a, c, g, or t
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtgcctacggggacatcgtgatgacccagtctccagactccctggctgtcgtctcgtgggcgaggacgggccacgatcaactgcaacgtccgagccggtagttagtttaacaccaacgtacctaagtaataaggtactttacttagtcttacggtaccagcaacgaaccacgacncgcctacaagctgtctcgttacgcggtcctccgtaccggtacgtcccggggtactagtactntcgaggtcgggccggtcgggtctagggtactagtacttcaccgtacctccgtacactcgacggtccacggtccggtcggcggtcgtaggtaagtcgtggttacggttcgtttactcgtcgtacgtacgtactagttagttacgttacgttcctacgtcttaacgttcgggtttaccggaaccgtagggtaaccgtagtcgtaaggtggtacctacgtcgaaacggtcgtcggtacggtctacggcctacgtattccg

SEQ ID NO: 117050 - DNA, 797 bp, Homo sapiens
  misc_feature: GYAE6OF02JK52B.36.35.D02.1.454.CMB.1.raw
tcagtacgctgtctcacgaccggtgctcgatttagcacacgatagttgggtttggggagctctgagagaggagcccagcccctgggattttcaggtgttttcatttggtgatcaggactgaacagagagaactcaccatggagtttgggctgagctggtctttttcttgtggtcttattttaaaaggtgtccagtgtgaggtgcagctgctggagtcgtgggggagcttggtacgagggccggggggtcccgtgagaccgtctccgtgtcgaacgtcctcgtggtattcctaccgtttgaacctaaggttcggtacgtccgagtacggtacccgttcggggtcccgaccgtacgggccgtaccggaacggggaaacggggtcgtacggggtacggtacgggttccgtacgtaacgtttaaggttaaggttaggttaaggttcgggtaggttaagcgtaaacgtgtaacgttacgactaccggtaaccgtccggttaggaaacggggtcccgttaaccgtacccgacgttcctaccgaacgacgtaacctaacgttacccaaacgtaccggaccgaccgtacgttcgttaacgttccgtaacgtaccctatacggaaaacctcggtaccccgtaaggtaacggaccggaccggaacgggtaaccgaacccgggtaacctaagtcgtttaaagttacgttcggttaaccgtacgggtttaaacccctttacggttttactaaccggtttcgtttaaacccgttttacccgtttacccgttacggttacccgtaacccgg

SEQ ID NO: 117051 - DNA, 184 bp, Homo sapiens
  misc_feature: GYAE6OF02HEX0B.36.35.D02.1.454.CMB.1.raw
  modified_base (173)..(184): a, c, t, g, unknown or other
  misc_feature (173)..(184): n is a, c, g, or t
tcagtacgctgtctcacgaccggtgctcgatttagcacacgatagttgggtttgggggaagaggaagactgacggtcccccaggagttcaggtgctgggcacagcggccctgggctgcctggtcaaggactacttccagacagcgtactgagcgggctggcaaggcgcatagnnnnnnnnnnnn

SEQ ID NO: 117052 - DNA, 750 bp, Homo sapiens
  misc_feature: GYAE6OF02IIDKX.36.35.D02.1.454.CMB.1.raw
  modified_base (509)..(509): a, c, t, g, unknown or other
  misc_feature (509)..(509): n is a, c, g, or t
tcagtacgctgtctcacgaccggtgctcgatttagcacacgatagttgggttgggggagctacaacaggcaggcaggggcagcaagatggtgttgcagacccaggtcttcattttcgtctgttgctctggatctctgttactacgaggtcgccgtacggggactagtcgtgatcgacccagtctccagcctcctggctgttgtcctgtgggccgagacgggccgacgtactacgaacgtcgacgaacgtccgacggtccggtagtttcgttttaacaactaaccgtaccgaaaagtaaagttaaacggtacgttttcgtttaacggtcgtttacggtaaccacggtaaccaaacgaaaaccgtaccgaaccaccggtaccctaccgtaaggtcctacgtccgtttacgtttaaccgtccgggtaccctaccgggtaacccggtacgggttccccgggtccgtacgaaccgttagttcgaggtcgggccgggtcggtacgtggggtaacngttactttccgactccgtacaccgtagtccgaacggcgtaaccgccggttcgggccggtacgtcggtaagtcggttacggttcgggttacgtttaacgttcgtcgtaccgcgtattaggttattacgttctttaccgtacgtacgtacgtttggttacgccgttacgggaccttagggccgtagggtacaccggtaccgtaacggtacggtacggtacggtccggtacggtcccagtcccg

SEQ ID NO: 117053 - DNA, 610 bp, Homo sapiens
  misc_feature: GYAE6OF02GMSWW.36.35.D02.1.454.CMB.1.raw
  modified_base (400)..(400): a, c, t, g, unknown or other
  misc_feature (400)..(400): n is a, c, g, or t
tcagtacgctgtctcacgaccggtgctcgatttagcacacgatagttgggtttggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgctggagtcgtgggggaggcttggtacaggccgggggggtccctgagactctccgtgtgagcctctggattcgacctttcgacaagtgtcgccatgacctggggtacccgccgaggcctccgtaggggaacggggctaggggagtcggggtcttcgagtttattaggtggtagtggtagtagcacgagattacgnagtacgtccgtagacgggccgtacaccatcctccagaacgtacaacttaccaacagccacgctagtactttcgactacatacgaaaccagtcctagacggagaccgaacggacaccgggacctatattattagttgtacggtaccgttaacttttccgttttaagtacgtttaggtttaacttaccgtacccgttacgtacgtaacccgg

SEQ ID NO: 117054 - DNA, 686 bp, Homo sapiens
  misc_feature: GYAE6OF02FWZ5S.36.35.D02.1.454.CMB.1.raw
  modified_base (329)..(329): a, c, t, g, unknown or other
  misc_feature (329)..(329): n is a, c, g, or t
tcagtacgctgtctcacgaccggtgctcgatttagcacacgatagttggggtttgggggagctacaacaggcaggcaggggcagcaagatggtgttgcagacccaggtcttcatttctctgttgctctggatctctgtactacaggtgccgtacgggacatcgtgatcgacccagtcctccagtacctcccgtggccttgtcgtctcgtgggcgagacggccacgtactacacgtgacaacgtccaggccggtagttgtttaacacaacaccgtaaagtaagtacgtacgttacgtttaagcgttacgtaccacgacaaccgaaaaccncgaaccgacgtccctacgtaacgtcctggtacctttacggtttacgccgggtacctccggtaacccgggtacgttcccggggtaccctaagtacgtactttacggacgggtcgggcggtccggttcgtagggctaaggttcttctaccgtctcgtacatcgagtcgtacgccgtacggccggtacgtaacgagtaggttcggttaggttacggtttacttacgtgtacgacttcgtaagttacgtttacgttacttacccgtcttacgtacgttacgttcggaaccggtacggaccgtagtcggaggtaacgtccgtacgtaccgacgtacggttacggtcgtacgtcgtacgtacc

SEQ ID NO: 117055 - DNA, 751 bp, Homo sapiens
  misc_feature: GYAE6OF02GOA8F.36.35.D02.1.454.CMB.1.raw
  modified_base (512)..(512): a, c, t, g, unknown or other
  misc_feature (512)..(512): n is a, c, g, or t
tcagtacgctgtctcacgaccggtgctcgatttagcacacgatagttgggtttggggacaacaggcaggcaggggcagcaagagtggtgttgcagacccaggtcttcatttctctgttgctctggatctctgttactacgaggtcgccgtacggggacagtcggtagtatacgaccctagtcctccgagtacctccgtcggctgtcgtctcgtgggcgaggacggccgacgtactacaacgtcgaccgtacgtccgacggccggtagtttagtttaactaaccgtaccgtaccgaaagtaacgtaaggtagtttaccgttaggtccgtttacggacccgtagaaccgaacgtaaacccgacgactacgtaccctacgtaacgccgttacgtcctttacggttacgtccggtcctacggtaacccgggttacgtccccggggtacctaggaccgtagtacggacggtcgggccggtacgggtcgacgggtacagtacttcgacctcgctaacngtaccgacgtacacggtcgcggacgtactaggaagtcggtcggttcggttaccggtttattacgcggtaacctggtaaccgtaggttacgttacgttacgttaccctccggttaccgttacggttaaccgggttccggaaccgggtaaccgtacccggtagtcgggtacgtaacggtacctccggaacgttaacgacggttcggtaccgtccgtacgtacccgtactaccgtttaccgg

SEQ ID NO: 117056 - DNA, 212 bp, Homo sapiens
  misc_feature: GYAE6OF02H5N45.36.35.D02.1.454.CMB.1.raw
  modified_base (162)..(212): a, c, t, g, unknown or other
  misc_feature (162)..(212): n is a, c, g, or t
tcagtacgctgtctcacgaccggtgctcgatttagcacacgatagttgggtttggggacaacaggcaggcaggggcagcaagatggtgttgcagacccaggtcttcatttctcttgttgctctggatctctgttactacaggtgcctacggggacatcgtgnnnnnnnnnnnnnnnnnnnnnnnnnnnnnnnnnnnnnnnnnnnnnnnnnnn

SEQ ID NO: 117057 - DNA, 739 bp, Homo sapiens
  misc_feature: GYAE6OF02GFQ1K.36.35.D02.1.454.CMB.1.raw
tcagtacgctgtctcacgaccggtgctcgatttagcacacgatagttggggtttgggggagctacaacaggcaggcaggggcagcaagatggtgttgcagacccaggtcttcatttctctgttgctctggatctctgttacacaggtgccgtacggggacagtcgtgatcgacccagtcctcagacctccgtggctcgtgtctcgtagggccgaggacgggccacgatacaacgtgacaacgtccgaacggtccgggtatttagttttacaacaaaccgtccgaaagtaaattaagtagttttactttaacggtctttacggaccaggtaccaaacgaaaccacggacacgtcctacgtaacgctacgtcttacgttacgtcggccttaccggtaaccgggtacgtcccgggtcctaggaactgttcgacgggtcgggcggtcggtcgtaggggacctaggtactttccgctactaccgtactactcgtaacgcgacgtcccgttgggacggggtacctaagggtagtacggttcgggtttacggtttaccggtttttaacttacgttcggtaccgaggttaaccgttaagtttacggttttaattcccggtttaaccttccttaaccgttaggtttaccgggtttacggaaccgggacggggtaactaaccgggtggttaaccggaacggttcgaccggtaacggtacgtccggtagggtccgcgttacgccgtaacg

SEQ ID NO: 117058 - DNA, 988 bp, Homo sapiens
  misc_feature: GYAE6OF02HKUSF.36.35.D02.1.454.CMB.1.raw
  modified_base (126)..(126): a, c, t, g, unknown or other
  misc_feature (126)..(126): n is a, c, g, or t
tcagtacgctgtctcacgaccggtgctcgatttagcacacgatagttgggtttgggggagctacaacaggcaggcaggggcagcaagatggtgttgcagacccaggtcttcatttctctgttgctntggatctctgttactacgaggtgccgtacggggacagtcgtagatgacctagtcctcacgacctccgtggctgtacgtcgtcgtgggaccgagacgggccacgacttacgaacgtgacaacgtccaggaccggtagtttacgttttaacactaacctaaccgtaaagtaaacgtaagttacgttttacgttacggtacgtttacgtaacctacgaacgtaaaaccggtaaaacccaccggtaaccgtaacgtcccctaaacgtaacggtccttccggttaccgtttacgtttaccgcggtaccccgttacgggtaaccccgggttacggtaccccggggttaccttaacggtaacggttactttaccggacgggttacgggtccggggttaccggggttacgtacggggtaaccgtaagttaccgtttacccgtaacctttcccggtaacccgtaaccgtaacgtaacccggtaacgggtaaccccgtaccggttaaacccgggttcggggtaaccgggggttacccggttaagggtaaacgggttaacgggtttaccggggttttacccggggttttaaacgggtttttaaaccggttaacccggttacggtttaaccgtaacgggtttaaccgtttaaggttttaacgtttttaaccgttaaccgggtttttaaccccttaacccggtttaacgttaacccgggtttagggtttacccggggtaaccgtaacccgggggtaaccggtaaccggttaaccgggtaacgggttaacggaaaccggttacccggtaacccggttaccgggttaaaccgttcggggtaaaccggtttcccgggtacccgtaaccgttaacccgg

SEQ ID NO: 117059 - DNA, 705 bp, Homo sapiens
  misc_feature: GYAE6OF02HH23C.36.35.D02.1.454.CMB.1.raw
  modified_base (434)..(434): a, c, t, g, unknown or other
  misc_feature (434)..(434): n is a, c, g, or t
  modified_base (499)..(499): a, c, t, g, unknown or other
  misc_feature (499)..(499): n is a, c, g, or t
tcagtacgctgtctcacgaccggtgctcgatttagcacacgatagttggggtttgggggagctacaacaggcaggcgaggggcagcaagatggtgttgcagacccaggtcttcatttctctgttgctctggatctctgttactacaggtgccgtacggggacatcgtgatcgaccctagtcctccagtacctcccgtggacctgtcgtcgtcgtgggacgaggacggggaccacgatacgaactgactaacgtccgacggccggtagttcgttttaacacctaactaccgaaagtaataacggtagtttcctttagctttggaacctagactaacgaaccagaccacggaccctaccgtaacgccgtgtaccgttcgtttacggtcgggtccctaccggtaacccgggtaccgttcccgggtcctagaaccgtntacgggacgtcgggccggtggtcgtacgggacacgtactttccgacttccgtaccacataccganactacgcgtgcgggtactaggaagacgttgggtacggttacgtttaataccgttaggtacacgtcgttaagttacgtttacgttacgttaccttccgttaacgtacggtttagtttacccggacggtaccggaccgtaggtacggtacggaacgtacgtacggtaaccgacggttaacgtcggttaccggacgtcgaccctaccgg

SEQ ID NO: 117060 - DNA, 757 bp, Homo sapiens
  misc_feature: GYAE6OF02GQK5L.36.35.D02.1.454.CMB.1.raw
  modified_base (131)..(131): a, c, t, g, unknown or other
  misc_feature (131)..(131): n is a, c, g, or t
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (377)..(377): a, c, t, g, unknown or other
  misc_feature (377)..(377): n is a, c, g, or t
tcagtacgctgtctcacgaccggtgctcgatttagcacacgatagttgggttgggacaacaggcaggcagggcagcaagatggtgttgcagtacccgaggtcttcgatttctctgttgctcgtggatcgtntgttacacgaggtgccgtacgggacagtcgtagatacgaccagtcctcgagcctccgnggctgtcgtctcgngggcaggacgtccagtactcgaactgacaacgtcgacggccggttagttagtttaacacgtaacctcgaaaagtacgtaaagtcgtttacttacggtacgtttacggaaccnggacctaaacggtaacccaggtaccacgtacctaacgaacgcgtcgtaccttcgttaacggnggtaccccttaacggtacccgggtaagtccccggtctaaggtaacctacgttgaacggggtcggccggtacgggtttccgaagggtactaacgtttccgttaccgctttcccgacgaaaccctggtacgtacggtctaaccgtccgttgggtacggtagtacggtacgttaggtccggttacgggttacgtttacgtacggttgtaccgggtatacgttacgtttaaggttaccttcgttaccgtacgtaccgttcggttaacgttaccggtaccgggaacgtacggtacggtacgtacggtaacgtaccgtacggggtacctaaccggttaacggtccgggtacggttaccaccggtacctaccggtacgtttacccgg

SEQ ID NO: 117061 - DNA, 831 bp, Homo sapiens
  misc_feature: GYAE6OF02G07XZ.36.35.D02.1.454.CMB.1.raw
tcagtacgctgtctcacgaccggtgctcgatttagcacacgatagttgggtttgggggagagaggagcccagccctgggattttcaggtgtttcatttggtgatcaggactgaacagagagaactcaccatggagtttgggctgagctggctttttcttgtggtctagttttaaaaggtctcctgtgaagcctcgtgattcacctttgacacgtgtgaccgatgaccgtcgggtcccgccgtaggcctccgagggggtaaggggctgggaagttcgggtactccgtagttagttaggtggtaggtggtaggtcgtacgacaggattacgctaagaccttccggtggaacgggtccgttaccacctacgtcctaccgagaggaacctaatttcccgaaactacgcaaccgtcgttaggttaacttttcgggacaaccgtagttaacgaaccgtacgtaccgtagaaggtaacggcccggtaagggaccgtacgggaccctaagttaacgttaactttaacgtttaggtacggtaacttaaacccggttttaccctttttaggtaacccggtttagttttaacgtttacccgttttaccccgttaacgttaccggaccccgttacgggttacccggggggtaccgtaaccgggggtaaaccccgtttggtacccgggttaaccccggttccgttacccccgttaccgtacccggaccctttaccccggaacccgtaacccgggtccctaccgggttacccggtccccgtttacccccgtcggtaccccgtacccccttccgtaccccggaacgttaccggacccttacccggg

SEQ ID NO: 117062 - DNA, 1069 bp, Homo sapiens
  misc_feature: GYAE6OF02FZ9J9.36.35.D02.1.454.CMB.1.raw
tcagtacgctgtctcacgaccggtgctcgatttagcacacgatagttgggtttggggacaacaggcaggcaggggcagcaagatggtgttgcagacccaggtcttcatttctctgttgctctggatctctgttactacaggtcgcctacgggacagtcgtgatcgaccagtctccagacctcctggctgtcgtctcgtgggcgaggacgggaccacgagtacaacgtcgacgtaacgtccgacggtaccggtagtttacgtttttaacgaacctaaacctaccgaaaagtaaaacgttaaacggttacgttttaccttttaggaccgttttacgggtaaacccctaggaaccgtaaaacgtaaaaaccccgaaccggtaacctaaccgtaccccgttaaccgttaaacggcccgttagttacccgtttaccggtttttaaccggtcccggggttacccctttaacccgggttaaaccccccgggggttaaacgggtttcccccccggggggttaccccttaaacggggttaaaacccggttacgtttaaccggtaaccggggtttccggggcccgggggttacccgggggttttcccggaacgggggttaacccgttaaaggggttaaccttttaccccgaaaccggttttcccctaacccgaacccgttaaccgtttcccggaaaccggtttaccgaacccggtttccccggtccggggtaacccggggttaccgttaaacggggaaaaccggtttccggtttacggggtttaaccgggggtttaccggttttttaaaccgtttaacggttacgggttaacccgttaaacggttcgttaaacgtttaacgggttttaacgtttaacccggtttttaacccgttaacccgtttaaccgttaacccgttttaagggttttccccggggtaaaccggtaacggggtaacctttaaccgggtccggttaacgggttaaaccggtaccgttacgggtaaccccggttaagttaaacccgggttcggttaaccggaccggtttaccggacccgttacccgttacgtttacccgg

SEQ ID NO: 117063 - DNA, 453 bp, Homo sapiens
  misc_feature: GYAE6OF01DUU9U.34.62.F07.1.454.CMB.1.raw
  modified_base (441)..(441): a, c, t, g, unknown or other
  misc_feature (441)..(441): n is a, c, g, or t
  modified_base (446)..(453): a, c, t, g, unknown or other
  misc_feature (446)..(453): n is a, c, g, or t
tcagtacacgtgatcacgaccggtgctcgatttagtagtcgcataaagggaaaggggctggagtgggtctcatccattagtcgtaacagtacttacatatactacgcagactcagtgaagggccgattcaccacctccagagacaacgccaagaactcactatatctgcaactgaacagcctgagagtcgaggacacggctgtatattactgtgcgagtagttttccctttattgtagtgataccagttgctatgatggggacctttactactggggccaggggaccctggtcaccgtctcctcagcctcaccaagggcccatcggtcttccccctggccacccctcctccaagacgcaccctcgtgggggcacagccggccctgggctgcctggtcaaggactacttccatcacgtgtactgagcgggctggcaaggcgnatagnnnnnnnn

SEQ ID NO: 117064 - DNA, 438 bp, Homo sapiens
  misc_feature: GYAE6OF01EPLNZ.34.62.F07.1.454.CMB.1.raw
  modified_base (422)..(422): a, c, t, g, unknown or other
  misc_feature (422)..(422): n is a, c, g, or t
  modified_base (424)..(438): a, c, t, g, unknown or other
  misc_feature (424)..(438): n is a, c, g, or t
tcagtacacgtgatcacgaccggtgctcgatttagtagtcgcataaagggaaaggggctggagtgggtctcatccattagtcgtaacagtacttacatatactacgcagactcagtgaagggccgattcaccacctccagagacaacgccaagaactcactatatctgcaactgaacagcctgagagtcgaggacacggctgtatattactgtgcgagagagacagccactcaggtgctgaccttgactcctggggccagggaaccctggtcaccgtctcctcagcctccaccaagggcccatccggtcttccccctggccaccctcctccaagagcacctctgggggcacagcggccctgggctgcctggtcaaggactacttccatcacgtgtactgagcgggctggcaaggcgcatagngnnnnnnnnnnnnnnn

SEQ ID NO: 117065 - DNA, 681 bp, Homo sapiens
  misc_feature: GYAE6OF01EHB1N.34.62.F07.1.454.CMB.1.raw
  modified_base (647)..(648): a, c, t, g, unknown or other
  misc_feature (647)..(648): n is a, c, g, or t
  modified_base (650)..(650): a, c, t, g, unknown or other
  misc_feature (650)..(650): n is a, c, g, or t
  modified_base (652)..(681): a, c, t, g, unknown or other
  misc_feature (652)..(681): n is a, c, g, or t
tcagtacacgtgatcacgaccggtgctcgatttagtagtcgcataaaagggaagggggctggagtgggtctcatccattagtcgtaacagtacttacatatactacgcagactcagtgaagggccgattcaccacctccagagacaacgccaagaactcactatatctgcaactgaacagcctgagagtcgaggacacggctgtatattactgtgcgagtacgttttccctttattgtagtgatacctagtttgacttatgtagtacggggtaccttttaacgtaccgtcgggggtcccgaacgggggtaccctgggtcctaacccggttcctccccgtctaccggtccccttacccgaacccgtaacgggggcccctacggttccggttccctttccccccgtcgggcccctacccccgttcccgtacccgaaacggtaccgacccgtaacccgtccggtcggggggacccaaccggtacggccccggggtccccgttcgggggccgttacggtccccggtttacgggtaacccgaaacgggtaccctttaaccctttcccgaacgttccctaaccgggttcgttaccggtacggacgggtaccgggggtcgtacggggacgaacgggtccgtaccgtagttacgnngngnnnnnnnnnnnnnnnnnnnnnnnnnnnnnn

SEQ ID NO: 117066 - DNA, 456 bp, Homo sapiens
  misc_feature: GYAE6OF02HU8XQ.34.62.F07.1.454.CMB.1.raw
  modified_base (297)..(297): a, c, t, g, unknown or other
  misc_feature (297)..(297): n is a, c, g, or t
  modified_base (438)..(456): a, c, t, g, unknown or other
  misc_feature (438)..(456): n is a, c, g, or t
tcagtacacgtgatcacgaccggtgctcgatttagtagtcgcataaagggaagggggctggagtggggtctcatcccattagtcgtaacagtacttacatatactacgcagactcagtgaagggccgattcaccacctccagagacaacgccaagaactcactatatctgcaactgtaacagcctgagagtcgaggacacggctgtatattactgtgcgagagtttcccttattgtagtgataccagttgctatgatggggactttactactggggccagggaccctggtcaccgtntcctcagcctccaccaagggcccatcggtcttccccctggcacccgtcctccaagagcacctctggggcacagcggccctgggctgcctggtcaaggctacttccatcacgtgtactgagcgggctggcaaggcgcatagnnnnnnnnnnnnnnnnnnn

SEQ ID NO: 117067 - DNA, 454 bp, Homo sapiens
  misc_feature: GYAE6OF02GJTZD.34.62.F07.1.454.CMB.1.raw
  modified_base (437)..(439): a, c, t, g, unknown or other
  misc_feature (437)..(439): n is a, c, g, or t
  modified_base (441)..(454): a, c, t, g, unknown or other
  misc_feature (441)..(454): n is a, c, g, or t
tcagtacacgtgatcacgaccggtgctcgatttagtagtcgcataaagggaaggggctggagtgggtctcatccattagtcgtaacagtacttacatatactacgcagactcagtgaagggccgattcaccacctccagagacaacgccaagaactcactatatctgcaactgaacagcctgagagtcgaggacacggctgtatattactgtgcgagagtttccctttattgtagtgataccagttgctatgatggggacctttactactggggccaggggaccctggtcaccgtctcctcagcctccaccaagggcccatcggtcttccccctggcacccctcctccaagacgcacctctgggggcacagcggccctgggctgcctggtcaggactactcatcacgtgtactgagcgggctggcaaggcgcatagnnngnnnnnnnnnnnnnn

SEQ ID NO: 117068 - DNA, 494 bp, Homo sapiens
  misc_feature: GYAE6OF02GF181.34.62.F07.1.454.CMB.1.raw
  modified_base (473)..(473): a, c, t, g, unknown or other
  misc_feature (473)..(473): n is a, c, g, or t
  modified_base (475)..(494): a, c, t, g, unknown or other
  misc_feature (475)..(494): n is a, c, g, or t
tcagtacacgtgatcacgaccggtgctcgatttagtagtcgcataaagggaaaggggctggagtgggtctcatccattagtcgtaacagtacttacatatactacgcagactcagtgaagggccgattcaccacctccagagacaacgccaagaactcactatatctgcaactgaacagcctgagagtcgaggacacggctgtatattactgtgcgagagtttccctttattgtagtgataccagttgctatgatggggacctttactactgggccaggggacctggtcaccgtctcctcacgcctccaccaacggcccactcggtccttcccctcgccaccctccctcccaagacgccacctcgtcgggggccacgacgccggcccgtcgggaacgtcgccgtcggtcgaacgggacctaccttccactcaccgtcgtacgtgagcgggcgtcggcgaacggcgcagtacgngnnnnnnnnnnnnnnnnnnnn

SEQ ID NO: 117069 - DNA, 133 bp, Homo sapiens
  misc_feature: GYAE6OF01EDVLB.51.30.C08.1.454.CMB.1.raw
  modified_base (119)..(133): a, c, t, g, unknown or other
  misc_feature (119)..(133): n is a, c, g, or t
tcagcgatcgtatacacgaccggtgctcgatttagtctgacgtcaaagggaaagggcagcgtcactctgttcccgccctcctctcgtagcactctgagcgggctggcaaggcgcatagnnnnnnnnnnnnnnn

SEQ ID NO: 117070 - DNA, 119 bp, Homo sapiens
  misc_feature: GYAE6OF01EX7A9.51.30.C08.1.454.CMB.1.raw
  modified_base (119)..(119): a, c, t, g, unknown or other
  misc_feature (119)..(119): n is a, c, g, or t
tcagcgatcgtatacacgaccggtgctcgatttagtctgacgtcaaagggaaagggcagcgtcactctgttcccaccctcctctcgtagcactctgagcgggctggcaaggcgcatagn

SEQ ID NO: 117071 - DNA, 118 bp, Homo sapiens
  misc_feature: GYAE6OF01CBMSX.51.30.C08.1.454.CMB.1.raw
tcagcgatcgtatacacgaccggtgctcgatttagtctgacgtcaaagggaaagggcagcgtcactctgttcccaccctcctctcgtagcactctgagcgggctggcaaggcgcatag

SEQ ID NO: 117072 - DNA, 120 bp, Homo sapiens
  misc_feature: GYAE6OF02F41KO.51.30.C08.1.454.CMB.1.raw
  modified_base (119)..(120): a, c, t, g, unknown or other
  misc_feature (119)..(120): n is a, c, g, or t
tcagcgatcgtatacacgaccggtgctcgatttagtctgacgtcaaagggaaagggcagcgtcactctgttcccaccctcctctcgtagcactctgagcgggctggcaaggcgcatagnn

SEQ ID NO: 117073 - DNA, 120 bp, Homo sapiens; identical to SEQ ID NO: 117072
  misc_feature: GYAE6OF02G4Q4V.51.30.C08.1.454.CMB.1.raw
  modified_base (119)..(120): a, c, t, g, unknown or other
  misc_feature (119)..(120): n is a, c, g, or t

SEQ ID NO: 117074 - DNA, 146 bp, Homo sapiens
  misc_feature: GYAE6OF02FNYTT.51.30.C08.1.454.CMB.1.raw
  modified_base (112)..(112): a, c, t, g, unknown or other
  misc_feature (112)..(112): n is a, c, g, or t
  modified_base (118)..(146): a, c, t, g, unknown or other
  misc_feature (118)..(146): n is a, c, g, or t
tcagcgatcgtatacacgaccggtgctcgatttagtctgacgtcaaagggaagggcagcgtcactctgttcccgccctcctctcgtagcactctgagcgggctggcaaggcncatagnnnnnnnnnnnnnnnnnnnnnnnnnnnnn

SEQ ID NO: 117075 - DNA, 188 bp, Homo sapiens
  misc_feature: GYAE6OF01C8H6Y.44.78.H01.1.454.CMB.1.raw
  modified_base (188)..(188): a, c, t, g, unknown or other
  misc_feature (188)..(188): n is a, c, g, or t
tcagacagtatatacacgaccggtgctcgatttagtgtgagtagttgggtttgggactccagccttggtggtgggtttcggcggagggacccgactgaccgtcctaagtcagcccaaggctgcccctcggtcactctgttcccaccctcctctatatactgtctgagcgggctggcaaggcgcatagn

SEQ ID NO: 117076 - DNA, 212 bp, Homo sapiens
  misc_feature: GYAE6OF01DXQD5.44.78.H01.1.454.CMB.1.raw
  modified_base (192)..(212): a, c, t, g, unknown or other
  misc_feature (192)..(212): n is a, c, g, or t
tcagacagtatatacacgaccggtgctcgatttagtgtgagtagtttgggtttgggactccagccttggtggtggggttttcggcggagggacccgactgaccgtcctaagtcagcccaaggctgccccctcggtcactctgttcccaccctcctctatatactgtctgagcgggctggcaaggcgcatagnnnnnnnnnnnnnnnnnnnnn

SEQ ID NO: 117077 - DNA, 617 bp, Homo sapiens
  misc_feature: GYAE6OF01BTR58.44.78.H01.1.454.CMB.1.raw
  modified_base (304)..(304): a, c, t, g, unknown or other
  misc_feature (304)..(304): n is a, c, g, or t
  modified_base (522)..(522): a, c, t, g, unknown or other
  misc_feature (522)..(522): n is a, c, g, or t
  modified_base (572)..(572): a, c, t, g, unknown or other
  misc_feature (572)..(572): n is a, c, g, or t
tcagacagtatatacacgaccggtgctcgatttagtgtgagtagtttgggtttggggggaagaggaagactgacggtcctgccacaggtggtgctgggcacgggttcactcaacaaccacatctgtcctctagagaaaaccctgtgagcacagctcctcaccatggactggacctggagatcgttcttcgttggtggcagcagctaacaagacgcccactcccgaggtacagctggtgcagtcgtggggctggaggtagaagaggccgtgggcctcgagtgacagtctcgtgcacggtcttcgnggacttacacgttcagttactaattatagtaattaagtttaacggtgggttcgaccgaacggtacggccgtacggtaggaaaccgaggggtcgtagggagtaggtagtagggagtaggagtcggaacgtcctagtaggtacgacgacgtacggtctttacgacccgtaaggtacgtacgaagggtactaagtaggttaagtagtacgtacgaggtacncccgtaaccgtcccgaaggttacacgtactacgtagacgtaactcggacncgtaggcaggtacagtcgacggacgtaccgcggttctggtttacg

SEQ ID NO: 117078 - DNA, 665 bp, Homo sapiens
  misc_feature: GYAE6OF01DXM38.44.78.H01.1.454.CMB.1.raw
  modified_base (245)..(245): a, c, t, g, unknown or other
  misc_feature (245)..(245): n is a, c, g, or t
  modified_base (346)..(346): a, c, t, g, unknown or other
  misc_feature (346)..(346): n is a, c, g, or t
  modified_base (421)..(421): a, c, t, g, unknown or other
  misc_feature (421)..(421): n is a, c, g, or t
tcagacagtatatacacgaccggtgctcgatttagtgtgagtagtttgggtttgggggaagaggaagactgacggtcctgccacaggtggtgctgggcacgggttcactcaacaaccacatctgtcctctagagaaaaccctggtgagcacagctcctcaccagtggacgtggacctggaggtattcgtctttcgttggtggcagcagctaacgagacgccccactcccgaggtacagctggtcncgaggtcgtggggctggaggtagaagagccgtcgggcctcgagtgacgacgtcctcgtgccgtacggtcttacgtggtactacgtacttacatactaattntagtaattaagttacgtgggtaccgacgacggacggccgtacgtagggaacgaggggtcgtagggtaggtagggngtgggtagtggtagtacgaacgtccgtaagtacggtacggacgtaaccggtcggttacttaccggaaccgtaagtaacgtacggaacggtagtaaggtaacgttaggatacggaaccggagtaaccgacccgaccccgttacccgtaagtaccgtacgtacctaggaacggtaacgtacgtaggacgtacgtaccgcgtaacgatacgttcgaaggaacggaccggtacgggtcgtagtttacg

SEQ ID NO: 117079 - DNA, 743 bp, Homo sapiens
  misc_feature: GYAE6OF01CW02U.44.78.H01.1.454.CMB.1.raw
tcagacagtatatacacgaccggtgctcgatttagtgtgagtagtttggggtttggggggaagaggaagactgacggtcctgccacaggtggtgctgggcacgggttcactcaacaaccacatctgtcctctagaagaaaaccctgtgagcacagctcctcaccagtggactggacctggaggtatcgttcttcgttgggtggcagccagctaacgaagacgcccactcccaggtacagctggtgcagtcgtggggctggaggtagaaaggacgccgtaggggcctagaagtggactagtcctccgtgcctacggtcttcgagtactacgtacgttcatataattagagtaatacgttaacgtgggtacacgtacgtacggaccgtcgagggaacgaacgggcgtagggaggtgggtagtggggaatggggaattacggaaaccgtccgttaaggtaacgggtacggaacgaaaccggtgggttacgttacggaacccgtaaaggtaacgttaccgaaggtacgtaaggttaaggttaaggacgtacgaaccggtaagggacccgtacccgtaaccccggtaccccgtaaagggtaccgtaacgttaccgtaaacgtaaggtaaccgggtaaaccgtacggaacggtaccgtaaccggtaccgttaaagggaaccgttacctaaacgggttacgggaaaccgggtacccgggtaaaccggtttcgggttaaccggttttaccg

SEQ ID NO: 117080 - DNA, 733 bp, Homo sapiens
  misc_feature: GYAE6OF01DVCDS.44.78.H01.1.454.CMB.1.raw
  modified_base (149)..(149): a, c, t, g, unknown or other
  misc_feature (149)..(149): n is a, c, g, or t
  modified_base (593)..(593): a, c, t, g, unknown or other
  misc_feature (593)..(593): n is a, c, g, or t
  modified_base (606)..(606): a, c, t, g, unknown or other
  misc_feature (606)..(606): n is a, c, g, or t
  modified_base (622)..(622): a, c, t, g, unknown or other
  misc_feature (622)..(622): n is a, c, g, or t
  modified_base (671)..(671): a, c, t, g, unknown or other
  misc_feature (671)..(671): n is a, c, g, or t
  modified_base (694)..(694): a, c, t, g, unknown or other
  misc_feature (694)..(694): n is a, c, g, or t
tcagacagtatatacacgaccggtgctcgatttagtgtgagtagtttgggtttgggggaagaggaagactgacggtcctgccacagggtggtgcgtgggcacgggttcactcaaaccaaccacatctgtcctctagagaaaaccctggngagcacagcctccctacaccagtcggacgtcggaccgtgggaggtattcgttctttcgttgggtggccagcagtcctaagaacgaccgtacccaccgtacccgaaggtacacggtcgttagggtcgcgtggtcggtgggagtgggtacggtaaggaacggtcggtccgggtcggtccgttacgaggtacgacgtccgtccgttccgcggaccgtccgtttcgttaccggtagtacctaccgtacgttactactaagtttaataacgttagttaaactttacggttaacggtgggaccggtaacggacggtaccggtaccggtaggaaccgggtacggtaacgggtggttaggggtaggtagggttaggtagggtagtaggtaacgtacggtaacccgtagtgtaccggacgacgacggttcgtacgtacgacgtagtacgaggntaaggcgtagtancgtagacggtacgacncccccgtaacgtcgaacggtcgttactacgaacgtgttaacccgtaagngaccgagtacggtcagggtaacncggttagacgtaccgaaccggtcggttaacttggttacg

SEQ ID NO: 117081 - DNA, 741 bp, Homo sapiens
  misc_feature: GYAE6OF01CQQJR.44.78.H01.1.454.CMB.1.raw
  modified_base (129)..(129): a, c, t, g, unknown or other
  misc_feature (129)..(129): n is a, c, g, or t
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
  modified_base (692)..(692): a, c, t, g, unknown or other
  misc_feature (692)..(692): n is a, c, g, or t
tcagacagtatatacacgaccggtgctcgatttagtgtgagtagtttgggtttgggggaagaggaagactgacggtcctgccacaggtggtgctgggcacgggttcactcaacaaccacatctgtcctntagaagaaaaccctgtgagcacagctcctcaccatggactggacctggagatcgtcttcgttgggtgcagcagctaacaagacgcccactacccgaggtacngtcgtggtgcagtcgtgggttcnggaggtagaaagacggccggtaggggccncgtagtcgactagttcctccgtgctacggctttcgtaggaataccgttacgttccaagttacctaaatttagtagtaagtttaacgttaacgggtcggggtaccggtagaaccggtacgggtacccgtcgtaacgggggaaaccgtaaggggtccggttagggaaggttagggagttaggggatgggtaacgtacggtaacgtacccgttaagtagggtaccgaacgtaaccgggtacgggttccgttacggaacccgttaggtaaaccggttacgaacggtacgtaaggttaacggttacgagtaaccggaccggaaacggttcgaaccccgtaccccgtacccgtaaaggttacccgtacgttaccgtaacgacgtaacggtaagtccggacgtacgacggttacgngtaacgtaagtccgtaacgggacgaaccggacgttcggttacgttacgg

SEQ ID NO: 117082 - DNA, 818 bp, Homo sapiens
  misc_feature: GYAE6OF01DIC1Z.44.78.H01.1.454.CMB.1.raw
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (366)..(366): a, c, t, g, unknown or other
  misc_feature (366)..(366): n is a, c, g, or t
  modified_base (462)..(462): a, c, t, g, unknown or other
  misc_feature (462)..(462): n is a, c, g, or t
  modified_base (743)..(743): a, c, t, g, unknown or other
  misc_feature (743)..(743): n is a, c, g, or t
tcagacagtatatacacgaccggtgctcgatttagtgtgagtagtttgggttggggggaagaggaagactgacggtcctgccacaggtggtgctgggcacgggttcactcaacaaccacatctgtcctctagaacgaaaaccctggtgacgcacagcctcctcaccagtcggacgtcggaccgtggacggtatcgttctttcgttgggtggcagcacgtctaacaagccgcccacctccgagtacngcgtggtcnctggtcggtggggtctagggaggtagaaggacggccgtcggggacctagacggtcgacctcgttccctcgtcgaccgtacggtctttacggcgtaaacttccgtaccgttnaacttaacttaattagtaacgttaactttaacgttaacgggtcgggtacgaccggtaacggaccgggccgttaggaacgggtaacgggtacggggngtcggggtaaggtggggtaacggtgggtaaggtaacggtgggtaaaccgacgttacccggtaagggtacgggtaaccgtaccggtaaacccgggttcggtttacgttaacccggaacgttaaagttacccgggttaacgaaacggtcgttaaacggtttacggtacgtaaccgagggtaaacccggtggtaaacccgtaccccgtaacccggtacccgtaaaggttaccttaccgaaccgttacgttaacggtaaccgtaccgtaacggtccggtaaaccncggtacgaacgggttctaaacgggttccgtaaaggggaccccgggtaaaccttcggggtttacttcgggtttacg

SEQ ID NO: 117083 - DNA, 130 bp, Homo sapiens
  misc_feature: GYAE6OF02ISCM8.44.78.H01.1.454.CMB.1.raw
  modified_base (130)..(130): a, c, t, g, unknown or other
  misc_feature (130)..(130): n is a, c, g, or t
tcagacagtatatacacgaccggtgctcgatttagtgtgagtagtttgggtttgggcacagcggccctgggctgcctggtcaaggactacttcctatatactgtctgagcgggctggcaaggcgcatagn

SEQ ID NO: 117084 - DNA, 146 bp, Homo sapiens
  misc_feature: GYAE6OF02HVZPG.44.78.H01.1.454.CMB.1.raw
  modified_base (131)..(146): a, c, t, g, unknown or other
  misc_feature (131)..(146): n is a, c, g, or t
tcagacagtatatacacgaccggtgctcgatttagtgtgagtagtttgggtttgggcacagcggccctgggctgcctggtcaaggactacttcctatatactgtctgagcgggctggcaaggcgccatagnnnnnnnnnnnnnnnn

SEQ ID NO: 117085 - DNA, 130 bp, Homo sapiens; identical to SEQ ID NO: 117083
  misc_feature: GYAE6OF02FPHPN.44.78.H01.1.454.CMB.1.raw
  modified_base (130)..(130): a, c, t, g, unknown or other
  misc_feature (130)..(130): n is a, c, g, or t

SEQ ID NO: 117086 - DNA, 196 bp, Homo sapiens
  misc_feature: GYAE6OF02HBWM1.44.78.H01.1.454.CMB.1.raw
  modified_base (192)..(196): a, c, t, g, unknown or other
  misc_feature (192)..(196): n is a, c, g, or t
tcagacagtatatacacgaccggtgctcgatttagtgtgagtagtttgggtttgggactccagccttggtggtggggttttcggcggagggacccgactgaccgtcctaagtcagcccaaggctgccccctcggtcactctgttcccaccctcctctatatactgtctgagcgggctggcaaggcgcatagnnnnn

SEQ ID NO: 117087 - DNA, 752 bp, Homo sapiens
  misc_feature: GYAE6OF02JU97V.44.78.H01.1.454.CMB.1.raw
  modified_base (649)..(649): a, c, t, g, unknown or other
  misc_feature (649)..(649): n is a, c, g, or t
  modified_base (663)..(663): a, c, t, g, unknown or other
  misc_feature (663)..(663): n is a, c, g, or t
tcagacagtatatacacgaccggtgctcgatttagtgtgagtagtttgggtttgggggaagaggaagactgacggtcctgccacaggtggtgctgggcacgggttcactcaacaaccacatctgtcctctagagaaaaccctgtgagcacagctcctcaccatggactgggacctggaggatcgttctttcgttggtggcagcagtctaacgaaagacgcccgtaacctccccgaggtaccaggcgtggttcgccgaggttcgtgggggctgggaggtaggaaacgaaggccggttggggccttacgaggtacgacgacgttcctccgtgcgacggtccgttcgtaggacttaccgtaccgttactacgttactaaagtttactagtaattaaacgttttaacggtcggggttacgacgtaaccggacgggcccgtacggtacggtaaccggaaacgggggtctaggggaggttaggagtaggggtactgggaagtacggaaaccgtcgttaagtacggtggaaccgtacgggtacggttacggtttcggaaacccgtaaggtaaccggttaacggtaacggacgttaacggagttagttacgggacgaacgtacggaaccacccgtaacccgtccgaaacggttaacncgtaacccgttaanccggtttaaggactacgaggaccgtacgaacggtcggtaaagcgtaacggttcggaccgtaacggtccgggttacccgttgtttaccgg

SEQ ID NO: 117088 - DNA, 716 bp, Homo sapiens
  misc_feature: GYAE6OF02HUUP6.44.78.H01.1.454.CMB.1.raw
tcagacagtatatacacgaccggtgctcgatttagtgtgagtagtttgggtttggggggaagaggaagactgacggtcctgccacaggtggtgctgggcacgggttcactcaacaaccacatctgtcctctagagaaaaccctgtgagcacagctcctcaccatggactggacctggaggatcgtcttcttggtggcagcagctaacaagagcccactccccaggtacagctggtgcagtcgtgggctgaggtgaagagccgtggggcctcgagtcgactagtctccgtgcctacggtccttcgtggaacttaccgtacgtttcgaacttacctaaattttaacgtagtaattaactttaaacggttggggttacggccggtaacaacgggcccgtacgttacgggaaccgaaggggtccgtaggggtaggtagggaggtaggggtaagttgggtacgtacggaaacgtcccgtaagtttaggtacgggtaccaaacggtccgggtacgttttacggacccgtaagggtaacgttacccggaaaggtacaacgggtaagtttaagtaacgtacggtaacggtagggaccgtcccgtaacccgttacccggacggttaacctcggtaccaacgttacgtacggtacgtaggaaccgacgtacgacgtaggacgacgtacgtaggacgggtacccgacggtccggttaagtttaccgg

SEQ ID NO: 117089 - DNA, 760 bp, Homo sapiens
  misc_feature: GYAE6OF02G37WT.44.78.H01.1.454.CMB.1.raw
  modified_base (244)..(244): a, c, t, g, unknown or other
  misc_feature (244)..(244): n is a, c, g, or t
  modified_base (480)..(480): a, c, t, g, unknown or other
  misc_feature (480)..(480): n is a, c, g, or t
tcagacagtatatacacgaccggtgctcgatttagtgtgagtagtttgggtttggggggaagaggaagactgacggtcctgccacaggtggtgctgggcacgggttcactcaacaaccacatctgtcctctagagaaaccctgtgagcacagctcctacaccatggactggacctggaggtatcgtcttcgttggtggcagcagtcctaacgaagaccgcccctacctaccccgaaggtaaccnggcgttgggtcgcgagttcggtgggctaggaggtagaaggacgtccggtaggggccacgtaggtcggactacgttcctccgtcgacgccggttaccttcggaggtaccttaccgtacggttcaataccgtaatttatagtaacttaagtttaccggtggggacgtaccgaacggacggcccggtagtaggggaaaccgacggggttcgtaggggtagttacgggggtacgtagggngtaaggtagaacggaaccgtacgtaggttagggaccgaacgtaacggtccggttaccgttcggacccggtaaacggtacgttaccggaaaggtacgttaacgggttagttaacgttaacggcggaaacccggtaggtaaccccggacccgttacccctaacccgggtaagttccgtaaacggttacctaccgtaggtaaccgtcgttacggaacgtcgtacggattcggaacgtcctacgggacacgggttaccgtaccggtttcgttacgttttaacgg

SEQ ID NO: 117090 - DNA, 304 bp, Homo sapiens
  misc_feature: GYAE6OF01B823Z.29.30.C08.1.454.CMB.1.raw
  modified_base (301)..(304): a, c, t, g, unknown or other
  misc_feature (301)..(304): n is a, c, g, or t
tcagatagagtactcacgaccggtgctcgatttagtctgacgtcaagggaagggctggagtgggtggccaacataaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117091 - DNA, 305 bp, Homo sapiens
  misc_feature: GYAE6OF01EIG6A.29.30.C08.1.454.CMB.1.raw
  modified_base (304)..(305): a, c, t, g, unknown or other
  misc_feature (304)..(305): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnn

SEQ ID NO: 117092 - DNA, 308 bp, Homo sapiens
  misc_feature: GYAE6OF01B03IM.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 117093 - DNA, 306 bp, Homo sapiens
  misc_feature: GYAE6OF01EX7C2.29.30.C08.1.454.CMB.1.raw
  modified_base (303)..(306): a, c, t, g, unknown or other
  misc_feature (303)..(306): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117094 - DNA, 307 bp, Homo sapiens
  misc_feature: GYAE6OF01BLCPG.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117095 - DNA, 311 bp, Homo sapiens
  misc_feature: GYAE6OF01BUN2I.29.30.C08.1.454.CMB.1.raw
  modified_base (304)..(311): a, c, t, g, unknown or other
  misc_feature (304)..(311): n is a, c, g, or t
tcagatagagtactcacgaccggtgctcgatttagtctgacgtcaaagggaaagggcgtggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnn

SEQ ID NO: 117096 - DNA, 302 bp, Homo sapiens
  misc_feature: GYAE6OF01BYA14.29.30.C08.1.454.CMB.1.raw
  modified_base (298)..(302): a, c, t, g, unknown or other
  misc_feature (298)..(302): n is a, c, g, or t
tcagatagagtactcacgaccggtgctcgatttagtctgacgtcaaggaagggctggagtggtggccaacataaccaagatggaagtgaacagtactatgtggactctgtgaagggccgattcaccatctccagagacaacgccaagaactcactgtctcctcagcctccaccaagggcccatcggtcttccctggcgccctgctccaggagcacctccgagagcacagcggccctgggctgcctggtcaaggactacttccacgtagcgtgctgagcgggctggcaaggcgcatagnnnnn

SEQ ID NO: 117097 - DNA, 311 bp, Homo sapiens
  misc_feature: GYAE6OF01B3EY6.29.30.C08.1.454.CMB.1.raw
  modified_base (304)..(311): a, c, t, g, unknown or other
  misc_feature (304)..(311): n is a, c, g, or t
tcagatagagtactcacgaccggtgctcgatttagtctgacgtcaaagggaaagggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnnn

SEQ ID NO: 117098 - DNA, 309 bp, Homo sapiens
  misc_feature: GYAE6OF01BXNG4.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnn

SEQ ID NO: 117099 - DNA, 309 bp, Homo sapiens; identical to SEQ ID NO: 117098
  misc_feature: GYAE6OF01D9OAV.29.30.C08.1.454.CMB.1.raw
  modified_base (304)..(309): a, c, t, g, unknown or other
  misc_feature (304)..(309): n is a, c, g, or t

SEQ ID NO: 117100 - DNA, 307 bp, Homo sapiens
  misc_feature: GYAE6OF01BB7RW.29.30.C08.1.454.CMB.1.raw
  modified_base (303)..(307): a, c, t, g, unknown or other
  misc_feature (303)..(307): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 117101 - DNA, 323 bp, Homo sapiens
  misc_feature: GYAE6OF01B0G3H.29.30.C08.1.454.CMB.1.raw
  modified_base (309)..(309): a, c, t, g, unknown or other
  misc_feature (309)..(309): n is a, c, g, or t
  modified_base (315)..(323): a, c, t, g, unknown or other
  misc_feature (315)..(323): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaatgccaagaactcactgtctcctcagcctccaccaacgggcccatcggtccttccccctggccgccctgcctccgaggagcacctccgagagcacagccggcccgtgggctgcctggtacaaggacctacttccacgtagcgtgctgagcgggtctggcaaggcncatagnnnnnnnnn

SEQ ID NO: 117102 - DNA, 313 bp, Homo sapiens
  misc_feature: GYAE6OF01BJGB9.29.30.C08.1.454.CMB.1.raw
  modified_base (305)..(313): a, c, t, g, unknown or other
  misc_feature (305)..(313): n is a, c, g, or t
tcagatagagtactcacgaccggtgctcgatttagtctgacgtcaaagggaaagggctgggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnn

SEQ ID NO: 117103 - DNA, 308 bp, Homo sapiens; identical to SEQ ID NO: 117092
  misc_feature: GYAE6OF01BW267.29.30.C08.1.454.CMB.1.raw
  modified_base (304)..(308): a, c, t, g, unknown or other
  misc_feature (304)..(308): n is a, c, g, or t

SEQ ID NO: 117104 - DNA, 307 bp, Homo sapiens
  misc_feature: GYAE6OF01BHA4K.29.30.C08.1.454.CMB.1.raw
  modified_base (303)..(307): a, c, t, g, unknown or other
  misc_feature (303)..(307): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnn

SEQ ID NO: 117105 - DNA, 305 bp, Homo sapiens
  misc_feature: GYAE6OF01BFNCI.29.30.C08.1.454.CMB.1.raw
  modified_base (303)..(305): a, c, t, g, unknown or other
  misc_feature (303)..(305): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 117106 - DNA, 307 bp, Homo sapiens
  misc_feature: GYAE6OF01ANNLJ.29.30.C08.1.454.CMB.1.raw
  modified_base (302)..(307): a, c, t, g, unknown or other
  misc_feature (302)..(307): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatagnnnnnn

SEQ ID NO: 117107 - DNA, 304 bp, Homo sapiens
  misc_feature: GYAE6OF01CZPVN.29.30.C08.1.454.CMB.1.raw
  modified_base (302)..(304): a, c, t, g, unknown or other
  misc_feature (302)..(304): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 117108 - DNA, 347 bp, Homo sapiens
  misc_feature: GYAE6OF01CRMUD.29.30.C08.1.454.CMB.1.raw
  modified_base (318)..(347): a, c, t, g, unknown or other
  misc_feature (318)..(347): n is a, c, g, or t
tcagatagagtactcacgaccggtgctcgatttagtctgacgtcaaagggaaaggggtcgtggagtgggtggccaacataaaccaagatggaagtgaactagtactatgtggactctgtgaagggcccgattcaccgatctccagagacaacgccaagaactcactgtctcctcagcctccaccaagggcccatccggtcttccccctggcgccctgctccaggagccacctccgagagcactagcggcccgtgggctgcctggtccaaggactacgttccacgtagccgtgctgagcgggctggcaaggcgcatagnnnnnnnnnnnnnnnnnnnnnnnnnnnnnn

SEQ ID NO: 117109 - DNA, 313 bp, Homo sapiens
  misc_feature: GYAE6OF01AMWYX.29.30.C08.1.454.CMB.1.raw
  modified_base (305)..(313): a, c, t, g, unknown or other
  misc_feature (305)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttccccctggcgccctgctccaggagcacctccgagagcacagcggccctgggctgcctggtcaaggactacttccacgtagcgtgctgagcgggctggcaaggcgcatagnnnnnnnnn

SEQ ID NO: 117110 - DNA, 307 bp, Homo sapiens
  misc_feature: GYAE6OF01DDUB6.29.30.C08.1.454.CMB.1.raw
  modified_base (305)..(307): a, c, t, g, unknown or other
  misc_feature (305)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 117111 - DNA, 305 bp, Homo sapiens
  misc_feature: GYAE6OF01B013X.29.30.C08.1.454.CMB.1.raw
  modified_base (302)..(305): a, c, t, g, unknown or other
  misc_feature (302)..(305): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnn

SEQ ID NO: 117112 - DNA, 253 bp, Homo sapiens
  misc_feature: GYAE6OF01BCOVE.29.30.C08.1.454.CMB.1.raw
  modified_base (221)..(253): a, c, t, g, unknown or other
  misc_feature (221)..(253): n is a, c, g, or t
tcagatagagtactcacgaccggtgctcgatttagtctgacgtcaaagggaaagggtaccggacggtcatcgtgtcctcagcctccgaccaagggcccatcggtcttccccctggcaccctcctccaagagcacctctgggggcacagcggccctgggctggcctgggtccaaggactacttcccagacgacgctctgagcgggctggcaaggcgcatagnnnnnnnnnnnnnnnnnnnnnnnnnnnnnnnnn

SEQ ID NO: 117113 - DNA, 304 bp, Homo sapiens
  misc_feature: GYAE6OF01E1V9T.29.30.C08.1.454.CMB.1.raw
  modified_base (304)..(304): a, c, t, g, unknown or other
  misc_feature (304)..(304): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagn

SEQ ID NO: 117114 - DNA, 310 bp, Homo sapiens
  misc_feature: GYAE6OF01CBME0.29.30.C08.1.454.CMB.1.raw
  modified_base (307)..(310): a, c, t, g, unknown or other
  misc_feature (307)..(310): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgaaactccaggagcacctccgagagcacagcggccctgggctgcctggtcaaggactacttccacgtagcgtgctgagcgggctggcaaggcgcatagnnnn

SEQ ID NO: 117115 - DNA, 309 bp, Homo sapiens
  misc_feature: GYAE6OF01CVW1U.29.30.C08.1.454.CMB.1.raw
  modified_base (306)..(309): a, c, t, g, unknown or other
  misc_feature (306)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnn

SEQ ID NO: 117116 - DNA, 307 bp, Homo sapiens
  misc_feature: GYAE6OF01C2WTI.29.30.C08.1.454.CMB.1.raw
  modified_base (301)..(307): a, c, t, g, unknown or other
  misc_feature (301)..(307): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccccgtggcgccctgctccaggagcacctcgagagcacagcggccctggctgcctggtcaaggctattccacgtagcgtgctgagcgggctggcaaggcgcatagnnnnnnn

SEQ ID NO: 117117 - DNA, 309 bp, Homo sapiens; identical to SEQ ID NO: 117115
  misc_feature: GYAE6OF01BX7BN.29.30.C08.1.454.CMB.1.raw
  modified_base (306)..(309): a, c, t, g, unknown or other
  misc_feature (306)..(309): n is a, c, g, or t

SEQ ID NO: 117118 - DNA, 307 bp, Homo sapiens; identical to SEQ ID NO: 117094
  misc_feature: GYAE6OF01D8HCI.29.30.C08.1.454.CMB.1.raw
  modified_base (304)..(307): a, c, t, g, unknown or other
  misc_feature (304)..(307): n is a, c, g, or t

SEQ ID NO: 117119 - DNA, 308 bp, Homo sapiens; identical to SEQ ID NO: 117092
  misc_feature: GYAE6OF01BXSFP.29.30.C08.1.454.CMB.1.raw
  modified_base (304)..(308): a, c, t, g, unknown or other
  misc_feature (304)..(308): n is a, c, g, or t

SEQ ID NO: 117120 - DNA, 305 bp, Homo sapiens; identical to SEQ ID NO: 117091
  misc_feature: GYAE6OF01DZS30.29.30.C08.1.454.CMB.1.raw
  modified_base (304)..(305): a, c, t, g, unknown or other
  misc_feature (304)..(305): n is a, c, g, or t

SEQ ID NO: 117121 - DNA, 307 bp, Homo sapiens; identical to SEQ ID NO: 117094
  misc_feature: GYAE6OF01B9J76.29.30.C08.1.454.CMB.1.raw
  modified_base (304)..(307): a, c, t, g, unknown or other
  misc_feature (304)..(307): n is a, c, g, or t

SEQ ID NO: 117122 - DNA, 307 bp, Homo sapiens; identical to SEQ ID NO: 117094
  misc_feature: GYAE6OF01DF266.29.30.C08.1.454.CMB.1.raw
  modified_base (304)..(307): a, c, t, g, unknown or other
  misc_feature (304)..(307): n is a, c, g, or t

SEQ ID NO: 117123 - DNA, 307 bp, Homo sapiens
  misc_feature: GYAE6OF01DFKPC.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117124 - DNA, 307 bp, Homo sapiens
  misc_feature: GYAE6OF01EJ4LF.29.30.C08.1.454.CMB.1.raw
  modified_base (305)..(307): a, c, t, g, unknown or other
  misc_feature (305)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgatttaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 117125 - DNA, 305 bp, Homo sapiens; identical to SEQ ID NO: 117091
  misc_feature: GYAE6OF01DCXNC.29.30.C08.1.454.CMB.1.raw
  modified_base (304)..(305): a, c, t, g, unknown or other
  misc_feature (304)..(305): n is a, c, g, or t

SEQ ID NO: 117126 - DNA, 321 bp, Homo sapiens
  misc_feature: GYAE6OF01D86CE.29.30.C08.1.454.CMB.1.raw
  modified_base (306)..(321): a, c, t, g, unknown or other
  misc_feature (306)..(321): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagcnnnnnnnnnnnnnnnn

SEQ ID NO: 117127 - DNA, 310 bp, Homo sapiens
  misc_feature: GYAE6OF01BTT2P.29.30.C08.1.454.CMB.1.raw
  modified_base (305)..(310): a, c, t, g, unknown or other
  misc_feature (305)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnn

SEQ ID NO: 117128 - DNA, 307 bp, Homo sapiens; identical to SEQ ID NO: 117094
  misc_feature: GYAE6OF01BT9LC.29.30.C08.1.454.CMB.1.raw
  modified_base (304)..(307): a, c, t, g, unknown or other
  misc_feature (304)..(307): n is a, c, g, or t

SEQ ID NO: 117129 - DNA, 308 bp, Homo sapiens
  misc_feature: GYAE6OF01C0UKL.29.30.C08.1.454.CMB.1.raw
  modified_base (305)..(308): a, c, t, g, unknown or other
  misc_feature (305)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117130 - DNA, 310 bp, Homo sapiens
  misc_feature: GYAE6OF01EIXUV.29.30.C08.1.454.CMB.1.raw
  modified_base (306)..(310): a, c, t, g, unknown or other
  misc_feature (306)..(310): n is a, c, g, or t
tcagatagagtactcacgaccggtgctcgatttagtctgacgtcaaagggaaaggggctggagtggtggccaacagtaaaccaagaataggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnn

SEQ ID NO: 117131 - DNA, 305 bp, Homo sapiens
  misc_feature: GYAE6OF01DT2DU.29.30.C08.1.454.CMB.1.raw
  modified_base (303)..(305): a, c, t, g, unknown or other
  misc_feature (303)..(305): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaagactacttccacgtagcgtgctgagcgggctggcaaggcgcatagnnn

SEQ ID NO: 117132 - DNA, 309 bp, Homo sapiens; identical to SEQ ID NO: 117098
  misc_feature: GYAE6OF01BGIJU.29.30.C08.1.454.CMB.1.raw
  modified_base (304)..(309): a, c, t, g, unknown or other
  misc_feature (304)..(309): n is a, c, g, or t

SEQ ID NO: 117133 - DNA, 310 bp, Homo sapiens
  misc_feature: GYAE6OF01DDA24.29.30.C08.1.454.CMB.1.raw
  modified_base (304)..(310): a, c, t, g, unknown or other
  misc_feature (304)..(310): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnn

SEQ ID NO: 117134 - DNA, 308 bp, Homo sapiens; identical to SEQ ID NO: 117129
  misc_feature: GYAE6OF01DV81D.29.30.C08.1.454.CMB.1.raw
  modified_base (305)..(308): a, c, t, g, unknown or other
  misc_feature (305)..(308): n is a, c, g, or t

SEQ ID NO: 117135 - DNA, 306 bp, Homo sapiens
  misc_feature: GYAE6OF01EOZAV.29.30.C08.1.454.CMB.1.raw
  modified_base (304)..(306): a, c, t, g, unknown or other
  misc_feature (304)..(306): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 117136 - DNA, 310 bp, Homo sapiens; identical to SEQ ID NO: 117127
  misc_feature: GYAE6OF01D3GQ1.29.30.C08.1.454.CMB.1.raw
  modified_base (305)..(310): a, c, t, g, unknown or other
  misc_feature (305)..(310): n is a, c, g, or t

SEQ ID NO: 117137 - DNA, 308 bp, Homo sapiens; identical to SEQ ID NO: 117092
  misc_feature: GYAE6OF01AQLU3.29.30.C08.1.454.CMB.1.raw
  modified_base (304)..(308): a, c, t, g, unknown or other
  misc_feature (304)..(308): n is a, c, g, or t

SEQ ID NO: 117138 - DNA, 308 bp, Homo sapiens
  misc_feature: GYAE6OF01AKZJZ.29.30.C08.1.454.CMB.1.raw
  modified_base (305)..(308): a, c, t, g, unknown or other
  misc_feature (305)..(308): n is a, c, g, or t
tcagatagagtactcacgaccggtgctcgatttagtctgacgtcaaagggaaagggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117139 - DNA, 306 bp, Homo sapiens; identical to SEQ ID NO: 117135
  misc_feature: GYAE6OF01AKFM2.29.30.C08.1.454.CMB.1.raw
  modified_base (304)..(306): a, c, t, g, unknown or other
  misc_feature (304)..(306): n is a, c, g, or t

SEQ ID NO: 117140 - DNA, 305 bp, Homo sapiens
  misc_feature: GYAE6OF01DI0H8.29.30.C08.1.454.CMB.1.raw
  modified_base (303)..(305): a, c, t, g, unknown or other
  misc_feature (303)..(305): n is a, c, g, or t
tcagatagagtactcacgaccggtgctcgatttagtctgacgtcaaagggaaagggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 117141 - DNA, 304 bp, Homo sapiens
  misc_feature: GYAE6OF01B88AH.29.30.C08.1.454.CMB.1.raw
  modified_base (302)..(304): a, c, t, g, unknown or other
  misc_feature (302)..(304): n is a, c, g, or t
tcagatagagtactcacgaccggtgctcgatttagtctgacgtcaaagggaagggctggagtgggtggccaacataaaccaagatggaagtgaacagtactatgtggactctgtgaaggaccgattcaccatctcagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnn

SEQ ID NO: 117142 - DNA, 341 bp, Homo sapiens
  misc_feature: GYAE6OF01DAV8F.29.30.C08.1.454.CMB.1.raw
  modified_base (221)..(221): a, c, t, g, unknown or other
  misc_feature (221)..(221): n is a, c, g, or t
  modified_base (312)..(341): a, c, t, g, unknown or other
  misc_feature (312)..(341): n is a, c, g, or t
tcagatagagtactcacgaccggtgctcgatttagtctgacgtcaaagggaaagggctggagtgggtggccaacataaaccaagatggaagtgaaccagtactatgtggactcgtgtgaagggccgattcaccatctccagagacaacgccaagaactcactgtctcctcagcctccaccaagggcccatcggtcttcccctggcgccctgcctccaggancacctccgagagcacagcggccctgggcctgccctggtcaaaggactacttaccacgtagcgtgcctgagcgggctggcaaggcgcatagnnnnnnnnnnnnnnnnnnnnnnnnnnnnnn

SEQ ID NO: 117143 - DNA, 353 bp, Homo sapiens
  misc_feature: GYAE6OF01BGGS9.29.30.C08.1.454.CMB.1.raw
  modified_base (312)..(353): a, c, t, g, unknown or other
  misc_feature (312)..(353): n is a, c, g, or t
tcagatagagtactcacgaccggtgctcgatttagtctgacgtcaaagggaaaggggctggggagtgggtggccaacattaaaccaagatggaagtgaacagtactatgtggactcctgtgaagggccgattcaccgatctccagagacaacgccaagaactcactgtctcctcagcctccaccaagggcccatcggtcttccccctggcgccctgctccaggacgcacctccgagacgcacagccggccctgggctgcctggtcaaggctacttccacgtagcgtgctgagcggctggcaaggcgcatagnnnnnnnnnnnnnnnnnnnnnnnnnnnnnnnnnnnnnnnnnn

SEQ ID NO: 117144 - DNA, 304 bp, Homo sapiens
  misc_feature: GYAE6OF01CKZ9R.29.30.C08.1.454.CMB.1.raw
  modified_base (300)..(304): a, c, t, g, unknown or other
  misc_feature (300)..(304): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggcctgggctgcctggtcaaggctacttccacgtagcgtgctgagcgggctggcaaggcgcatagnnnnn

SEQ ID NO: 117145 - DNA, 317 bp, Homo sapiens
  misc_feature: GYAE6OF01EHYCI.29.30.C08.1.454.CMB.1.raw
  modified_base (305)..(317): a, c, t, g, unknown or other
  misc_feature (305)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnnnn

SEQ ID NO: 117146 - DNA, 308 bp, Homo sapiens; identical to SEQ ID NO: 117129
  misc_feature: GYAE6OF01BRXV1.29.30.C08.1.454.CMB.1.raw
  modified_base (305)..(308): a, c, t, g, unknown or other
  misc_feature (305)..(308): n is a, c, g, or t

SEQ ID NO: 117147 - DNA, 312 bp, Homo sapiens
  misc_feature: GYAE6OF01C20NZ.29.30.C08.1.454.CMB.1.raw
  modified_base (305)..(312): a, c, t, g, unknown or other
  misc_feature (305)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnn

SEQ ID NO: 117148 - DNA, 309 bp, Homo sapiens
  misc_feature: GYAE6OF01BG5AR.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcatagnnnnn

SEQ ID NO: 117149 - DNA, 334 bp, Homo sapiens
  misc_feature: GYAE6OF01B8O28.29.30.C08.1.454.CMB.1.raw
  modified_base (227)..(227): a, c, t, g, unknown or other
  misc_feature (227)..(227): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (309)..(334): a, c, t, g, unknown or other
  misc_feature (309)..(334): n is a, c, g, or t
tcagatagagtactcacgaccggtgctcgatttagtctgacgtcaaagggtaaggggtcgtggagtgggtcggcccaacataaaccaagatggaagtgaacagtactatcgtggactctgtgaagggccattcaccatctccagagacaacgccaagaactcactgtctcctcagcctccaccaagggcccatcggtcttcccctggcgccctgctcgaggagcacnccgagagcacagcggcctgggctgcctgggtcaaggtactacttccaacgtgcgtgctgagcggntggcaaggcgcanagcnnnnnnnnnnnnnnnnnnnnnnnnnn

SEQ ID NO: 117150 - DNA, 308 bp, Homo sapiens; identical to SEQ ID NO: 117092
  misc_feature: GYAE6OF01CPXWM.29.30.C08.1.454.CMB.1.raw
  modified_base (304)..(308): a, c, t, g, unknown or other
  misc_feature (304)..(308): n is a, c, g, or t

SEQ ID NO: 117151 - DNA, 307 bp, Homo sapiens
  misc_feature: GYAE6OF01BZEXK.29.30.C08.1.454.CMB.1.raw
  modified_base (303)..(307): a, c, t, g, unknown or other
  misc_feature (303)..(307): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 117152 - DNA, 377 bp, Homo sapiens
  misc_feature: GYAE6OF01DDP18.29.30.C08.1.454.CMB.1.raw
  modified_base (321)..(321): a, c, t, g, unknown or other
  misc_feature (321)..(321): n is a, c, g, or t
  modified_base (323)..(377): a, c, t, g, unknown or other
  misc_feature (323)..(377): n is a, c, g, or t
tcagatagagtactcacgaccggtgctcgatttagtctgacgtcaaagggaaagggctggagtgggggtggccaacgataaaccaagatggaagtggaacagtactatgtgggactcgtgtgaagggccgatttcaccatctccagagacaacgccaagaactcactgtctcctcagccctccaccaagggccccatcggtcttcccctggcgccctgctccaggagcacctccgagagtcacagcggcccgtgggctgcctggtcaagggtacttacttccacgtagcgtgctgagcgggctggccaaacggcgcatagntnnnnnnnnnnnnnnnnnnnnnnnnnnnnnnnnnnnnnnnnnnnnnnnnnnnnnnn

SEQ ID NO: 117153 - DNA, 309 bp, Homo sapiens
  misc_feature: GYAE6OF01A7XGX.29.30.C08.1.454.CMB.1.raw
  modified_base (303)..(309): a, c, t, g, unknown or other
  misc_feature (303)..(309): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnn

SEQ ID NO: 117154 - DNA, 315 bp, Homo sapiens
  misc_feature: GYAE6OF01EYMTB.29.30.C08.1.454.CMB.1.raw
  modified_base (306)..(315): a, c, t, g, unknown or other
  misc_feature (306)..(315): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnn

SEQ ID NO: 117155 - DNA, 314 bp, Homo sapiens
  misc_feature: GYAE6OF01C176L.29.30.C08.1.454.CMB.1.raw
  modified_base (306)..(314): a, c, t, g, unknown or other
  misc_feature (306)..(314): n is a, c, g, or t
tcagatagagtactcacgaccggtgctcgatttagtctgacgtcaaagggaaaggggctgggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnn

SEQ ID NO: 117156 - DNA, 306 bp, Homo sapiens; identical to SEQ ID NO: 117135
  misc_feature: GYAE6OF01EJ479.29.30.C08.1.454.CMB.1.raw
  modified_base (304)..(306): a, c, t, g, unknown or other
  misc_feature (304)..(306): n is a, c, g, or t

SEQ ID NO: 117157 - DNA, 306 bp, Homo sapiens; identical to SEQ ID NO: 117135
  misc_feature: GYAE6OF01ENBMS.29.30.C08.1.454.CMB.1.raw
  modified_base (304)..(306): a, c, t, g, unknown or other
  misc_feature (304)..(306): n is a, c, g, or t

SEQ ID NO: 117158 - DNA, 306 bp, Homo sapiens; identical to SEQ ID NO: 117135
  misc_feature: GYAE6OF01D7FAA.29.30.C08.1.454.CMB.1.raw
  modified_base (304)..(306): a, c, t, g, unknown or other
  misc_feature (304)..(306): n is a, c, g, or t

SEQ ID NO: 117159 - DNA, 307 bp, Homo sapiens
  misc_feature: GYAE6OF01C1RPM.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117160 - DNA, 309 bp, Homo sapiens
  misc_feature: GYAE6OF01A0RND.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 117161 - DNA, 308 bp, Homo sapiens; identical to SEQ ID NO: 117129
  misc_feature: GYAE6OF01CT5OJ.29.30.C08.1.454.CMB.1.raw
  modified_base (305)..(308): a, c, t, g, unknown or other
  misc_feature (305)..(308): n is a, c, g, or t

SEQ ID NO: 117162 - DNA, 307 bp, Homo sapiens
  misc_feature: GYAE6OF01BL4WJ.29.30.C08.1.454.CMB.1.raw
  modified_base (305)..(307): a, c, t, g, unknown or other
  misc_feature (305)..(307): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnn

SEQ ID NO: 117163 - DNA, 326 bp, Homo sapiens
  misc_feature: GYAE6OF01B8EFR.29.30.C08.1.454.CMB.1.raw
  modified_base (309)..(311): a, c, t, g, unknown or other
  misc_feature (309)..(311): n is a, c, g, or t
  modified_base (313)..(326): a, c, t, g, unknown or other
  misc_feature (313)..(326): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgcctaagaactcactgtctcctcagcctccaccaagggcccatcggtcttccccctggcgccctgctccaggagcacctccggagagcacagcggccctgggctgcctggtcaaggctacttccacgtagcgtgctgagcgggctggccaaggcgcataggnnngnnnnnnnnnnnnnn

SEQ ID NO: 117164 - DNA, 308 bp, Homo sapiens; identical to SEQ ID NO: 117092
  misc_feature: GYAE6OF01EM79K.29.30.C08.1.454.CMB.1.raw
  modified_base (304)..(308): a, c, t, g, unknown or other
  misc_feature (304)..(308): n is a, c, g, or t

SEQ ID NO: 117165 - DNA, 320 bp, Homo sapiens
  misc_feature: GYAE6OF01CGJ87.29.30.C08.1.454.CMB.1.raw
  modified_base (304)..(320): a, c, t, g, unknown or other
  misc_feature (304)..(320): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnnnnnnnnnnnn

SEQ ID NO: 117166 - DNA, 310 bp, Homo sapiens
  misc_feature: GYAE6OF01BLGIJ.29.30.C08.1.454.CMB.1.raw
  modified_base (306)..(310): a, c, t, g, unknown or other
  misc_feature (306)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnn

SEQ ID NO: 117167 - DNA, 305 bp, Homo sapiens
  misc_feature: GYAE6OF01CO4CI.29.30.C08.1.454.CMB.1.raw
  modified_base (220)..(220): a, c, t, g, unknown or other
  misc_feature (220)..(220): n is a, c, g, or t
  modified_base (303)..(305): a, c, t, g, unknown or other
  misc_feature (303)..(305): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctcgagagcacagcggcctgggctgcctggtcaaggactacttccacgtagcgtgctgagcggctggcaaggcgcatagnnn

SEQ ID NO: 117168 - DNA, 308 bp, Homo sapiens; identical to SEQ ID NO: 117092
  misc_feature: GYAE6OF01AJHDQ.29.30.C08.1.454.CMB.1.raw
  modified_base (304)..(308): a, c, t, g, unknown or other
  misc_feature (304)..(308): n is a, c, g, or t

SEQ ID NO: 117169 - DNA, 325 bp, Homo sapiens
  misc_feature: GYAE6OF01BU808.29.30.C08.1.454.CMB.1.raw
  modified_base (307)..(308): a, c, t, g, unknown or other
  misc_feature (307)..(308): n is a, c, g, or t
  modified_base (310)..(325): a, c, t, g, unknown or other
  misc_feature (310)..(325): n is a, c, g, or t
tcagatagagtactcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctccaccaagggcccatccggtcttcccctggcgccctgctccaggagcacctccgagagcacagcggccctgggctgcctggtcaaggactacttccacgtagcgtgctgagcgggctggcaaggcgcatagnngnnnnnnnnnnnnnnnn

SEQ ID NO: 117170 - DNA, 306 bp, Homo sapiens
  misc_feature: GYAE6OF01CM8LM.29.30.C08.1.454.CMB.1.raw
  modified_base (304)..(306): a, c, t, g, unknown or other
  misc_feature (304)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnn

SEQ ID NO: 117171 - DNA, 309 bp, Homo sapiens; identical to SEQ ID NO: 117160
  misc_feature: GYAE6OF01DAWW2.29.30.C08.1.454.CMB.1.raw
  modified_base (305)..(309): a, c, t, g, unknown or other
  misc_feature (305)..(309): n is a, c, g, or t

SEQ ID NO: 117172 - DNA, 308 bp, Homo sapiens; identical to SEQ ID NO: 117092
  misc_feature: GYAE6OF01ALEKA.29.30.C08.1.454.CMB.1.raw
  modified_base (304)..(308): a, c, t, g, unknown or other
  misc_feature (304)..(308): n is a, c, g, or t

SEQ ID NO: 117173 - DNA, 310 bp, Homo sapiens; identical to SEQ ID NO: 117127
  misc_feature: GYAE6OF01EW7LU.29.30.C08.1.454.CMB.1.raw
  modified_base (305)..(310): a, c, t, g, unknown or other
  misc_feature (305)..(310): n is a, c, g, or t

SEQ ID NO: 117174 - DNA, 307 bp, Homo sapiens
  misc_feature: GYAE6OF01EH004.29.30.C08.1.454.CMB.1.raw
  modified_base (306)..(307): a, c, t, g, unknown or other
  misc_feature (306)..(307): n is a, c, g, or t
tcagatagagtactcacgaccggtgctcgatttagtctgacgtcaatgggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnn

SEQ ID NO: 117175 - DNA, 372 bp, Homo sapiens
  misc_feature: GYAE6OF01CKY64.29.30.C08.1.454.CMB.1.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (316)..(322): a, c, t, g, unknown or other
  misc_feature (316)..(322): n is a, c, g, or t
  modified_base (324)..(372): a, c, t, g, unknown or other
  misc_feature (324)..(372): n is a, c, g, or t
tcagatagagtactcacgaccggtgctcgatttagtctgacgtcaaagggaaagggggctggagtgggtggccaacataaaccaaggactggaagtgaaccagtacgtatgtggactctgtgaaggccgattcaccatctccagagacaacgccaagtaactcactgtctcctcagcctccaccaagggtcccatcgggtacttccccctggccgccctgctccaggancacctccgagagcacagcggccctgggctgcctggtcaaggactacttccacgtagcgtgctgagcgggntggcaaggccncatagnnnnnnngnnnnnnnnnnnnnnnnnnnnnnnnnnnnnnnnnnnnnnnnnnnnnnnnn

SEQ ID NO: 117176 - DNA, 311 bp, Homo sapiens
  misc_feature: GYAE6OF01A5K73.29.30.C08.1.454.CMB.1.raw
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctgggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaagggcgcatagnnnnnn

SEQ ID NO: 117177 - DNA, 625 bp, Homo sapiens
  misc_feature: GYAE6OF01A85RO.29.30.C08.1.454.CMB.1.raw
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
  modified_base (565)..(565): a, c, t, g, unknown or other
  misc_feature (565)..(565): n is a, c, g, or t
  modified_base (576)..(576): a, c, t, g, unknown or other
  misc_feature (576)..(576): n is a, c, g, or t
tcagatagagtactcacgaccggtgctcgatttagtctgacgtcaaagggaaaggggtcgtggagtggatttcatattattagtgctggtgcgttacgtaccatgaagtacgcagtactctgtgaggggccgagtttcgaccatttccgagggacgacggccaagaaatcagtatagtctacaaatgagtagcctgacgagacgaggaccaccggctgtgttattactgtagcgggccgggtagccaacgtccggaccaccctacgaccaagactactggggaccacggaaccctggtcgccgtcgtcctcagcctaccgaccaagggcccatcggtcttcccctggcacccgtcctccaagtacgcacctacgtacggggtctacgtacgacaacgccgtaggggctcggcctacggtccaacggtacctaacgttccaacggtttaagccggttacggaccgtacggaacggtcccggggaccgttcgggaccgtaaacgggcccggacgaacgtaacgggttcgcgcgacgacacgcgacgagngtcgcncgtacgtactcncgacgcgacgngagagagagagtagtacgtcgtacgtcgtactacacgacacacgcgacg

SEQ ID NO: 117178 - DNA, 308 bp, Homo sapiens
  misc_feature: GYAE6OF01C6G2A.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 117179 - DNA, 307 bp, Homo sapiens; identical to SEQ ID NO: 117110
  misc_feature: GYAE6OF01A65SI.29.30.C08.1.454.CMB.1.raw
  modified_base (305)..(307): a, c, t, g, unknown or other
  misc_feature (305)..(307): n is a, c, g, or t

SEQ ID NO: 117180 - DNA, 309 bp, Homo sapiens; identical to SEQ ID NO: 117160
  misc_feature: GYAE6OF01D1046.29.30.C08.1.454.CMB.1.raw
  modified_base (305)..(309): a, c, t, g, unknown or other
  misc_feature (305)..(309): n is a, c, g, or t

SEQ ID NO: 117181 - DNA, 334 bp, Homo sapiens
  misc_feature: GYAE6OF01BS16A.29.30.C08.1.454.CMB.1.raw
  modified_base (206)..(206): a, c, t, g, unknown or other
  misc_feature (206)..(206): n is a, c, g, or t
  modified_base (308)..(334): a, c, t, g, unknown or other
  misc_feature (308)..(334): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaacttcactgtctcctctagcctccaccaagggcccatcggtcttcccctggcnccctgctccaggagcacctccggagagcacagcggccctgggctgcctggtcaaggctacttccacgtagcgtgctgagcgggctgggcaaggcgcataggnnnnnnnnnnnnnnnnnnnnnnnnnnn

SEQ ID NO: 117182 - DNA, 306 bp, Homo sapiens; identical to SEQ ID NO: 117135
  misc_feature: GYAE6OF01EMIMD.29.30.C08.1.454.CMB.1.raw
  modified_base (304)..(306): a, c, t, g, unknown or other
  misc_feature (304)..(306): n is a, c, g, or t

SEQ ID NO: 117183 - DNA, 309 bp, Homo sapiens; identical to SEQ ID NO: 117148
  misc_feature: GYAE6OF01AVUI0.29.30.C08.1.454.CMB.1.raw
  modified_base (305)..(309): a, c, t, g, unknown or other
  misc_feature (305)..(309): n is a, c, g, or t

SEQ ID NO: 117184 - DNA, 306 bp, Homo sapiens
  misc_feature: GYAE6OF01CJU17.29.30.C08.1.454.CMB.1.raw
  modified_base (302)..(306): a, c, t, g, unknown or other
  misc_feature (302)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggcctgggctgcctggtcaaggctacttccacgtagcgtgctgagcgggctggcaaggcgcatagnnnnn

SEQ ID NO: 117185 - DNA, 307 bp, Homo sapiens
  misc_feature: GYAE6OF01BM6IS.29.30.C08.1.454.CMB.1.raw
  modified_base (305)..(307): a, c, t, g, unknown or other
  misc_feature (305)..(307): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagataacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnn

SEQ ID NO: 117186 - DNA, 307 bp, Homo sapiens
  misc_feature: GYAE6OF01CEKXV.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggcctgggctgcctggtcaaggctacttccacgtagcgtgctgagcgggctggcaaggcgcatagnnnn

SEQ ID NO: 117187 - DNA, 308 bp, Homo sapiens
  misc_feature: GYAE6OF01D61UJ.29.30.C08.1.454.CMB.1.raw
  modified_base (305)..(308): a, c, t, g, unknown or other
  misc_feature (305)..(308): n is a, c, g, or t
tcagatagagtactcacgaccggtgctcgatttagtctgacgtcaaagggaaagggctggagtgggtggccaacataaaccaagatggaagtgaaccagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117188 - DNA, 310 bp, Homo sapiens; identical to SEQ ID NO: 117127
  misc_feature: GYAE6OF01EMYMY.29.30.C08.1.454.CMB.1.raw
  modified_base (305)..(310): a, c, t, g, unknown or other
  misc_feature (305)..(310): n is a, c, g, or t

SEQ ID NO: 117189 - DNA, 230 bp, Homo sapiens
  misc_feature: GYAE6OF01CTCSL.29.30.C08.1.454.CMB.1.raw
  modified_base (214)..(230): a, c, t, g, unknown or other
  misc_feature (214)..(230): n is a, c, g, or t
tcagatagagtactcacgaccggtgctcgatttagtctgacgtcaaagggaaagggaccacgggtcatcgtgtcctcagcctccaccaagggcccatcggtcttccccctggcaccctcctccaagagcacctctgggggcacagcggccctgggctgcctggtcaaggactacttccagacgacgctctgagcgggctggcaaggcgcatagnnnnnnnnnnnnnnnnn

SEQ ID NO: 117190 - DNA, 311 bp, Homo sapiens
  misc_feature: GYAE6OF01CR2VO.29.30.C08.1.454.CMB.1.raw
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnnn

SEQ ID NO: 117191 - DNA, 325 bp, Homo sapiens
  misc_feature: GYAE6OF01EP52X.29.30.C08.1.454.CMB.1.raw
  modified_base (310)..(310): a, c, t, g, unknown or other
  misc_feature (310)..(310): n is a, c, g, or t
  modified_base (312)..(325): a, c, t, g, unknown or other
  misc_feature (312)..(325): n is a, c, g, or t
tcagatagagtactcacgaccggtgctcgatttagtctgacgtcaaagggaaagggggctggagtgggtaggccaaccataaaccaagatggaagtgaacagtactatgtggactctgtgaagggccgattcaccatcttccagtagacaacgccaagaactcactgtctcctcagcctccaccaagggcccatcggtcttccccctggcgccctgctccgaggagcacctccgagagcacagcggccctgggctgcctggtcaaggctacttcacgtagcgtgctgagcgggctggcaaggcgcatagngnnnnnnnnnnnnnn

SEQ ID NO: 117192 - DNA, 327 bp, Homo sapiens
  misc_feature: GYAE6OF01EYPS7.29.30.C08.1.454.CMB.1.raw
  modified_base (220)..(220): a, c, t, g, unknown or other
  misc_feature (220)..(220): n is a, c, g, or t
  modified_base (311)..(327): a, c, t, g, unknown or other
  misc_feature (311)..(327): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgatttcaccatctccagagacaacgccaagaactcactgtctcctcagcctccaccaagggcccatcggtcttcccctggcgccctgctcaggancacctccgagagcacaggccggccctgggctgcctggtcaaggctacttccacgtagcgttgctgagcgggcctgggcaaggccgcatagnnnnnnnnnnnnnnnnn

SEQ ID NO: 117193 - DNA, 307 bp, Homo sapiens; identical to SEQ ID NO: 117110
  misc_feature: GYAE6OF01DVBJ4.29.30.C08.1.454.CMB.1.raw
  modified_base (305)..(307): a, c, t, g, unknown or other
  misc_feature (305)..(307): n is a, c, g, or t

SEQ ID NO: 117194 - DNA, 309 bp, Homo sapiens; identical to SEQ ID NO: 117160
  misc_feature: GYAE6OF01DRFNS.29.30.C08.1.454.CMB.1.raw
  modified_base (305)..(309): a, c, t, g, unknown or other
  misc_feature (305)..(309): n is a, c, g, or t

SEQ ID NO: 117195 - DNA, 309 bp, Homo sapiens; identical to SEQ ID NO: 117160
  misc_feature: GYAE6OF01BWMMX.29.30.C08.1.454.CMB.1.raw
  modified_base (305)..(309): a, c, t, g, unknown or other
  misc_feature (305)..(309): n is a, c, g, or t

SEQ ID NO: 117196 - DNA, 308 bp, Homo sapiens; identical to SEQ ID NO: 117129
  misc_feature: GYAE6OF01BVE5B.29.30.C08.1.454.CMB.1.raw
  modified_base (305)..(308): a, c, t, g, unknown or other
  misc_feature (305)..(308): n is a, c, g, or t

SEQ ID NO: 117197 - DNA, 306 bp, Homo sapiens; identical to SEQ ID NO: 117135
  misc_feature: GYAE6OF01BRKEA.29.30.C08.1.454.CMB.1.raw
  modified_base (304)..(306): a, c, t, g, unknown or other
  misc_feature (304)..(306): n is a, c, g, or t

SEQ ID NO: 117198 - DNA, 307 bp, Homo sapiens; identical to SEQ ID NO: 117094
  misc_feature: GYAE6OF01EMOSV.29.30.C08.1.454.CMB.1.raw
  modified_base (304)..(307): a, c, t, g, unknown or other
  misc_feature (304)..(307): n is a, c, g, or t

SEQ ID NO: 117199 - DNA, 309 bp, Homo sapiens
  misc_feature: GYAE6OF01A7YSC.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnn

SEQ ID NO: 117200 - DNA, 309 bp, Homo sapiens; identical to SEQ ID NO: 117160
  misc_feature: GYAE6OF01DRH2N.29.30.C08.1.454.CMB.1.raw
  modified_base (305)..(309): a, c, t, g, unknown or other
  misc_feature (305)..(309): n is a, c, g, or t

SEQ ID NO: 117201 - DNA, 306 bp, Homo sapiens
  misc_feature: GYAE6OF01CZY6D.29.30.C08.1.454.CMB.1.raw
  modified_base (305)..(306): a, c, t, g, unknown or other
  misc_feature (305)..(306): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcttgctgagcgggctggcaaggcgcatagnn

SEQ ID NO: 117202 - DNA, 310 bp, Homo sapiens; identical to SEQ ID NO: 117127
  misc_feature: GYAE6OF01DCC1W.29.30.C08.1.454.CMB.1.raw
  modified_base (305)..(310): a, c, t, g, unknown or other
  misc_feature (305)..(310): n is a, c, g, or t

SEQ ID NO: 117203 - DNA, 308 bp, Homo sapiens
  misc_feature: GYAE6OF01ELC9J.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnn

SEQ ID NO: 117204 - DNA, 306 bp, Homo sapiens
  misc_feature: GYAE6OF01BP4PC.29.30.C08.1.454.CMB.1.raw
  modified_base (303)..(306): a, c, t, g, unknown or other
  misc_feature (303)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggctacttccacgtagcgtgctgagcgggctggcaaggcgcatagnnnn

SEQ ID NO: 117205 - DNA, 311 bp, Homo sapiens; identical to SEQ ID NO: 117190
  misc_feature: GYAE6OF01DNUG9.29.30.C08.1.454.CMB.1.raw
  modified_base (306)..(311): a, c, t, g, unknown or other
  misc_feature (306)..(311): n is a, c, g, or t

SEQ ID NO: 117206 - DNA, 306 bp, Homo sapiens; identical to SEQ ID NO: 117170
  misc_feature: GYAE6OF01APGQF.29.30.C08.1.454.CMB.1.raw
  modified_base (304)..(306): a, c, t, g, unknown or other
  misc_feature (304)..(306): n is a, c, g, or t

SEQ ID NO: 117207 - DNA, 309 bp, Homo sapiens; identical to SEQ ID NO: 117160
  misc_feature: GYAE6OF01BSYWK.29.30.C08.1.454.CMB.1.raw
  modified_base (305)..(309): a, c, t, g, unknown or other
  misc_feature (305)..(309): n is a, c, g, or t

SEQ ID NO: 117208 - DNA, 310 bp, Homo sapiens
  misc_feature: GYAE6OF01C66V4.29.30.C08.1.454.CMB.1.raw
  modified_base (302)..(310): a, c, t, g, unknown or other
  misc_feature (302)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaactacttccacgtagcgtgctgagcgggctggcaggcgcatagnnnnnnnnn

SEQ ID NO: 117209 - DNA, 311 bp, Homo sapiens
  misc_feature: GYAE6OF01DIP05.29.30.C08.1.454.CMB.1.raw
  modified_base (299)..(299): a, c, t, g, unknown or other
  misc_feature (299)..(299): n is a, c, g, or t
  modified_base (305)..(311): a, c, t, g, unknown or other
  misc_feature (305)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagtcggccctgggctgcctggtcaaggctacttcacgtagcgtgctgagcgggctggcaaggcncatagnnnnnnn

SEQ ID NO: 117210 - DNA, 309 bp, Homo sapiens
  misc_feature: GYAE6OF01BVQTK.29.30.C08.1.454.CMB.1.raw
  modified_base (219)..(219): a, c, t, g, unknown or other
  misc_feature (219)..(219): n is a, c, g, or t
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagcggccctgggctgcctggtcaaggactacttccacgtagcgtgctgagcgggctggcaaggcgcatagnnnnn

SEQ ID NO: 117211 - DNA, 308 bp, Homo sapiens
  misc_feature: GYAE6OF01CYGUE.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcgccctgggctgcctggtcaaggactacttccacgtagcgtgctgagcgggctggcaaggcgcatagnnnnn

SEQ ID NO: 117212 - DNA, 310 bp, Homo sapiens
  misc_feature: GYAE6OF01DO629.29.30.C08.1.454.CMB.1.raw
  modified_base (302)..(302): a, c, t, g, unknown or other
  misc_feature (302)..(302): n is a, c, g, or t
  modified_base (307)..(310): a, c, t, g, unknown or other
  misc_feature (307)..(310): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtcctcctcagcctccaccaacggcccatcggtccttcccctggccgccctgctccgaggagcacctccgagagcacagccggcctgggctgcctggtcaaggctacttccacgtagcgtgctgagcgggctggcaaggcgnaatgnnnn

SEQ ID NO: 117213 - DNA, 309 bp, Homo sapiens; identical to SEQ ID NO: 117160
  misc_feature: GYAE6OF01EEZIJ.29.30.C08.1.454.CMB.1.raw
  modified_base (305)..(309): a, c, t, g, unknown or other
  misc_feature (305)..(309): n is a, c, g, or t

SEQ ID NO: 117214 - DNA, 307 bp, Homo sapiens; identical to SEQ ID NO: 117110
  misc_feature: GYAE6OF01ER3LY.29.30.C08.1.454.CMB.1.raw
  modified_base (305)..(307): a, c, t, g, unknown or other
  misc_feature (305)..(307): n is a, c, g, or t

SEQ ID NO: 117215 - DNA, 694 bp, Homo sapiens
  misc_feature: GYAE6OF01D3XPQ.29.30.C08.1.454.CMB.1.raw
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
tcagatagagtactcacgaccggtgctcgattttagtctgacgtcaagggaagggggctttggagtgggtggccaacagtaaacccaacggatggaaagtagaacaggtaactatcgttggacgttttcctcgtgaacgggtccggtattcaccatccctaccgagggacgacaaccgaccgaagaactcaccttcgtcgtccttcggaccggaccttaccaccgaaagggccccagtcggtcctttccccctggccgcccctgctcccaaggtgcctaccttccggaagtaagtccaaacgtagggccgggtccccgtttagggtcttgggcccttggggtacaaacggggactaacgtttcccccggaagggttacgcggtggcgtagacggcggggctggactaacgggcgccaatttaagggngananananacacacncncnagagaganctcttcngngagacgacaacacactactactanatatactctctcgaccgccgacgacgtacgtacctttacttacgtgtcgcgacgacgtacgaacacgacgaactaacttaacttattattagttagtagttacggttacgggtaccggtaaccggtacccggtaccgaccgtacttactcctaccgtaccgtacctaccgaccgaaccggtaccgtaccgttccgttcccgtcccg

SEQ ID NO: 117216 - DNA, 308 bp, Homo sapiens
  misc_feature: GYAE6OF01D5FHI.29.30.C08.1.454.CMB.1.raw
  modified_base (292)..(292): a, c, t, g, unknown or other
  misc_feature (292)..(292): n is a, c, g, or t
  modified_base (298)..(308): a, c, t, g, unknown or other
  misc_feature (298)..(308): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagcaacgccaagaactcactgtctcctcagcctccaccaagggcccatcggtcttcccctggcgccctgctccaggagcacctcgagagcacagcggccctggctgcctggtcaaggctacttccacgtagcgtgctgagcggctggcaggcncatagnnnnnnnnnnn

SEQ ID NO: 117217 - DNA, 307 bp, Homo sapiens; identical to SEQ ID NO: 117110
  misc_feature: GYAE6OF01C9I03.29.30.C08.1.454.CMB.1.raw
  modified_base (305)..(307): a, c, t, g, unknown or other
  misc_feature (305)..(307): n is a, c, g, or t

SEQ ID NO: 117218 - DNA, 320 bp, Homo sapiens
  misc_feature: GYAE6OF01E2NYU.29.30.C08.1.454.CMB.1.raw
  modified_base (306)..(320): a, c, t, g, unknown or other
  misc_feature (306)..(320): n is a, c, g, or t
tcagatagagtactcacgaccggtgctcgatttagtctgacgtcaaagggaaaggggctggagtgggtggccaacataaaccaagatggaagtgaacagtactatgtggactctggtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnnnnnn

SEQ ID NO: 117219 - DNA, 309 bp, Homo sapiens
  misc_feature: GYAE6OF01CV77P.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagcgggtggccaacataaaccaagatggaagtgaacagtactatgtggactctgtgaagggccgattcaccatctcagagacaacgccaagaactcactgtctcctcagcctccaccaagggcccatccggtcttcccctggccgccctgctccaggagcacctccgagagcacagcggcctgggctgcctggtcaaggactacttccacgtagcgtgctgagcgggctggcaaggcgcatagnnnnn

SEQ ID NO: 117220 - DNA, 331 bp, Homo sapiens
  misc_feature: GYAE6OF01A8E43.29.30.C08.1.454.CMB.1.raw
  modified_base (308)..(331): a, c, t, g, unknown or other
  misc_feature (308)..(331): n is a, c, g, or t
tcagatagagtactcacgaccggtgctcgatttagtctgacgtcaaagggaaaggggctggagtgggtaggccaacataaaccaagatggaagtgaacagtactatgtggactctgtgaagggcccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnnnnnnnnnnnnnnnnnnnnn

SEQ ID NO: 117221 - DNA, 314 bp, Homo sapiens
  misc_feature: GYAE6OF01D7U4P.29.30.C08.1.454.CMB.1.raw
  modified_base (309)..(314): a, c, t, g, unknown or other
  misc_feature (309)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggccgccctgctccaggacgcacctccgagagcacagcggccctgggctgcctggtcaaggacctacttccacgtagcgtgctgagcgggctggcaaggcgcatagnnnnnn

SEQ ID NO: 117222 - DNA, 312 bp, Homo sapiens
  misc_feature: GYAE6OF01A8161.29.30.C08.1.454.CMB.1.raw
  modified_base (306)..(312): a, c, t, g, unknown or other
  misc_feature (306)..(312): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctgggcaagggcgcatagnnnnnnn

SEQ ID NO: 117223 - DNA, 214 bp, Homo sapiens
  misc_feature: GYAE6OF01DJCP1.29.30.C08.1.454.CMB.1.raw
  modified_base (212)..(214): a, c, t, g, unknown or other
  misc_feature (212)..(214): n is a, c, g, or t
tcagatagagtactcacgaccggtgctcgatttagtctgacgtcaaagggaaagggaccacggtcatcgtgtcctcagcctccaccaaggcccatcggtcttccccctggcaccctcctccaagagcacctctgggggcacagcggccctgggctgcctggtcaaggactacttccagacgacgctctgagcgggctggcaaggcgcatagnnn

SEQ ID NO: 117224 - DNA, 306 bp, Homo sapiens
  misc_feature: GYAE6OF01AIFV5.29.30.C08.1.454.CMB.1.raw
  modified_base (304)..(306): a, c, t, g, unknown or other
  misc_feature (304)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactactccacgtagcgtgctgagcgggctggcaaggcgcatagnnn

SEQ ID NO: 117225 - DNA, 311 bp, Homo sapiens; identical to SEQ ID NO: 117190
  misc_feature: GYAE6OF01CXPB6.29.30.C08.1.454.CMB.1.raw
  modified_base (306)..(311): a, c, t, g, unknown or other
  misc_feature (306)..(311): n is a, c, g, or t

SEQ ID NO: 117226 - DNA, 307 bp, Homo sapiens; identical to SEQ ID NO: 117110
  misc_feature: GYAE6OF01ENGIR.29.30.C08.1.454.CMB.1.raw
  modified_base (305)..(307): a, c, t, g, unknown or other
  misc_feature (305)..(307): n is a, c, g, or t

SEQ ID NO: 117227 - DNA, 337 bp, Homo sapiens
  misc_feature: GYAE6OF01DBGQM.29.30.C08.1.454.CMB.1.raw
  modified_base (310)..(337): a, c, t, g, unknown or other
  misc_feature (310)..(337): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctcagagacaacgccaagaacctcactgtctcctcagcctccaccgaagggcccagttcggtccttccccctggccgccctgctccaggagcacctccgagagcacagcggcctgggctgcctggtcaaggactacttccacgtagcgtgctgagcgggctggcaaggcgcatagannnnnnnnnnnnnnnnnnnnnnnnnnnn

SEQ ID NO: 117228 - DNA, 310 bp, Homo sapiens; identical to SEQ ID NO: 117166
  misc_feature: GYAE6OF01BOYJR.29.30.C08.1.454.CMB.1.raw
  modified_base (306)..(310): a, c, t, g, unknown or other
  misc_feature (306)..(310): n is a, c, g, or t

SEQ ID NO: 117229 - DNA, 307 bp, Homo sapiens; identical to SEQ ID NO: 117110
  misc_feature: GYAE6OF01BSPPT.29.30.C08.1.454.CMB.1.raw
  modified_base (305)..(307): a, c, t, g, unknown or other
  misc_feature (305)..(307): n is a, c, g, or t

SEQ ID NO: 117230 - DNA, 306 bp, Homo sapiens
  misc_feature: GYAE6OF01DNPLW.29.30.C08.1.454.CMB.1.raw
  modified_base (304)..(306): a, c, t, g, unknown or other
  misc_feature (304)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatagnnn

SEQ ID NO: 117231 - DNA, 346 bp, Homo sapiens
  misc_feature: GYAE6OF01DC6W7.29.30.C08.1.454.CMB.1.raw
  modified_base (312)..(346): a, c, t, g, unknown or other
  misc_feature (312)..(346): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtccttccccctggccgccctgcctccaggagcacctccgagagcacagccggccctgggctgcctggtcaaggactacttaccacgtagcgtgctgagcgggctggcaaggcgcatagnnnnnnnnnnnnnnnnnnnnnnnnnnnnnnnnnnn

SEQ ID NO: 117232 - DNA, 309 bp, Homo sapiens
  misc_feature: GYAE6OF01EULEW.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnn

SEQ ID NO: 117233 - DNA, 307 bp, Homo sapiens
  misc_feature: GYAE6OF01CFWSN.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnn

SEQ ID NO: 117234 - DNA, 310 bp, Homo sapiens
  misc_feature: GYAE6OF01DMR3R.29.30.C08.1.454.CMB.1.raw
  modified_base (305)..(310): a, c, t, g, unknown or other
  misc_feature (305)..(310): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgccctggtcaaggactacttccacgtagcgtgctgagcgggctggcaaggcgcatagnnnnnn

SEQ ID NO: 117235 - DNA, 498 bp, Homo sapiens
  misc_feature: GYAE6OF01EHTRY.29.30.C08.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (214)..(215): a, c, t, g, unknown or other
  misc_feature (214)..(215): n is a, c, g, or t
  modified_base (219)..(219): a, c, t, g, unknown or other
  misc_feature (219)..(219): n is a, c, g, or t
  modified_base (280)..(284): a, c, t, g, unknown or other
  misc_feature (280)..(284): n is a, c, g, or t
  modified_base (286)..(287): a, c, t, g, unknown or other
  misc_feature (286)..(287): n is a, c, g, or t
  modified_base (290)..(290): a, c, t, g, unknown or other
  misc_feature (290)..(290): n is a, c, g, or t
  modified_base (293)..(294): a, c, t, g, unknown or other
  misc_feature (293)..(294): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (313)..(314): a, c, t, g, unknown or other
  misc_feature (313)..(314): n is a, c, g, or t
  modified_base (318)..(318): a, c, t, g, unknown or other
  misc_feature (318)..(318): n is a, c, g, or t
  modified_base (320)..(321): a, c, t, g, unknown or other
  misc_feature (320)..(321): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (339)..(340): a, c, t, g, unknown or other
  misc_feature (339)..(340): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctcacaggcccatcggtctcccngcncctnctcngncactcgnncacngcgcctggctgcctgtcaggctactccagtgcgtgctgacgcggctggcaaggcgcatagnnnnntnncgntanncgatnangatcntcnctannctantnntacgtnagtcntcatcgnngcntagntacgtnagtcagtcngtcagttcacgtacgtcgtacgtcgtacgtacgtcggtaaccgtgtacgtaacgtacgtcgtaacggttccttaggaccgtttaccggattaaccggtcggttcctaacggggtcttacgggtcctaagggttccc

SEQ ID NO: 117236 - DNA, 235 bp, Homo sapiens
  misc_feature: GYAE6OF01D8GQV.29.30.C08.1.454.CMB.1.raw
  modified_base (216)..(235): a, c, t, g, unknown or other
  misc_feature (216)..(235): n is a, c, g, or t
tcagatagagtactcacgaccggtgctcgatttagtctgacgtcaaagggaaagggaccacggtcatcgtgtcctcagcctccaccaagggcccaatccggtcttccccctggcacccctcctccaagagcacctctgggggcacagcggccctgggctgcctggtcaaggactacttccagacgacgctctgagcgggctggcaaggcgcatagnnnnnnnnnnnnnnnnnnnn

SEQ ID NO: 117237 - DNA, 345 bp, Homo sapiens
  misc_feature: GYAE6OF01AQ596.29.30.C08.1.454.CMB.1.raw
  modified_base (199)..(199): a, c, t, g, unknown or other
  misc_feature (199)..(199): n is a, c, g, or t
  modified_base (310)..(310): a, c, t, g, unknown or other
  misc_feature (310)..(310): n is a, c, g, or t
  modified_base (313)..(345): a, c, t, g, unknown or other
  misc_feature (313)..(345): n is a, c, g, or t
tcagatagagtactcacgaccggtgctcgatttagtctgacgtcaaagggaaaggggctggagtgggtggccaacataaaccaagatgggaagtgaacagtactatgtggactctgtgaagggccgattcaccatctccagagacaacgccaagaactcactgtctcctcagcctcaccaaggcccatcggtcttcccnggcgccctgctccaggagcacctccgagagcacgagcggccctgggctggcctggtacaaggactacttccacgtagcgtgctgacgcgggctggcaagggcgacagtagnagnnnnnnnnnnnnnnnnnnnnnnnnnnnnnnnnn

SEQ ID NO: 117238 - DNA, 306 bp, Homo sapiens
  misc_feature: GYAE6OF01BZ4OR.29.30.C08.1.454.CMB.1.raw
  modified_base (301)..(306): a, c, t, g, unknown or other
  misc_feature (301)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtccttcccctggcgccctgctccaggagcacctcgagagcacagcggccctgggctgcctggtcaaggctacttccagtagcgtgctgagcgggctggcaaggcgcatgnnnnnn

SEQ ID NO: 117239 - DNA, 309 bp, Homo sapiens; identical to SEQ ID NO: 117115
  misc_feature: GYAE6OF01A558Y.29.30.C08.1.454.CMB.1.raw
  modified_base (306)..(309): a, c, t, g, unknown or other
  misc_feature (306)..(309): n is a, c, g, or t

SEQ ID NO: 117240 - DNA, 311 bp, Homo sapiens
  misc_feature: GYAE6OF01DNU1Z.29.30.C08.1.454.CMB.1.raw
  modified_base (305)..(311): a, c, t, g, unknown or other
  misc_feature (305)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnn

SEQ ID NO: 117241 - DNA, 307 bp, Homo sapiens; identical to SEQ ID NO: 117094
  misc_feature: GYAE6OF01DVDOK.29.30.C08.1.454.CMB.1.raw
  modified_base (304)..(307): a, c, t, g, unknown or other
  misc_feature (304)..(307): n is a, c, g, or t

SEQ ID NO: 117242 - DNA, 306 bp, Homo sapiens
  misc_feature: GYAE6OF01CR0EI.29.30.C08.1.454.CMB.1.raw
  modified_base (304)..(306): a, c, t, g, unknown or other
  misc_feature (304)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnn

SEQ ID NO: 117243 - DNA, 309 bp, Homo sapiens; identical to SEQ ID NO: 117199
  misc_feature: GYAE6OF01BOZZU.29.30.C08.1.454.CMB.1.raw
  modified_base (305)..(309): a, c, t, g, unknown or other
  misc_feature (305)..(309): n is a, c, g, or t

SEQ ID NO: 117244 - DNA, 331 bp, Homo sapiens
  misc_feature: GYAE6OF01BF4KI.29.30.C08.1.454.CMB.1.raw
  modified_base (325)..(331): a, c, t, g, unknown or other
  misc_feature (325)..(331): n is a, c, g, or t
tcagatagagtactcacgaccggtgctcgatttagtctgacgtcaaagggaaaggggctggaggtgggtggccaacaataaaccaagatggaagtgaacagtactatgtggactctgtggaaggccgattcaccatctccagagacaacgccaagaactcactgtctcctcacgcctccaccgaacgggcccatcggtccttcccccgtggccgccctgcctccgaggacgccacctccgagacgcacaggccggcccgtgggctgccgtggtacaaggacctacttccacgtagcgtgctgaggcggctggcaaggcgcatagnnnnnnn

SEQ ID NO: 117245 - DNA, 307 bp, Homo sapiens; identical to SEQ ID NO: 117110
  misc_feature: GYAE6OF01EOZNU.29.30.C08.1.454.CMB.1.raw
  modified_base (305)..(307): a, c, t, g, unknown or other
  misc_feature (305)..(307): n is a, c, g, or t

SEQ ID NO: 117246 - DNA, 312 bp, Homo sapiens
  misc_feature: GYAE6OF01D4ZI7.29.30.C08.1.454.CMB.1.raw
  modified_base (308)..(312): a, c, t, g, unknown or other
  misc_feature (308)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctgggcaagggcgcatagnnnnn

SEQ ID NO: 117247 - DNA, 316 bp, Homo sapiens
  misc_feature: GYAE6OF01EXBXG.29.30.C08.1.454.CMB.1.raw
  modified_base (96)..(96): a, c, t, g, unknown or other
  misc_feature (96)..(96): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (306)..(316): a, c, t, g, unknown or other
  misc_feature (306)..(316): n is a, c, g, or t
tcagatagagtactcacgaccggtgctcgatttagtctgacgtcaaagggaaggggctggagtgggtggccaacataaaccaagatggaatgaacngtactatgtggactctgtgaagggccgattcaccatctccagagacaacgccaagaactcactgctctcagcctccaccgaagggcccatcggtcttcccctggcgccctgctccaggancactcgagagcanagcggtccctgggcctgcctggtcaaggactacttccacgtagcgtgctgagcgggtctggacaagggctacatagnnnnnnnnnnn

SEQ ID NO: 117248 - DNA, 306 bp, Homo sapiens
  misc_feature: GYAE6OF01E53GU.29.30.C08.1.454.CMB.1.raw
  modified_base (305)..(306): a, c, t, g, unknown or other
  misc_feature (305)..(306): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggactacttccacgtagcgtgctgagcgggctggcaagggcgcatgnn

SEQ ID NO: 117249 - DNA, 336 bp, Homo sapiens
  misc_feature: GYAE6OF01EGJRY.29.30.C08.1.454.CMB.1.raw
  modified_base (308)..(308): a, c, t, g, unknown or other
  misc_feature (308)..(308): n is a, c, g, or t
  modified_base (310)..(336): a, c, t, g, unknown or other
  misc_feature (310)..(336): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagacgcacagcggccctgggctgcctggtcaaggactacttccacgtagcgtgctgagcgggctgggcaaggcgcataggcngnnnnnnnnnnnnnnnnnnnnnnnnnnn

SEQ ID NO: 117250 - DNA, 306 bp, Homo sapiens
  misc_feature: GYAE6OF01CKOSM.29.30.C08.1.454.CMB.1.raw
  modified_base (303)..(306): a, c, t, g, unknown or other
  misc_feature (303)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcgggctggcaaggcgcatagnnnn

SEQ ID NO: 117251 - DNA, 308 bp, Homo sapiens
  misc_feature: GYAE6OF01COBNW.29.30.C08.1.454.CMB.1.raw
  modified_base (302)..(308): a, c, t, g, unknown or other
  misc_feature (302)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggcctgggctgcctggtcaaggctacttccacgtagcgtgctgagcgggctggcaaggcgcatagnnnnnnn

SEQ ID NO: 117252 - DNA, 314 bp, Homo sapiens
  misc_feature: GYAE6OF01BQC3F.29.30.C08.1.454.CMB.1.raw
  modified_base (219)..(219): a, c, t, g, unknown or other
  misc_feature (219)..(219): n is a, c, g, or t
  modified_base (304)..(314): a, c, t, g, unknown or other
  misc_feature (304)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagcggcctgggctgcctggtcaaggactacttccagtagcgtgctgagcgggctggcaaggcgcagtagnnnnnnnnnnn

SEQ ID NO: 117253 - DNA, 342 bp, Homo sapiens
  misc_feature: GYAE6OF01DY00A.29.30.C08.1.454.CMB.1.raw
  modified_base (290)..(290): a, c, t, g, unknown or other
  misc_feature (290)..(290): n is a, c, g, or t
  modified_base (312)..(314): a, c, t, g, unknown or other
  misc_feature (312)..(314): n is a, c, g, or t
  modified_base (316)..(342): a, c, t, g, unknown or other
  misc_feature (316)..(342): n is a, c, g, or t
tcagatagagtactcacgaccggtgctcgatttagtctgacgtcaaagggaaaggggctggaggtgggtggccaacataaaccaagatgggaagtgaacagtacctatgtggactctgtgaagggccgattcaccatctccagagacaacgccaagaactcactgtctcctcagcctccaccaagggcccatcggtcttcccctggcgccctgcctccaggagcacctccgagagcacagcggccctgggctgccgtggtcaaggactacttccacggtagcgtgctgancgggctggcaaggcgcattagnnncnnnnnnnnnnnnnnnnnnnnnnnnnnn

SEQ ID NO: 117254 - DNA, 307 bp, Homo sapiens; identical to SEQ ID NO: 117110
  misc_feature: GYAE6OF01C03OD.29.30.C08.1.454.CMB.1.raw
  modified_base (305)..(307): a, c, t, g, unknown or other
  misc_feature (305)..(307): n is a, c, g, or t

SEQ ID NO: 117255 - DNA, 310 bp, Homo sapiens; identical to SEQ ID NO: 117166
  misc_feature: GYAE6OF01BPACK.29.30.C08.1.454.CMB.1.raw
  modified_base (306)..(310): a, c, t, g, unknown or other
  misc_feature (306)..(310): n is a, c, g, or t

SEQ ID NO: 117256 - DNA, 310 bp, Homo sapiens; identical to SEQ ID NO: 117127
  misc_feature: GYAE6OF01B4YNA.29.30.C08.1.454.CMB.1.raw
  modified_base (305)..(310): a, c, t, g, unknown or other
  misc_feature (305)..(310): n is a, c, g, or t

SEQ ID NO: 117257 - DNA, 310 bp, Homo sapiens; identical to SEQ ID NO: 117127
  misc_feature: GYAE6OF01DFKTR.29.30.C08.1.454.CMB.1.raw
  modified_base (305)..(310): a, c, t, g, unknown or other
  misc_feature (305)..(310): n is a, c, g, or t

SEQ ID NO: 117258 - DNA, 372 bp, Homo sapiens
  misc_feature: GYAE6OF01CKA50.29.30.C08.1.454.CMB.1.raw
  modified_base (347)..(348): a, c, t, g, unknown or other
  misc_feature (347)..(348): n is a, c, g, or t
  modified_base (350)..(372): a, c, t, g, unknown or other
  misc_feature (350)..(372): n is a, c, g, or t
tcagatagagtactcacgaccggtgctcgatttagtctgacgtcaaaggggaaaggggcgtgggagtgggtggccaacaataaaccaagatggaagtgaacagtactatgtggactctgtgaagggccgattcaccatctcagagacaacgccaagaactcactgtctcctcagcctccaccgaagggcccagtcggtccttcccccgtggccgccctgcctccgagggacgccgaccgtccggagacgcacgacggtccggccctggggcctcgccgtaggtaccaaggtccttaaccttccgaacggtagcgtgcgtgaggcgggctgggcaagggcacagtagnngnnnnnnnnnnnnnnnnnnnnnnn

SEQ ID NO: 117259 - DNA, 308 bp, Homo sapiens
  misc_feature: GYAE6OF01C5SQZ.29.30.C08.1.454.CMB.1.raw
  modified_base (303)..(308): a, c, t, g, unknown or other
  misc_feature (303)..(308): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaagggcgcatagnnnnnn

SEQ ID NO: 117260 - DNA, 310 bp, Homo sapiens
  misc_feature: GYAE6OF01B9NAV.29.30.C08.1.454.CMB.1.raw
  modified_base (306)..(310): a, c, t, g, unknown or other
  misc_feature (306)..(310): n is a, c, g, or t
tcagatagagtactcacgaccggtgctcgatttagtctgacgtcaaagggaaaggggctggtgtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnn

SEQ ID NO: 117261 - DNA, 353 bp, Homo sapiens
  misc_feature: GYAE6OF01BA8B3.29.30.C08.1.454.CMB.1.raw
  modified_base (229)..(229): a, c, t, g, unknown or other
  misc_feature (229)..(229): n is a, c, g, or t
  modified_base (318)..(353): a, c, t, g, unknown or other
  misc_feature (318)..(353): n is a, c, g, or t
tcagatagagtactcacgaccggtgctcgatttagtctgacgtcaaagggtaagggggctggagtgggtggccaacataaaccaaggatggaagtgaacaggtacctagtgtggactctgttgaagggcccgattcaccatcgtccagaggcaacggccaagaactcacctgtctcctcagcctccaccaagggcccagtcggtcttcccctggcgccctgctccaggncactccgagagcacagcggccctgggctgcctggtcaaggctacttccgacgtagccgtgctgagccgggactggcaaggcgtcatagnnnnnnnnnnnnnnnnnnnnnnnnnnnnnnnnnnnn

SEQ ID NO: 117262 - DNA, 323 bp, Homo sapiens
  misc_feature: GYAE6OF01CYIAM.29.30.C08.1.454.CMB.1.raw
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
  modified_base (311)..(323): a, c, t, g, unknown or other
  misc_feature (311)..(323): n is a, c, g, or t
tcagatagagtactcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgcctccagganccacctccgagagcacagccggccctgggctgacctggtcaaggctacttccacgtancgtgctgacgcgggctggcaaggcgcatagnnnnnnnnnnnnn

SEQ ID NO: 117263 - DNA, 310 bp, Homo sapiens
  misc_feature: GYAE6OF01AT5KM.29.30.C08.1.454.CMB.1.raw
  modified_base (306)..(310): a, c, t, g, unknown or other
  misc_feature (306)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagccacctccgagagcacagcggccctgggctgcctggtcaaggactacttccacgtagcgtgctgagcgggctggcaaggcgcatagnnnnn

SEQ ID NO: 117264 - DNA, 310 bp, Homo sapiens
  misc_feature: GYAE6OF01DCHCB.29.30.C08.1.454.CMB.1.raw
  modified_base (306)..(310): a, c, t, g, unknown or other
  misc_feature (306)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagccggcctgggctgcctggtcaaggactacttccacgtagcgtgctgagcgggctggcaaggcgcatagnnnnn

SEQ ID NO: 117265 - DNA, 328 bp, Homo sapiens
  misc_feature: GYAE6OF01C79I0.29.30.C08.1.454.CMB.1.raw
  modified_base (220)..(220): a, c, t, g, unknown or other
  misc_feature (220)..(220): n is a, c, g, or t
  modified_base (306)..(328): a, c, t, g, unknown or other
  misc_feature (306)..(328): n is a, c, g, or t
tcagatagagtactcacgaccggtgctcgatttagtctgacgtcaaaggggaaaggggctggagtgggtggccaacataaaccaagatggaagtgaacagtactatgtggactctgtgaagggccgattcacatctccagagacaacgccaagaactcactgtctcctcagcctccaccaaggcccatcggtcttccccctggccgccctgctccaggancacctccgagagcacagcggccctgggctgcctggtcaaggactacttccacgtagcgtgctgagcgggctggcaaggcgcatagnnnnnnnnnnnnnnnnnnnnnnn

SEQ ID NO: 117266 - DNA, 308 bp, Homo sapiens; identical to SEQ ID NO: 117129
  misc_feature: GYAE6OF01EFQ4W.29.30.C08.1.454.CMB.1.raw
  modified_base (305)..(308): a, c, t, g, unknown or other
  misc_feature (305)..(308): n is a, c, g, or t

SEQ ID NO: 117267 - DNA, 310 bp, Homo sapiens; identical to SEQ ID NO: 117127
  misc_feature: GYAE6OF01EJ5XM.29.30.C08.1.454.CMB.1.raw
  modified_base (305)..(310): a, c, t, g, unknown or other
  misc_feature (305)..(310): n is a, c, g, or t

SEQ ID NO: 117268 - DNA, 316 bp, Homo sapiens
  misc_feature: GYAE6OF01BEEE0.29.30.C08.1.454.CMB.1.raw
  modified_base (307)..(316): a, c, t, g, unknown or other
  misc_feature (307)..(316): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaagggcgcatagnnnnnnnnnn

SEQ ID NO: 117269 - DNA, 319 bp, Homo sapiens
  misc_feature: GYAE6OF01CWBX3.29.30.C08.1.454.CMB.1.raw
  modified_base (224)..(224): a, c, t, g, unknown or other
  misc_feature (224)..(224): n is a, c, g, or t
  modified_base (280)..(280): a, c, t, g, unknown or other
  misc_feature (280)..(280): n is a, c, g, or t
  modified_base (311)..(319): a, c, t, g, unknown or other
  misc_feature (311)..(319): n is a, c, g, or t
tcagatagagtactcacgaccggtgctcgatttagtctgacgtcaaagggaaagggggctggagtgggtggccaacataaaccaagatggaagtgaacagtactatgtgggactctgtgaagggccgattcaccatctccagagacaacgccaagaactcactgtctcctcagcctccaccaagggcccatcggtccttccccctggccgccctgctccaggancacctcgagagcacagccggccctgggctggcctggtcaaggactacttcacgtancgtgctgagcgggctggcaaggcgcaatagnnnnnnnnn

SEQ ID NO: 117270 - DNA, 311 bp, Homo sapiens
  misc_feature: GYAE6OF01B9Y2E.29.30.C08.1.454.CMB.1.raw
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctggcaaggcgcatagnnnnnn

SEQ ID NO: 117271 - DNA, 305 bp, Homo sapiens
  misc_feature: GYAE6OF01DJ5RL.29.30.C08.1.454.CMB.1.raw
  modified_base (303)..(305): a, c, t, g, unknown or other
  misc_feature (303)..(305): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactactccacgtagcgtgctgagcgggctggcaaggcgcatagnnn

SEQ ID NO: 117272 - DNA, 309 bp, Homo sapiens
  misc_feature: GYAE6OF01CQ7ET.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttcacgtagcgtgctgagcgggctggcaaggcgcatagnnnnnn

SEQ ID NO: 117273 - DNA, 308 bp, Homo sapiens
  misc_feature: GYAE6OF01CGOJH.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaggcgcatagnnnnn

SEQ ID NO: 117274 - DNA, 310 bp, Homo sapiens
  misc_feature: GYAE6OF01B41MW.29.30.C08.1.454.CMB.1.raw
  modified_base (304)..(310): a, c, t, g, unknown or other
  misc_feature (304)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnn

SEQ ID NO: 117275 - DNA, 309 bp, Homo sapiens
  misc_feature: GYAE6OF01CQG3N.29.30.C08.1.454.CMB.1.raw
  modified_base (289)..(289): a, c, t, g, unknown or other
  misc_feature (289)..(289): n is a, c, g, or t
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggntggcaaggcgcatagnnnnn

SEQ ID NO: 117276 - DNA, 307 bp, Homo sapiens
  misc_feature: GYAE6OF01CUV0M.29.30.C08.1.454.CMB.1.raw
  modified_base (305)..(307): a, c, t, g, unknown or other
  misc_feature (305)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcatagnnn

SEQ ID NO: 117277 - DNA, 307 bp, Homo sapiens
  misc_feature: GYAE6OF01DLBC1.29.30.C08.1.454.CMB.1.raw
  modified_base (288)..(288): a, c, t, g, unknown or other
  misc_feature (288)..(288): n is a, c, g, or t
  modified_base (304)..(307): a, c, t, g, unknown or other
  misc_feature (304)..(307): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggntggcaaggcgcatagnnnn

SEQ ID NO: 117278 - DNA, 325 bp, Homo sapiens
  misc_feature: GYAE6OF01D43BR.29.30.C08.1.454.CMB.1.raw
  modified_base (310)..(310): a, c, t, g, unknown or other
  misc_feature (310)..(310): n is a, c, g, or t
  modified_base (317)..(325): a, c, t, g, unknown or other
  misc_feature (317)..(325): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtccttccccctggccgccctgcctccgaggacgccacctccgagagcacagccggccctgggctgcctggtcaaggactacttccagtagcgtgctggacgcgggctggcaagggcnctatagnnnnnnnnn

SEQ ID NO: 117279 - DNA, 308 bp, Homo sapiens; identical to SEQ ID NO: 117129
  misc_feature: GYAE6OF01ER1N9.29.30.C08.1.454.CMB.1.raw
  modified_base (305)..(308): a, c, t, g, unknown or other
  misc_feature (305)..(308): n is a, c, g, or t

SEQ ID NO: 117280 - DNA, 308 bp, Homo sapiens; identical to SEQ ID NO: 117129
  misc_feature: GYAE6OF01E078A.29.30.C08.1.454.CMB.1.raw
  modified_base (305)..(308): a, c, t, g, unknown or other
  misc_feature (305)..(308): n is a, c, g, or t

SEQ ID NO: 117281 - DNA, 318 bp, Homo sapiens
  misc_feature: GYAE6OF01CBOLS.29.30.C08.1.454.CMB.1.raw
  modified_base (313)..(318): a, c, t, g, unknown or other
  misc_feature (313)..(318): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatccggtccttccccctggccgccctgctccaggagcacctccgagagcacagccggccctgggctgccgtggtcaaggacctacgttccacgtagcgtgctgacgcgggctgggcaaggcgcatgnnnnnn

SEQ ID NO: 117282 - DNA, 308 bp, Homo sapiens
  misc_feature: GYAE6OF01CWH2M.29.30.C08.1.454.CMB.1.raw
  modified_base (302)..(308): a, c, t, g, unknown or other
  misc_feature (302)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttcccctggcgccctgctccaggagcacctcgagagcacagcggcctgggctgcctggtcaaaggctacttccacgtagcgtgctgagcgggctggcaaggcgcatagnnnnnnn

SEQ ID NO: 117283 - DNA, 310 bp, Homo sapiens; identical to SEQ ID NO: 117274
  misc_feature: GYAE6OF01A1IVW.29.30.C08.1.454.CMB.1.raw
  modified_base (304)..(310): a, c, t, g, unknown or other
  misc_feature (304)..(310): n is a, c, g, or t

SEQ ID NO: 117284 - DNA, 308 bp, Homo sapiens
  misc_feature: GYAE6OF01BJK9C.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcatagnnnnn

SEQ ID NO: 117285 - DNA, 330 bp, Homo sapiens
  misc_feature: GYAE6OF01E4RXQ.29.30.C08.1.454.CMB.1.raw
  modified_base (309)..(311): a, c, t, g, unknown or other
  misc_feature (309)..(311): n is a, c, g, or t
  modified_base (313)..(330): a, c, t, g, unknown or other
  misc_feature (313)..(330): n is a, c, g, or t
tcagatagagtactcacgaccggtgctcgatttagtctgacgtcaaaggggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcaccgtccgagagcacagcggccctgggctgcctggtcaaggactacttccacgtagcgtgctggagcgggctggcaagggcgcatagnnnannnnnnnnnnnnnnnnnn

SEQ ID NO: 117286 - DNA, 309 bp, Homo sapiens
  misc_feature: GYAE6OF01BQ40I.29.30.C08.1.454.CMB.1.raw
  modified_base (221)..(221): a, c, t, g, unknown or other
  misc_feature (221)..(221): n is a, c, g, or t
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggancacctcgagagcacagccggccctgggctgcctggtcaaggactacttccagtagcgtgctgagcggctggcaaggcgcatagnnnnn

SEQ ID NO: 117287 - DNA, 308 bp, Homo sapiens
  misc_feature: GYAE6OF01CJJOL.29.30.C08.1.454.CMB.1.raw
  modified_base (305)..(308): a, c, t, g, unknown or other
  misc_feature (305)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnn

SEQ ID NO: 117288 - DNA, 308 bp, Homo sapiens
  misc_feature: GYAE6OF01EI3IO.29.30.C08.1.454.CMB.1.raw
  modified_base (306)..(308): a, c, t, g, unknown or other
  misc_feature (306)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnn

SEQ ID NO: 117289 - DNA, 309 bp, Homo sapiens
  misc_feature: GYAE6OF01B8H89.29.30.C08.1.454.CMB.1.raw
  modified_base (306)..(309): a, c, t, g, unknown or other
  misc_feature (306)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggactacttccacgtagcgtgctgagcgggctggcaaggcgcatagnnnn

SEQ ID NO: 117290 - DNA, 311 bp, Homo sapiens
  misc_feature: GYAE6OF01DAN7Y.29.30.C08.1.454.CMB.1.raw
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctctgggggcacagcggccctgggctgcctggtcaaggactacttccacgtagcgtgctgagcgggctggcaaggcgcatagnnnnnn

SEQ ID NO: 117291 - DNA, 351 bp, Homo sapiens
  misc_feature: GYAE6OF01CN25T.29.30.C08.1.454.CMB.1.raw
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
  modified_base (324)..(351): a, c, t, g, unknown or other
  misc_feature (324)..(351): n is a, c, g, or t
tcagatagagtactcacgaccggtgctcgatttagtctgacgtcaaagggtaaagggggcgtggtagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgcctcaggancacctccgagngcanacgccggccctgggacttgcctggtacaaagggtcctacttccgacgtagccgtgctggagcgggctgggcaagggcncaatgnnnnnnnnnnnnnnnnnnnnnnnnnnnn

SEQ ID NO: 117292 - DNA, 313 bp, Homo sapiens
  misc_feature: GYAE6OF01EFQ8X.29.30.C08.1.454.CMB.1.raw
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaagggcgcatagnnnnnnnn

SEQ ID NO: 117293 - DNA, 332 bp, Homo sapiens
  misc_feature: GYAE6OF01B3GZB.29.30.C08.1.454.CMB.1.raw
  modified_base (274)..(274): a, c, t, g, unknown or other
  misc_feature (274)..(274): n is a, c, g, or t
  modified_base (308)..(332): a, c, t, g, unknown or other
  misc_feature (308)..(332): n is a, c, g, or t
tcagatagagtactcacgaccggtgctcgatttagtctgacgtcaaagggaaaggggcgtggagtgggtggccaacataaaccaagagtggaagtgaacagtactatgtggactctgtgaagggccgattcaccatctccgagagacaacgccaagaactcactgtctcctcagcctccaccaagggcccatcggtcttcccctggcgccctgctccaggagcacctccgagagcacagcggccctgggctgcctggtcaggctactccagtancgtgctgagcgggactcggcaaggcgcaattagnnnnnnnnnnnnnnnnnnnnnnnnn

SEQ ID NO: 117294 - DNA, 309 bp, Homo sapiens
  misc_feature: GYAE6OF01EL81Y.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactactccacgtagcgtgctgagcgggctggcaagggcgcatagnnnnn

SEQ ID NO: 117295 - DNA, 312 bp, Homo sapiens
  misc_feature: GYAE6OF01BSOYZ.29.30.C08.1.454.CMB.1.raw
  modified_base (219)..(219): a, c, t, g, unknown or other
  misc_feature (219)..(219): n is a, c, g, or t
  modified_base (304)..(312): a, c, t, g, unknown or other
  misc_feature (304)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagcggccctgggctgcctggtcaaggctacttccacgtagcgtgctgagcgggctggcaaggcgcatagnnnnnnnnn

SEQ ID NO: 117296 - DNA, 307 bp, Homo sapiens; identical to SEQ ID NO: 117233
  misc_feature: GYAE6OF01AUVXR.29.30.C08.1.454.CMB.1.raw
  modified_base (304)..(307): a, c, t, g, unknown or other
  misc_feature (304)..(307): n is a, c, g, or t

SEQ ID NO: 117297 - DNA, 307 bp, Homo sapiens
  misc_feature: GYAE6OF01BAPGZ.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctcgagagcacagcggccctgggctgcctggtcaaggactacttccacgtagctgctgagcgggctggcaaggcgcatagnnnn

SEQ ID NO: 117298 - DNA, 309 bp, Homo sapiens
  misc_feature: GYAE6OF01CB9JG.29.30.C08.1.454.CMB.1.raw
  modified_base (219)..(219): a, c, t, g, unknown or other
  misc_feature (219)..(219): n is a, c, g, or t
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttccccctggcgccctgctccaggancacctccgagagcacagcggccctgggctgcctggtcaaggactacttccacgtagcgtgctgagcgggctggcaaggcgcatagnnnnn

SEQ ID NO: 117299 - DNA, 312 bp, Homo sapiens
  misc_feature: GYAE6OF01BQC6J.29.30.C08.1.454.CMB.1.raw
  modified_base (306)..(312): a, c, t, g, unknown or other
  misc_feature (306)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtctcccctggcgccctgctccaggacgcacctccgagacgcacagcggccctgggctgcctggtcaaggactacttccacgtagcgtgctgagcgggctggcaaggcgcatagnnnnnnn

SEQ ID NO: 117300 - DNA, 317 bp, Homo sapiens
  misc_feature: GYAE6OF01CRGN5.29.30.C08.1.454.CMB.1.raw
  modified_base (304)..(317): a, c, t, g, unknown or other
  misc_feature (304)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttcacgtagcgtgctgagcgggctggcaaggcgcatagnnnnnnnnnnnnnn

SEQ ID NO: 117301 - DNA, 312 bp, Homo sapiens
  misc_feature: GYAE6OF01CBJFC.29.30.C08.1.454.CMB.1.raw
  modified_base (306)..(312): a, c, t, g, unknown or other
  misc_feature (306)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnnnn

SEQ ID NO: 117302 - DNA, 312 bp, Homo sapiens
  misc_feature: GYAE6OF01DICK5.29.30.C08.1.454.CMB.1.raw
  modified_base (235)..(235): a, c, t, g, unknown or other
  misc_feature (235)..(235): n is a, c, g, or t
  modified_base (305)..(312): a, c, t, g, unknown or other
  misc_feature (305)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacngccggccctgggctgcctggtcaacggctactccagtagcgtgctgagcgggctggcaagggcgcatagnnnnnnnn

SEQ ID NO: 117303 - DNA, 217 bp, Homo sapiens
  misc_feature: GYAE6OF01DOCK2.29.30.C08.1.454.CMB.1.raw
  modified_base (213)..(217): a, c, t, g, unknown or other
  misc_feature (213)..(217): n is a, c, g, or t
tcagatagagtactcacgaccggtgctcgatttagtctgacgtcaaagggaaagggaccacggtcatcgtgtcctcagcctccaccaagggcccatcggtcctccccctggcaccctcctccaagagcacctctgggggcacagcggccctgggctgcctggtcaaggactacttccagacgacgctctgagcgggctggcaaggcgcatagnnnnn

SEQ ID NO: 117304 - DNA, 313 bp, Homo sapiens
  misc_feature: GYAE6OF01CZM23.29.30.C08.1.454.CMB.1.raw
  modified_base (276)..(276): a, c, t, g, unknown or other
  misc_feature (276)..(276): n is a, c, g, or t
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggagcacctccgagagcacagcggccctgggctgcctggtcaaggctacttccacgtancgtgctgagcgggctggcaaggcgcatagnnnnnnnn

SEQ ID NO: 117305 - DNA, 307 bp, Homo sapiens; identical to SEQ ID NO: 117162
  misc_feature: GYAE6OF01CPIW9.29.30.C08.1.454.CMB.1.raw
  modified_base (305)..(307): a, c, t, g, unknown or other
  misc_feature (305)..(307): n is a, c, g, or t

SEQ ID NO: 117306 - DNA, 310 bp, Homo sapiens
  misc_feature: GYAE6OF01BSHFD.29.30.C08.1.454.CMB.1.raw
  modified_base (306)..(310): a, c, t, g, unknown or other
  misc_feature (306)..(310): n is a, c, g, or t
tcagatagagtactcacgaccggtgctcgatttagtctgacgtcaaagggaaaggggctggagtgggtggccaacataaaccaagatggaagtgaacggtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnn

SEQ ID NO: 117307 - DNA, 313 bp, Homo sapiens
  misc_feature: GYAE6OF01AEQJ8.29.30.C08.1.454.CMB.1.raw
  modified_base (219)..(219): a, c, t, g, unknown or other
  misc_feature (219)..(219): n is a, c, g, or t
  modified_base (302)..(313): a, c, t, g, unknown or other
  misc_feature (302)..(313): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggngcacctccgagagcacagcggccctgggctgcctggtcaaggctacttccacgtagcgtgctgagcggctggcaggcgcatgnnnnnnnnnnnn

SEQ ID NO: 117308 - DNA, 308 bp, Homo sapiens; identical to SEQ ID NO: 117092
  misc_feature: GYAE6OF01AG7D6.29.30.C08.1.454.CMB.1.raw
  modified_base (304)..(308): a, c, t, g, unknown or other
  misc_feature (304)..(308): n is a, c, g, or t

SEQ ID NO: 117309 - DNA, 312 bp, Homo sapiens
  misc_feature: GYAE6OF01EM5IB.29.30.C08.1.454.CMB.1.raw
  modified_base (307)..(312): a, c, t, g, unknown or other
  misc_feature (307)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcataggnnnnnn

SEQ ID NO: 117310 - DNA, 310 bp, Homo sapiens; identical to SEQ ID NO: 117127
  misc_feature: GYAE6OF01BPRS5.29.30.C08.1.454.CMB.1.raw
  modified_base (305)..(310): a, c, t, g, unknown or other
  misc_feature (305)..(310): n is a, c, g, or t

SEQ ID NO: 117311 - DNA, 307 bp, Homo sapiens
  misc_feature: GYAE6OF01DLOLV.29.30.C08.1.454.CMB.1.raw
  modified_base (303)..(307): a, c, t, g, unknown or other
  misc_feature (303)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggctacttccacgtagcgtgctgagcgggctggcaaggcgcatagnnnnn

SEQ ID NO: 117312 - DNA, 311 bp, Homo sapiens; identical to SEQ ID NO: 117190
  misc_feature: GYAE6OF01B1ZD8.29.30.C08.1.454.CMB.1.raw
  modified_base (306)..(311): a, c, t, g, unknown or other
  misc_feature (306)..(311): n is a, c, g, or t

SEQ ID NO: 117313 - DNA, 318 bp, Homo sapiens
  misc_feature: GYAE6OF01AVG9T.29.30.C08.1.454.CMB.1.raw
  modified_base (307)..(307): a, c, t, g, unknown or other
  misc_feature (307)..(307): n is a, c, g, or t
  modified_base (314)..(318): a, c, t, g, unknown or other
  misc_feature (314)..(318): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggagcacctccgagagcacagccggccctgggctcgcctggtcaaggcctacttcccacgtagcgtgctgacggcgggctggcaagggcncataggnnnnn

SEQ ID NO: 117314 - DNA, 307 bp, Homo sapiens; identical to SEQ ID NO: 117094
  misc_feature: GYAE6OF01DT5JR.29.30.C08.1.454.CMB.1.raw
  modified_base (304)..(307): a, c, t, g, unknown or other
  misc_feature (304)..(307): n is a, c, g, or t

SEQ ID NO: 117315 - DNA, 308 bp, Homo sapiens; identical to SEQ ID NO: 117129
  misc_feature: GYAE6OF01BAVXS.29.30.C08.1.454.CMB.1.raw
  modified_base (305)..(308): a, c, t, g, unknown or other
  misc_feature (305)..(308): n is a, c, g, or t

SEQ ID NO: 117316 - DNA, 308 bp, Homo sapiens
  misc_feature: GYAE6OF01EV3C7.29.30.C08.1.454.CMB.1.raw
  modified_base (219)..(219): a, c, t, g, unknown or other
  misc_feature (219)..(219): n is a, c, g, or t
  modified_base (299)..(299): a, c, t, g, unknown or other
  misc_feature (299)..(299): n is a, c, g, or t
  modified_base (305)..(308): a, c, t, g, unknown or other
  misc_feature (305)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagccggccctgggctgcctggtcaaggactacttccacgtagcgtgctgagcggctggcaaggcncatagnnnn

SEQ ID NO: 117317 - DNA, 329 bp, Homo sapiens
  misc_feature: GYAE6OF01AINJY.29.30.C08.1.454.CMB.1.raw
  modified_base (234)..(234): a, c, t, g, unknown or other
  misc_feature (234)..(234): n is a, c, g, or t
  modified_base (312)..(329): a, c, t, g, unknown or other
  misc_feature (312)..(329): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtcttccccctggccgccctgctccaggacgccacctcgagngcacagccggcccgtgggctgacctggtcaaggctacgttccactagcgtgctgacgcgggctggcaaggcgcatagnnnnnnnnnnnnnnnnnn

SEQ ID NO: 117318 - DNA, 310 bp, Homo sapiens
  misc_feature: GYAE6OF01BGTC8.29.30.C08.1.454.CMB.1.raw
  modified_base (218)..(218): a, c, t, g, unknown or other
  misc_feature (218)..(218): n is a, c, g, or t
  modified_base (304)..(310): a, c, t, g, unknown or other
  misc_feature (304)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggctccctgctccaggancacctccgagagcacagcggccctgggctgcctggtcaaggactacttccacgtagcgtgctgagcgggctggcaaggcgcatagnnnnnnn

SEQ ID NO: 117319 - DNA, 313 bp, Homo sapiens
  misc_feature: GYAE6OF01C3DMC.29.30.C08.1.454.CMB.1.raw
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagccggccctgggctgcctggtcaaggctacttccacgtagcgtgctgagcgggctggcaaggcgcatagnnnnnnnn

SEQ ID NO: 117320 - DNA, 310 bp, Homo sapiens
  misc_feature: GYAE6OF01E1NXE.29.30.C08.1.454.CMB.1.raw
  modified_base (310)..(310): a, c, t, g, unknown or other
  misc_feature (310)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctcaccaagggcccatcggtccttcccctggccgccctgctccgaggagccacctccgagacgcacgagcggccctgggctgcctggtcaaggactacttccacgtagccgtgctgagcgggctggcaaggcgcatagn

SEQ ID NO: 117321 - DNA, 313 bp, Homo sapiens
  misc_feature: GYAE6OF01BL0WC.29.30.C08.1.454.CMB.1.raw
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctggcaaggcgcatagnnnnnnnn

SEQ ID NO: 117322 - DNA, 308 bp, Homo sapiens; identical to SEQ ID NO: 117129
  misc_feature: GYAE6OF01BVMK4.29.30.C08.1.454.CMB.1.raw
  modified_base (305)..(308): a, c, t, g, unknown or other
  misc_feature (305)..(308): n is a, c, g, or t

SEQ ID NO: 117323 - DNA, 308 bp, Homo sapiens
  misc_feature: GYAE6OF01BXYZW.29.30.C08.1.454.CMB.1.raw
  modified_base (305)..(308): a, c, t, g, unknown or other
  misc_feature (305)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcggctggcaaggcgcatagnnnn

SEQ ID NO: 117324 - DNA, 312 bp, Homo sapiens
  misc_feature: GYAE6OF01CXQZR.29.30.C08.1.454.CMB.1.raw
  modified_base (304)..(312): a, c, t, g, unknown or other
  misc_feature (304)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcgggctggcaaggcgcatagnnnnnnnnn

SEQ ID NO: 117325 - DNA, 307 bp, Homo sapiens; identical to SEQ ID NO: 117110
  misc_feature: GYAE6OF01BXFWE.29.30.C08.1.454.CMB.1.raw
  modified_base (305)..(307): a, c, t, g, unknown or other
  misc_feature (305)..(307): n is a, c, g, or t

SEQ ID NO: 117326 - DNA, 323 bp, Homo sapiens
  misc_feature: GYAE6OF01BQI28.29.30.C08.1.454.CMB.1.raw
  modified_base (306)..(323): a, c, t, g, unknown or other
  misc_feature (306)..(323): n is a, c, g, or t
tcagatagagtactcacgaccggtgctcgatttagtctgacgtcaaagggaaaggggctggagtgggtggccaacataaaccaagatggaagtgaacgagtactatgtggactctgtgaagggccgattcaccatctccagagataacgccaagaactcactgtctcctcagcctccacctaagggcccatcggtcttccccctggcgccctgctccaggagcacctcgagagcacagcggccctgggctgcctggtacaaggctattccacgtagcgtgctgagcgggatggcaaggcgcatagnnnnnnnnnnnnnnnnnn

SEQ ID NO: 117327 - DNA, 313 bp, Homo sapiens
  misc_feature: GYAE6OF01DF96Q.29.30.C08.1.454.CMB.1.raw
  modified_base (307)..(313): a, c, t, g, unknown or other
  misc_feature (307)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttccccctggccgccctgctccgaggagcacctccgagagcacagccggccctgggctgcctggtcaaggctacttccacgtagcgtgctgagcgggctggcaaggcgcatagnnnnnnn

SEQ ID NO: 117328 - DNA, 310 bp, Homo sapiens
  misc_feature: GYAE6OF01C641G.29.30.C08.1.454.CMB.1.raw
  modified_base (300)..(300): a, c, t, g, unknown or other
  misc_feature (300)..(300): n is a, c, g, or t
  modified_base (305)..(310): a, c, t, g, unknown or other
  misc_feature (305)..(310): n is a, c, g, or t
tcagatagagtactcacgaccggtgctcgattagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggccgccctgctccaggacgcacctcgagagcacagccggccctgggctgcctggtcaaggactacttcacgtagcgtgctgagcgggctggcaaggcncatgnnnnnn

SEQ ID NO: 117329 - DNA, 313 bp, Homo sapiens
  misc_feature: GYAE6OF01EHON0.29.30.C08.1.454.CMB.1.raw
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (302)..(313): a, c, t, g, unknown or other
  misc_feature (302)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctgcgccctgctccaggagcacctccgagagcacagcggccctgggctgcctgtcaaggactacttccacgtancgtgctgagcgggctggcaaggcncatagnnnnnnnnnnnn

SEQ ID NO: 117330 - DNA, 348 bp, Homo sapiens
  misc_feature: GYAE6OF01CGO0E.29.30.C08.1.454.CMB.1.raw
  modified_base (340)..(348): a, c, t, g, unknown or other
  misc_feature (340)..(348): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtccttccccctggccgccctgcctccaggacgccaccctccgagagccaacgaggccggcccgtgggcctggcccgtgggtaccaaaggaccttaccttccgacggtagcgtgctggacggcggggctggacgaaggccgacatagnnnnnnnnn

SEQ ID NO: 117331 - DNA, 317 bp, Homo sapiens
  misc_feature: GYAE6OF01BGBCT.29.30.C08.1.454.CMB.1.raw
  modified_base (307)..(317): a, c, t, g, unknown or other
  misc_feature (307)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccgaggagcacctccgagagcacagcggccctgggctgcctggtcaaggactacttccacgtagcgtgcctgagcgggctggcaaggcgcatagnnnnnnnnnnn

SEQ ID NO: 117332 - DNA, 335 bp, Homo sapiens
  misc_feature: GYAE6OF01BAESY.29.30.C08.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (311)..(312): a, c, t, g, unknown or other
  misc_feature (311)..(312): n is a, c, g, or t
  modified_base (314)..(335): a, c, t, g, unknown or other
  misc_feature (314)..(335): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgtattcaccatctccagagacaacgccaagaactcactgtctcctcagccgtccaccaagggcccatccggtccgttccccctggccgccctgcctccagganccacctccgagagcacagcggccctgggctgcctggcaaggctactccagtgcgtgctgagcgggctggcaaggtcncatagnngnnnnnnnnnnnnnnnnnnnnnn

SEQ ID NO: 117333 - DNA, 310 bp, Homo sapiens; identical to SEQ ID NO: 117133
  misc_feature: GYAE6OF01EGMY0.29.30.C08.1.454.CMB.1.raw
  modified_base (304)..(310): a, c, t, g, unknown or other
  misc_feature (304)..(310): n is a, c, g, or t

SEQ ID NO: 117334 - DNA, 323 bp, Homo sapiens
  misc_feature: GYAE6OF01BZGGA.29.30.C08.1.454.CMB.1.raw
  modified_base (314)..(323): a, c, t, g, unknown or other
  misc_feature (314)..(323): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaatgccaagaactcactgtctcctcagcctccaccaagggcccatcggtccttcccccgtggccgccctgcctccgaggagccacctccgagacgcacgagccggccgtggctgcctggtcaaggctacttccacgtagcgtgctgagcgggtctggcaaggcacatagnnnnnnnnnn

SEQ ID NO: 117335 - DNA, 305 bp, Homo sapiens
  misc_feature: GYAE6OF01C2NNY.29.30.C08.1.454.CMB.1.raw
  modified_base (302)..(305): a, c, t, g, unknown or other
  misc_feature (302)..(305): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccagtagcgtgctgagcgggctggcaaggcgcatgnnnn

SEQ ID NO: 117336 - DNA, 309 bp, Homo sapiens
  misc_feature: GYAE6OF01DW2GS.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatagnnnnnn

SEQ ID NO: 117337 - DNA, 306 bp, Homo sapiens
  misc_feature: GYAE6OF01CPWII.29.30.C08.1.454.CMB.1.raw
  modified_base (200)..(200): a, c, t, g, unknown or other
  misc_feature (200)..(200): n is a, c, g, or t
  modified_base (302)..(306): a, c, t, g, unknown or other
  misc_feature (302)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttccccnggcgccctgctccaggagcacctcgagagcacagcggcctgggctgcctggtcaaggctaacttccacgtagcgtgctgagcgggctggcaaggcgcatagnnnnn

SEQ ID NO: 117338 - DNA, 309 bp, Homo sapiens
  misc_feature: GYAE6OF01EY059.29.30.C08.1.454.CMB.1.raw
  modified_base (306)..(309): a, c, t, g, unknown or other
  misc_feature (306)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctggagcgggctggcaaggcgcatagnnnn

SEQ ID NO: 117339 - DNA, 308 bp, Homo sapiens
  misc_feature: GYAE6OF01A7PSO.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggctacttccagtagcgtgctgagcgggctggcaaggcgcatagnnnnn

SEQ ID NO: 117340 - DNA, 311 bp, Homo sapiens
  misc_feature: GYAE6OF01CWWTY.29.30.C08.1.454.CMB.1.raw
  modified_base (217)..(217): a, c, t, g, unknown or other
  misc_feature (217)..(217): n is a, c, g, or t
  modified_base (286)..(286): a, c, t, g, unknown or other
  misc_feature (286)..(286): n is a, c, g, or t
  modified_base (302)..(311): a, c, t, g, unknown or other
  misc_feature (302)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaggcccatcggtcttcccctggcgccctgctccaggancacctccgagagcacagcggccctgggctgcctggtcaaggctacttccacgtagcgtgctgagcgggntggcaaggcgcatagnnnnnnnnnn

SEQ ID NO: 117341 - DNA, 326 bp, Homo sapiens
  misc_feature: GYAE6OF01C6UJB.29.30.C08.1.454.CMB.1.raw
  modified_base (311)..(326): a, c, t, g, unknown or other
  misc_feature (311)..(326): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtcctcctcagcctccaccaaggcccatcggtccttccccctggccgccctgctccaggagccacctcgagagcacagccggcctgggctgcctggtcaaggctacttccacgtagcgtgctgacgcgggctggcaaggccgcaagtagnnnnnnnnnnnnnnnn

SEQ ID NO: 117342 - DNA, 364 bp, Homo sapiens
  misc_feature: GYAE6OF01EGOFC.29.30.C08.1.454.CMB.1.raw
  modified_base (335)..(364): a, c, t, g, unknown or other
  misc_feature (335)..(364): n is a, c, g, or t
tcagatagagtactcacgaccggtgctcgatttagtctgacgtcaaaggggaaaggggctgggagtgggtggccaacaataaaaccaagatggaagtgaacagtactatgtggactctgtgaagggccgattcaccatctccagagacaacgccaagaactcactgtctcctcacgcctccaccaagggcccatccggtccttccccctggccgccctgcctaccgaggagccacctccgagacgcacagcggcccgtgggctcgcctggcaaaggcttaccttcacggttagccgttgctggacggcggggctgggacaaggggctacaatggnnnnnnnnnnnnnnnnnnnnnnnnnnnnnn

SEQ ID NO: 117343 - DNA, 314 bp, Homo sapiens
  misc_feature: GYAE6OF01DU8PN.29.30.C08.1.454.CMB.1.raw
  modified_base (308)..(314): a, c, t, g, unknown or other
  misc_feature (308)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctggagcgggctggcaagggcgcagtagnnnnnnn

SEQ ID NO: 117344 - DNA, 308 bp, Homo sapiens
  misc_feature: GYAE6OF01BDRV6.29.30.C08.1.454.CMB.1.raw
  modified_base (221)..(221): a, c, t, g, unknown or other
  misc_feature (221)..(221): n is a, c, g, or t
  modified_base (306)..(308): a, c, t, g, unknown or other
  misc_feature (306)..(308): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggacncacctccgagagcacagcggccctgggctgcctggcaaggactacttccacgtagcgtgctgagcgggctggcaaggcgcatagnnn

SEQ ID NO: 117345 - DNA, 313 bp, Homo sapiens
  misc_feature: GYAE6OF01CVXEE.29.30.C08.1.454.CMB.1.raw
  modified_base (273)..(273): a, c, t, g, unknown or other
  misc_feature (273)..(273): n is a, c, g, or t
  modified_base (304)..(313): a, c, t, g, unknown or other
  misc_feature (304)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggcctgggctgcctggtcaaggctactccacgtancgtgctgagcgggctggcaagggcgcatagnnnnnnnnnn

SEQ ID NO: 117346 - DNA, 333 bp, Homo sapiens
  misc_feature: GYAE6OF01B1OSO.29.30.C08.1.454.CMB.1.raw
  modified_base (221)..(221): a, c, t, g, unknown or other
  misc_feature (221)..(221): n is a, c, g, or t
  modified_base (323)..(333): a, c, t, g, unknown or other
  misc_feature (323)..(333): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtccttccccctggccgccctgctccaggancacctccgagagcacagcggccctgggctgcctggtcaagtcgacttacctccgacgtacgcgtgcgtggacggcgggtctgggacgaacggcgacaagtgnnnnnnnnnnn

SEQ ID NO: 117347 - DNA, 307 bp, Homo sapiens
  misc_feature: GYAE6OF01CST6Z.29.30.C08.1.454.CMB.1.raw
  modified_base (302)..(307): a, c, t, g, unknown or other
  misc_feature (302)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggccgccctgctccaggagcacctccgagagcacagcgcctggctgcctggtcaaggactactccacgtagcgtgctgagcgggctggcaaggcgcatgnnnnnn

SEQ ID NO: 117348 - DNA, 307 bp, Homo sapiens; identical to SEQ ID NO: 117233
  misc_feature: GYAE6OF01BA32S.29.30.C08.1.454.CMB.1.raw
  modified_base (304)..(307): a, c, t, g, unknown or other
  misc_feature (304)..(307): n is a, c, g, or t

SEQ ID NO: 117349 - DNA, 315 bp, Homo sapiens
  misc_feature: GYAE6OF01DCYA5.29.30.C08.1.454.CMB.1.raw
  modified_base (308)..(315): a, c, t, g, unknown or other
  misc_feature (308)..(315): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctggagcgggctggcaagggcgcatagnnnnnnnn

SEQ ID NO: 117350 - DNA, 338 bp, Homo sapiens
  misc_feature: GYAE6OF01DY3AO.29.30.C08.1.454.CMB.1.raw
  modified_base (169)..(169): a, c, t, g, unknown or other
  misc_feature (169)..(169): n is a, c, g, or t
  modified_base (214)..(214): a, c, t, g, unknown or other
  misc_feature (214)..(214): n is a, c, g, or t
  modified_base (296)..(296): a, c, t, g, unknown or other
  misc_feature (296)..(296): n is a, c, g, or t
  modified_base (303)..(307): a, c, t, g, unknown or other
  misc_feature (303)..(307): n is a, c, g, or t
  modified_base (309)..(338): a, c, t, g, unknown or other
  misc_feature (309)..(338): n is a, c, g, or t
tcagatagagtactcacgaccggtgctcgatttagtctgacgtcaaagggaaaggggctggaggtgggtggccaacataaaccaagatggaagtgaacagtactatgtggactctgtgaagggccgattcaccatctccagagacaacgccaagaactcactgtctctnagcctcacaaggcccatcggtcttccctggcgccctgctcaggancaccgtcgagagcacagtcggccctgggctgccttggtcaaggctacttccacgttagcgtgctgagcgggctggcaaggcnagtagcnnnnngnnnnnnnnnnnnnnnnnnnnnnnnnnnnnn

SEQ ID NO: 117351 - DNA, 315 bp, Homo sapiens
  misc_feature: GYAE6OF01B8R8G.29.30.C08.1.454.CMB.1.raw
  modified_base (308)..(315): a, c, t, g, unknown or other
  misc_feature (308)..(315): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggcgccctgctccaggagcacctccgagagcacggcggccctgggctgcctggtcaaggactacttccacgtgcgtgctgaggcgggctgggcaaggcgcatagnnnnnnnn

SEQ ID NO: 117352 - DNA, 350 bp, Homo sapiens
  misc_feature: GYAE6OF01BFB2I.29.30.C08.1.454.CMB.1.raw
  modified_base (313)..(350): a, c, t, g, unknown or other
  misc_feature (313)..(350): n is a, c, g, or t
tcagatagagtactcacgaccggtgctcgattttagtctgacgtcaaaggggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgcctccaggagcacctccgaagacgcacagcggccctgggctgcctggacaaggactacttccagtagcgtgctgagcgggctggacaagggcgcatacgnnnnnnnnnnnnnnnnnnnnnnnnnnnnnnnnnnnnnn

SEQ ID NO: 117353 - DNA, 309 bp, Homo sapiens
  misc_feature: GYAE6OF01CGA6U.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaggcgcatagnnnnnn

SEQ ID NO: 117354 - DNA, 309 bp, Homo sapiens
  misc_feature: GYAE6OF01AYUWU.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcggctggcaagggcgcatagnnnnn

SEQ ID NO: 117355 - DNA, 308 bp, Homo sapiens
  misc_feature: GYAE6OF01BCEPM.29.30.C08.1.454.CMB.1.raw
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (305)..(308): a, c, t, g, unknown or other
  misc_feature (305)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggntggcaaggcncatagnnnn

SEQ ID NO: 117356 - DNA, 311 bp, Homo sapiens
  misc_feature: GYAE6OF01EFEK7.29.30.C08.1.454.CMB.1.raw
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcagtagnnnnnn

SEQ ID NO: 117357 - DNA, 315 bp, Homo sapiens
  misc_feature: GYAE6OF01C3NWR.29.30.C08.1.454.CMB.1.raw
  modified_base (307)..(315): a, c, t, g, unknown or other
  misc_feature (307)..(315): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctgggcaaggcgcagtagnnnnnnnnn

SEQ ID NO: 117358 - DNA, 331 bp, Homo sapiens
  misc_feature: GYAE6OF01CCXNZ.29.30.C08.1.454.CMB.1.raw
  modified_base (322)..(331): a, c, t, g, unknown or other
  misc_feature (322)..(331): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtcctcctcagcctccaccaagggcccatcggtccttccccctggccgccctgctccaggacgccacctccgagagcacaggccggccctgggctcgcctggtaccaaggactaccttccacggtagcgtgctggaggcgggctggcaaggcgtacatagnnnnnnnnnn

SEQ ID NO: 117359 - DNA, 311 bp, Homo sapiens
  misc_feature: GYAE6OF01EWOWW.29.30.C08.1.454.CMB.1.raw
  modified_base (307)..(311): a, c, t, g, unknown or other
  misc_feature (307)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctggcaaggcgcagtagnnnnn

SEQ ID NO: 117360 - DNA, 340 bp, Homo sapiens
  misc_feature: GYAE6OF01A8QFA.29.30.C08.1.454.CMB.1.raw
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
  modified_base (313)..(340): a, c, t, g, unknown or other
  misc_feature (313)..(340): n is a, c, g, or t
tcagatagagtactcacgaccggtgctcgatttagtctgacgtcaaaggggaaaggggctggagtgggtggccaacataaaccaagatggaagtgaacagtactatgtggactctgtgaagggccgattcaccatctccagagacaacgccaagaactcactgtctcctcagcctccaccaagggccccatcggtcttccccctggccgccctgctccaggagccacctccgagagcacagcggccctggctgcctggtacaaggtcctacttccacgtagcgtgctgagcggntggcaaggcgcataggnannnnnnnnnnnnnnnnnnnnnnnnnnnn

SEQ ID NO: 117361 - DNA, 309 bp, Homo sapiens
  misc_feature: GYAE6OF01CEUAH.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaaagaactcactgtctcctcagcctccaccaagggcccatcggtctcccctggcgccctgctccaggagcacctccgagagcacagcggccctgggctgcctggtcaaggactacttccacgtagcgtgctgagcgggctggcaaggcgcatagnnnnn

SEQ ID NO: 117362 - DNA, 306 bp, Homo sapiens; identical to SEQ ID NO: 117170
  misc_feature: GYAE6OF01E348F.29.30.C08.1.454.CMB.1.raw
  modified_base (304)..(306): a, c, t, g, unknown or other
  misc_feature (304)..(306): n is a, c, g, or t

SEQ ID NO: 117363 - DNA, 309 bp, Homo sapiens
  misc_feature: GYAE6OF01BN933.29.30.C08.1.454.CMB.1.raw
  modified_base (301)..(301): a, c, t, g, unknown or other
  misc_feature (301)..(301): n is a, c, g, or t
  modified_base (306)..(309): a, c, t, g, unknown or other
  misc_feature (306)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggacgcacctccgagagcacagccggccctgggctgcctggtcaaggatacttccacgtagcgtgctgagcgggctggcaaggcncatgnnnn

SEQ ID NO: 117364 - DNA, 404 bp, Homo sapiens
  misc_feature: GYAE6OF01BYWVF.29.30.C08.1.454.CMB.1.raw
  modified_base (230)..(230): a, c, t, g, unknown or other
  misc_feature (230)..(230): n is a, c, g, or t
  modified_base (278)..(278): a, c, t, g, unknown or other
  misc_feature (278)..(278): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
  modified_base (339)..(340): a, c, t, g, unknown or other
  misc_feature (339)..(340): n is a, c, g, or t
  modified_base (342)..(404): a, c, t, g, unknown or other
  misc_feature (342)..(404): n is a, c, g, or t
tcagatagagtactcacgaccggtgctcgattttagtctgacgtcaaaaggggaaagggggctggagtgggtggccaacataaaccaagatggaagtgaacagtactagtgtggactctgtgaagggccgattcaccatctccagagacaacgccaagaactcactgtcctcctcagcctcccaccgaagggccccatcggtcttccccctggcgccctgctccaggacncacctccgagacgcacacgcggccctgggctgctggtcaaggaccttnttcccgacgtagccgtgctgaggcgggctgggaccaagggccgactagtagnagcgangcnncnnnnnnnnnnnnnnnnnnnnnnnnnnnnnnnnnnnnnnnnnnnnnnnnnnnnnnnnnnnnnnn

SEQ ID NO: 117365 - DNA, 310 bp, Homo sapiens; identical to SEQ ID NO: 117166
  misc_feature: GYAE6OF01AX2CU.29.30.C08.1.454.CMB.1.raw
  modified_base (306)..(310): a, c, t, g, unknown or other
  misc_feature (306)..(310): n is a, c, g, or t

SEQ ID NO: 117366 - DNA, 313 bp, Homo sapiens
  misc_feature: GYAE6OF01DBYKB.29.30.C08.1.454.CMB.1.raw
  modified_base (220)..(220): a, c, t, g, unknown or other
  misc_feature (220)..(220): n is a, c, g, or t
  modified_base (292)..(292): a, c, t, g, unknown or other
  misc_feature (292)..(292): n is a, c, g, or t
  modified_base (308)..(313): a, c, t, g, unknown or other
  misc_feature (308)..(313): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaaggccgattcaccatctccagagacaacgccaagaactcactgtctcctcagcctccaccaagggcccatcggtcttcccctggccgccctgctccaggancacctcgagagcacagccggccctgggctgcctggtcaaggactacttccacgtagcgtgctggagccgggntggcaaggcgcatagnnnnnn

SEQ ID NO: 117367 - DNA, 313 bp, Homo sapiens
  misc_feature: GYAE6OF01DE9D0.29.30.C08.1.454.CMB.1.raw
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaaagaactcactgtctcctcagcctccaccaagggcccatcggtcttcccctggccgccctgctccaggagcacctccgagagcacagcggccctgggctgcctggtcaaggactacttccacgtagcgtgctgagcgggctggcaaggcgcatagnnnnnnnn

SEQ ID NO: 117368 - DNA, 310 bp, Homo sapiens; identical to SEQ ID NO: 117127
  misc_feature: GYAE6OF01B23JS.29.30.C08.1.454.CMB.1.raw
  modified_base (305)..(310): a, c, t, g, unknown or other
  misc_feature (305)..(310): n is a, c, g, or t

SEQ ID NO: 117369 - DNA, 367 bp, Homo sapiens
  misc_feature: GYAE6OF01EG9O3.29.30.C08.1.454.CMB.1.raw
  modified_base (224)..(224): a, c, t, g, unknown or other
  misc_feature (224)..(224): n is a, c, g, or t
  modified_base (346)..(367): a, c, t, g, unknown or other
  misc_feature (346)..(367): n is a, c, g, or t
tcagatagagtactcacgaccggtgctcgatttagtctgacgtcaaaggggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggccgccctgcctccgaggancacctccgagacgcacgagccggcccgtgggctgccgtggtacaacggaccttaccttaccgacggttagccggttgcctaggaggtccggggctgggaccgtaagggccgactagtacggnnnnnnnnnnnnnnnnnnnnnn

SEQ ID NO: 117370 - DNA, 314 bp, Homo sapiens
  misc_feature: GYAE6OF01C4V4Q.29.30.C08.1.454.CMB.1.raw
  modified_base (302)..(314): a, c, t, g, unknown or other
  misc_feature (302)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggcctgggctgcctggtcaaggctacttcacgtagcgtgctgagcgggctggcaaggcgcatgnnnnnnnnnnnnn

SEQ ID NO: 117371 - DNA, 411 bp, Homo sapiens
  misc_feature: GYAE6OF01COUSR.29.30.C08.1.454.CMB.1.raw
  modified_base (388)..(388): a, c, t, g, unknown or other
  misc_feature (388)..(388): n is a, c, g, or t
  modified_base (390)..(411): a, c, t, g, unknown or other
  misc_feature (390)..(411): n is a, c, g, or t
tcagatagagtactcacgaccggtgctcgatttagtctgacgtcaaagggaaaggggctggagtgggtggccaacataaaccaagatggaagtgaacagtactatgtggactctgtggaagggccgattcaccatctcagagacaacgccaagaactcactgtcctcctcagccctccaaccgaacgggccccagtccggtccttcccccgtggccgccctgcctccgaggacgccaccgtccggagacgccacgacggccgggcccgtggggcctcggcccgttaggggtaccaaacgggtaccttacctttcccgaacggttacggcggttcgccgtgggacgggccggggtcctggggaccaaagggggccgtacgtaagtaggngnnnnnnnnnnnnnnnnnnnnnn

SEQ ID NO: 117372 - DNA, 364 bp, Homo sapiens
  misc_feature: GYAE6OF01CPXEC.29.30.C08.1.454.CMB.1.raw
  modified_base (238)..(238): a, c, t, g, unknown or other
  misc_feature (238)..(238): n is a, c, g, or t
  modified_base (344)..(364): a, c, t, g, unknown or other
  misc_feature (344)..(364): n is a, c, g, or t
tcagatagagtactcacgaccggtgctcgatttagtctgacgtcaaaaggggaaaggggctggagtggggtggccaacataaaaccaagatggaagtgaacagtactatgtggactctgtgaagggccgattcaccatctcagagacaacgccaagaactcactgtctcctcagcctccaaccgaacgggcccagtccggtcccttcccccgtgggccgccctgcctccgaagggacnccaccgtccgagagacacaggccggtccgtgggctcggctggacaaggacttaccttccagtagcgtgctggacgcgggctagggcaaaggggccacgaagtcgannnnnnnnnnnnnnnnnnnnn

SEQ ID NO: 117373 - DNA, 322 bp, Homo sapiens
  misc_feature: GYAE6OF01AEA3D.29.30.C08.1.454.CMB.1.raw
  modified_base (219)..(219): a, c, t, g, unknown or other
  misc_feature (219)..(219): n is a, c, g, or t
  modified_base (304)..(322): a, c, t, g, unknown or other
  misc_feature (304)..(322): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagcggccctgggctgcctggtcaaggactacttccacgtagcgtgctgagcggctggcaaggcgcatagnnnnnnnnnnnnnnnnnnn

SEQ ID NO: 117374 - DNA, 310 bp, Homo sapiens
  misc_feature: GYAE6OF01AV1VD.29.30.C08.1.454.CMB.1.raw
  modified_base (305)..(310): a, c, t, g, unknown or other
  misc_feature (305)..(310): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnnnn

SEQ ID NO: 117375 - DNA, 306 bp, Homo sapiens
  misc_feature: GYAE6OF01BVVQP.29.30.C08.1.454.CMB.1.raw
  modified_base (301)..(306): a, c, t, g, unknown or other
  misc_feature (301)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtctcccctggcgccctgctccaggagcacctcgagagcacagcggccctgggctgcctggtcaaggactacttccagtagcgtgctgagcgggctggcaaggcgcatagnnnnnn

SEQ ID NO: 117376 - DNA, 307 bp, Homo sapiens; identical to SEQ ID NO: 117110
  misc_feature: GYAE6OF01ED3JC.29.30.C08.1.454.CMB.1.raw
  modified_base (305)..(307): a, c, t, g, unknown or other
  misc_feature (305)..(307): n is a, c, g, or t

SEQ ID NO: 117377 - DNA, 343 bp, Homo sapiens
  misc_feature: GYAE6OF01BSKT3.29.30.C08.1.454.CMB.1.raw
  modified_base (171)..(171): a, c, t, g, unknown or other
  misc_feature (171)..(171): n is a, c, g, or t
  modified_base (220)..(220): a, c, t, g, unknown or other
  misc_feature (220)..(220): n is a, c, g, or t
  modified_base (322)..(322): a, c, t, g, unknown or other
  misc_feature (322)..(322): n is a, c, g, or t
  modified_base (329)..(343): a, c, t, g, unknown or other
  misc_feature (329)..(343): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtcctcctcancctccacaagggcccatcggtccttcccctggccgccctgctcgaaggngccaccgtccgagagccaacgacgccggccccgtgggcctgcccgtggtacaaggaccttacttccacgtagcgtgctggagcggggctgggcaagggccgnacgtagnnnnnnnnnnnnnnn

SEQ ID NO: 117378 - DNA, 308 bp, Homo sapiens
  misc_feature: GYAE6OF01AOP2O.29.30.C08.1.454.CMB.1.raw
  modified_base (302)..(308): a, c, t, g, unknown or other
  misc_feature (302)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcggctggcaggcgcagtgnnnnnnn

SEQ ID NO: 117379 - DNA, 382 bp, Homo sapiens
  misc_feature: GYAE6OF01CGEI2.29.30.C08.1.454.CMB.1.raw
  modified_base (188)..(188): a, c, t, g, unknown or other
  misc_feature (188)..(188): n is a, c, g, or t
  modified_base (242)..(242): a, c, t, g, unknown or other
  misc_feature (242)..(242): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (374)..(382): a, c, t, g, unknown or other
  misc_feature (374)..(382): n is a, c, g, or t
tcagatagagtactcacgaccggtgctcgatttagtctgacgtcaaagggaaagggcgtggagtgggtgggccgaacataaaccaaacgaatggaagtgaacagtactatgtggacgtctgtgtaaggaccggagttcaccactctccacgagacaacgaccaacgaactacactcgtctcctctacncctccaccaaccggacccgacgtaccgtcgttccccgttccgtccgcccgtccnccgtccacggacgacgacctaccgaccgacggacaccgacgccggccggtccggtcggtcgccgtcggtcgacggacgtacttaccgtacgtacgcgtgtcgtcggngcggcggcggcgacggacgcganannnnnnnnn

SEQ ID NO: 117380 - DNA, 371 bp, Homo sapiens
  misc_feature: GYAE6OF01BEVH2.29.30.C08.1.454.CMB.1.raw
  modified_base (172)..(172): a, c, t, g, unknown or other
  misc_feature (172)..(172): n is a, c, g, or t
  modified_base (344)..(371): a, c, t, g, unknown or other
  misc_feature (344)..(371): n is a, c, g, or t
tcagatagagtactcacgaccggtgctcgatttagtctgacgtcaaagggaaagggggcgtggagtggggtggccaacataaaccaagatggaagtgaacagtactatgtggactctgtgaagggccgattcaccatctccagagacaacgccaagaactcactgtctcctnagcctccaccaacgggcccatcggtccttccccgtggccgccctgctccgaggacgcacctccgagacgcacagccggcccgtgggctcgcctgggtacaaggtaccttaaccgttccgaacggttaggtcgctaggacggccgggctgggaccaaagggccgacagtaggnnnnnnnnnnnnnnnnnnnnnnnnnnnn

SEQ ID NO: 117381 - DNA, 382 bp, Homo sapiens
  misc_feature: GYAE6OF01C6H80.29.30.C08.1.454.CMB.1.raw
  modified_base (137)..(137): a, c, t, g, unknown or other
  misc_feature (137)..(137): n is a, c, g, or t
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
  modified_base (330)..(382): a, c, t, g, unknown or other
  misc_feature (330)..(382): n is a, c, g, or t
tcagatagagtactcacgaccggtgctcgatttagtctgacgtcaaaggggaaaggggctggagtgggtggccaacataaaccaagatggaagtgaacagtactatgtggacctctgtgaaggccgattcaccatcncagagacaacgccaagaactcactgtctcctcagcctccaccaagggcccatcggtcttcccccnggccgccctgctccaggagccacctccgagagccagngcggcctgggctgcccgtggtaccaaagggacctactttccgaacgttagccgttgctggagcgggctgggacaaggggtcanagtagctnnnnnnnnnnnnnnnnnnnnnnnnnnnnnnnnnnnnnnnnnnnnnnnnnnnnn

SEQ ID NO: 117382 - DNA, 314 bp, Homo sapiens
  misc_feature: GYAE6OF01CFOBT.29.30.C08.1.454.CMB.1.raw
  modified_base (305)..(314): a, c, t, g, unknown or other
  misc_feature (305)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnn

SEQ ID NO: 117383 - DNA, 324 bp, Homo sapiens
  misc_feature: GYAE6OF01ATI6C.29.30.C08.1.454.CMB.1.raw
  modified_base (313)..(324): a, c, t, g, unknown or other
  misc_feature (313)..(324): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggcgccctgcctccaggagcacctccgagagcacagccggccctgggctcgcctggtcaaggactaccttccacgtagcgtgctgaggcgggctggcaagggcgcatcgnnnnnnnnnnnn

SEQ ID NO: 117384 - DNA, 323 bp, Homo sapiens
  misc_feature: GYAE6OF01AJZHF.29.30.C08.1.454.CMB.1.raw
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
  modified_base (320)..(323): a, c, t, g, unknown or other
  misc_feature (320)..(323): n is a, c, g, or t
tcagatagagtactcacgaccggtgctcgatttagtctgacgtcaaaggggaaaggggctggagtgggtggccaacataaaccaagatggaagtgaacagtactatgtggactctgtgaagggccgattcaccatctccagagacaacgccaagaactcactgtcctcctcacgcctccaccaacgggcccatccggtccttccccctggccgccctgctccgaggacgccaccgtccgagacgcacgagccggcctgggctgcctggtacaaggacttactccacgtagcgtgctgagcgggctggacaggcnctangnnnn

SEQ ID NO: 117385 - DNA, 320 bp, Homo sapiens
  misc_feature: GYAE6OF01BZO19.29.30.C08.1.454.CMB.1.raw
  modified_base (222)..(222): a, c, t, g, unknown or other
  misc_feature (222)..(222): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (310)..(320): a, c, t, g, unknown or other
  misc_feature (310)..(320): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcacgcctccaccaagggcccatccggtccttcccctggccgccctgctccaggancacctcgagagcacgagccggccctgggctgcctggtcaaggacctactccacgtagcgtncgtgagcgggctggcaaggcncatagnnnnnnnnnnn

SEQ ID NO: 117386 - DNA, 330 bp, Homo sapiens
  misc_feature: GYAE6OF01C773V.29.30.C08.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (308)..(330): a, c, t, g, unknown or other
  misc_feature (308)..(330): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctgccgccctgctccaggngcacctccgagngcacagccggcctgggctgcctggtcaaggaccttacttcgacgtagccgtgctgacgcgggctggcaaggcgcatagnnnnnnnnnnnnnnnnnnnnnnn

SEQ ID NO: 117387 - DNA, 311 bp, Homo sapiens
  misc_feature: GYAE6OF01EZPOH.29.30.C08.1.454.CMB.1.raw
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
  modified_base (303)..(311): a, c, t, g, unknown or other
  misc_feature (303)..(311): n is a, c, g, or t
tcagatagagtactcacgaccggtgctcgatttagtctgacgtcaaagggaaaggggctggagtgggtggccaacataaaccaagatggaagtgaacgtactatgtggactctgtgaggccgattctaccatctccacgagacaacgaccaagaactacactgtctcctcagcctccaccaacggcccactcggtcttcccctcggcgccctcgctccaggagcacctccgagagcacagcggccctgggctcgctggtcaggactactccacgtacgcgtgctgngcggctggncagcgcannnnnnnnn

SEQ ID NO: 117388 - DNA, 324 bp, Homo sapiens
  misc_feature: GYAE6OF01C5781.29.30.C08.1.454.CMB.1.raw
  modified_base (168)..(168): a, c, t, g, unknown or other
  misc_feature (168)..(168): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (311)..(324): a, c, t, g, unknown or other
  misc_feature (311)..(324): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagactcactgtctcctnagcctccaccaaggcccatcggtcttcccctggccgccctgctccagggagtccacctccgagacgcacgagccggccctgggctggcctggtcaaggctactccagtancgtncgtgagcgggctgggcaaggcncataggnnnnnnnnnnnnnn

SEQ ID NO: 117389 - DNA, 340 bp, Homo sapiens
  misc_feature: GYAE6OF01CQBIP.29.30.C08.1.454.CMB.1.raw
  modified_base (308)..(340): a, c, t, g, unknown or other
  misc_feature (308)..(340): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaaccaagggcccatccggtcttcccctggcgccctgctccaggagcacctcgagagcacagcgcctgggctgctgtcaaggactacttccagtagcgtgctgagcggggctgggacaagggcgacaatacgnnnnnnnnnnnnnnnnnnnnnnnnnnnnnnnnn

SEQ ID NO: 117390 - DNA, 319 bp, Homo sapiens
  misc_feature: GYAE6OF01D3TLO.29.30.C08.1.454.CMB.1.raw
  modified_base (301)..(301): a, c, t, g, unknown or other
  misc_feature (301)..(301): n is a, c, g, or t
  modified_base (307)..(319): a, c, t, g, unknown or other
  misc_feature (307)..(319): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggccatcggtcttcccctggcgccctgctccaggagcacctccgagagcacagccggccctgggctgcctggtcaaggactacttccacgtagcgtgctgaggcgggctggcaagggcncatagnnnnnnnnnnnnn

SEQ ID NO: 117391 - DNA, 307 bp, Homo sapiens
  misc_feature: GYAE6OF01EEZTM.29.30.C08.1.454.CMB.1.raw
  modified_base (303)..(307): a, c, t, g, unknown or other
  misc_feature (303)..(307): n is a, c, g, or t
tcagatagagtactcacgaccggtgctcgatttagtctgacgtcaaagggaaaggggctgtagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggccctgggctgcctggtcaaggactactccacgtagcgtgctgagcgggctggcaaggcgcatagnnnnn

SEQ ID NO: 117392 - DNA, 367 bp, Homo sapiens
  misc_feature: GYAE6OF01B6HPX.29.30.C08.1.454.CMB.1.raw
  modified_base (351)..(367): a, c, t, g, unknown or other
  misc_feature (351)..(367): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggccgccctgctccgaggagccacctccgagacgcacaggccgggccctggggctcggccgtgggtaccaaagggtaccttaaccttcccaacggtacgtccggtggtcctggacggcggggactggggaccaagggccgtcataggnnnnnnnnnnnnnnnnn

SEQ ID NO: 117393 - DNA, 329 bp, Homo sapiens
  misc_feature: GYAE6OF01E1YTL.29.30.C08.1.454.CMB.1.raw
  modified_base (305)..(329): a, c, t, g, unknown or other
  misc_feature (305)..(329): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggctacttccacgtagcgtgctgagcgggctggcaaggcgcatagnnnnnnnnnnnnnnnnnnnnnnnnn

SEQ ID NO: 117394 - DNA, 325 bp, Homo sapiens
  misc_feature: GYAE6OF01A3984.29.30.C08.1.454.CMB.1.raw
  modified_base (227)..(227): a, c, t, g, unknown or other
  misc_feature (227)..(227): n is a, c, g, or t
  modified_base (315)..(325): a, c, t, g, unknown or other
  misc_feature (315)..(325): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccaagggccccatccggtccttccccctggccgcccctgcctccagganccacctccgagagcacagccgcctgggctgcctggtcaaggactacttccacgtagcgtgctggagcggctggacaagggcacatagnnnnnnnnnnn

SEQ ID NO: 117395 - DNA, 320 bp, Homo sapiens
  misc_feature: GYAE6OF01AS1DU.29.30.C08.1.454.CMB.1.raw
  modified_base (304)..(304): a, c, t, g, unknown or other
  misc_feature (304)..(304): n is a, c, g, or t
  modified_base (310)..(320): a, c, t, g, unknown or other
  misc_feature (310)..(320): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggtcccatcggtccttcccctggccgccctgctccaggagccacctccgagagccacgacgccggccctgggctgcctggtcaaggctacttccagtagcgtgctgagcgggctggcagggcncatagnnnnnnnnnnn

SEQ ID NO: 117396 - DNA, 317 bp, Homo sapiens
  misc_feature: GYAE6OF01BVZC9.29.30.C08.1.454.CMB.1.raw
  modified_base (308)..(317): a, c, t, g, unknown or other
  misc_feature (308)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtcttcccctggcgccctgctccaggagcacctccgagacgcacagcggccctgggctgcctggtacaaggctacttccacgtagcgtgctgagcgggctggcgaggcgacatagnnnnnnnnnn

SEQ ID NO: 117397 - DNA, 461 bp, Homo sapiens
  misc_feature: GYAE6OF01DH91J.29.30.C08.1.454.CMB.1.raw
  modified_base (412)..(415): a, c, t, g, unknown or other
  misc_feature (412)..(415): n is a, c, g, or t
  modified_base (417)..(461): a, c, t, g, unknown or other
  misc_feature (417)..(461): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaaccaagggccccatccggtccttccccctgggccgcccctgcctacccgagggacgccaacccgtcccggaagacgaccaacgacggcccgggtccccttgggggccttcggccccgttgggttaccgaaaagggtaccttaaccgtttcccgaacggttagcccggttggccgttgggaacgggtccgggggccttgggggaaccgaaaacggggtccggaccaaagttaggnnnngnnnnnnnnnnnnnnnnnnnnnnnnnnnnnnnnnnnnnnnnnnnnn

SEQ ID NO: 117398 - DNA, 318 bp, Homo sapiens
  misc_feature: GYAE6OF01A2P64.29.30.C08.1.454.CMB.1.raw
  modified_base (205)..(205): a, c, t, g, unknown or other
  misc_feature (205)..(205): n is a, c, g, or t
  modified_base (305)..(318): a, c, t, g, unknown or other
  misc_feature (305)..(318): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcnccctgctccaggagccacctccgagagcacagcggccctgggctgcctggtcaaggctactccacgtagcgtgctgagcgggctgggcaaggcgcatagnnnnnnnnnnnnnn

SEQ ID NO: 117399 - DNA, 419 bp, Homo sapiens
  misc_feature: GYAE6OF01CLYFH.29.30.C08.1.454.CMB.1.raw
  modified_base (254)..(254): a, c, t, g, unknown or other
  misc_feature (254)..(254): n is a, c, g, or t
  modified_base (390)..(390): a, c, t, g, unknown or other
  misc_feature (390)..(390): n is a, c, g, or t
  modified_base (392)..(419): a, c, t, g, unknown or other
  misc_feature (392)..(419): n is a, c, g, or t
tcagatagagtactcacgaccggtgctcgatttagtctgacgtcaaagggaaaggggctgggagtgggtggccaacataaaccaagatggaagtgaacagtactatgtggactctgtgaagggccgattcaccatctccagagacaacgccaagaactcactgtctcctcacgccctccaaccgaagggcccctagttccggtccttccccccgtgggccgcccctgcctccgagggacgccaccgtccgaagngccacgaggccggcccgtgggcctggacccgtgggtacgaaacggaccttaaccgtttcccgaaggttacggccggttgccgttagggacgggtcgggggccttaggggaccgaaaggggccgacgtaagttaggngnnnnnnnnnnnnnnnnnnnnnnnnnnnn

SEQ ID NO: 117400 - DNA, 333 bp, Homo sapiens
  misc_feature: GYAE6OF01CP7LK.29.30.C08.1.454.CMB.1.raw
  modified_base (323)..(333): a, c, t, g, unknown or other
  misc_feature (323)..(333): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccccgtggccgcccctgcctcccgaggacgccaccgtccgagacgcacacgccggccctgggctcgcctggtcaaggaccttactccacgtagcgtgctggagcgggctggcacgggcgacatagnnnnnnnnnnn

SEQ ID NO: 117401 - DNA, 334 bp, Homo sapiens
  misc_feature: GYAE6OF01AJ9FS.29.30.C08.1.454.CMB.1.raw
  modified_base (322)..(334): a, c, t, g, unknown or other
  misc_feature (322)..(334): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggccccatccggtccttccccctggccgcccctgctccaggacgcacctccgagagcacaggccggcccctggggctcgccgtggtcaaggaccttacgttccacgtagcgtgctgacggcgggctggcaggcgcatagnnnnnnnnnnnnn

SEQ ID NO: 117402 - DNA, 318 bp, Homo sapiens
  misc_feature: GYAE6OF01C3PP1.29.30.C08.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (302)..(318): a, c, t, g, unknown or other
  misc_feature (302)..(318): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccagtcgtcttccccnggcnccctgctcaggancaccnccgagancaacagcgcctgggctgcctgcaaggactacttccagtagcgtgactgagcgggctggcaaggcgcagtagnnnnnnnnnnnnnnnnn

SEQ ID NO: 117403 - DNA, 353 bp, Homo sapiens
  misc_feature: GYAE6OF01CXGOA.29.30.C08.1.454.CMB.1.raw
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (336)..(353): a, c, t, g, unknown or other
  misc_feature (336)..(353): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaaagaactcactgtctcctcagcctccaccaagggcccatccggtccttccccctggccgccctgcctccgaggcgcacctccgagacgccacaggccggccgtgggcctgccgtggtcaaggtcctacttccgacggtagcgtgctggacggtcgggctcggacgaaggccggacagtagnancnnnnnnnnnnnnnnnnnn

SEQ ID NO: 117404 - DNA, 455 bp, Homo sapiens
  misc_feature: GYAE6OF01BVJUG.29.30.C08.1.454.CMB.1.raw
  modified_base (398)..(398): a, c, t, g, unknown or other
  misc_feature (398)..(398): n is a, c, g, or t
  modified_base (402)..(455): a, c, t, g, unknown or other
  misc_feature (402)..(455): n is a, c, g, or t
tcagatagagtactcacgaccggtgctcgatttagtctgacgtcaaaaggggaaaggggctgggagtgggtggccaacataaaaccaagatggaagtgaacagtactatgtggactctgtgaagggccgattcaccatctccagagacaacgccaagaactcactgtctcctcagcctccaccaagggcccatccggtccttccccctggccgccctgctccgaggcgccacctccggagacgcacgacggccggccccttgggggcctacggcccgttggggtaaccgaaaacgggtaccttaaccgtttaccccgaacggttaacggtccggttgccgttgggaacgggccgggggtccgttggggaccgaaacggggccgaccgtaaagttaggncagnnnnnnnnnnnnnnnnnnnnnnnnnnnnnnnnnnnnnnnnnnnnnnnnnnnnnn

SEQ ID NO: 117405 - DNA, 399 bp, Homo sapiens
  misc_feature: GYAE6OF01C2DH5.29.30.C08.1.454.CMB.1.raw
  modified_base (388)..(399): a, c, t, g, unknown or other
  misc_feature (388)..(399): n is a, c, g, or t
tcagatagagtactcacgaccggtgctcgatttagtctgacgtcaaagggaaaggggctggagtgggtggccaacataaaccaagatggaagtgaacagtactatgtggactctgtggaagggccgattcaccatctcagagacaacgccaagaactcactgtcctccctcacgccctccaaccgaacggggcccctagttccgggttcctttcccccccgtgggccgcccctggcctaccggagggacgccacccgtccggaagacgccaacgacgggcccgggtcccgtggggcctcggccgttagggtaccgaaacggtacctacctttcccgacggttacggcgtgccgtgagggccgggctagggcgaacgggcgtacatagnnnnnnnnnnnn

SEQ ID NO: 117406 - DNA, 326 bp, Homo sapiens
  misc_feature: GYAE6OF01AYVTU.29.30.C08.1.454.CMB.1.raw
  modified_base (221)..(221): a, c, t, g, unknown or other
  misc_feature (221)..(221): n is a, c, g, or t
  modified_base (315)..(316): a, c, t, g, unknown or other
  misc_feature (315)..(316): n is a, c, g, or t
  modified_base (318)..(326): a, c, t, g, unknown or other
  misc_feature (318)..(326): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggacncacctccgagacgcacaggcggcccgtgggctcgcctggtcaacggactacttccacggtagcgtagctgagcgggctggacaaggcgcatagnngnnnnnnnnn

SEQ ID NO: 117407 - DNA, 305 bp, Homo sapiens
  misc_feature: GYAE6OF01BS1C4.29.30.C08.1.454.CMB.1.raw
  modified_base (219)..(219): a, c, t, g, unknown or other
  misc_feature (219)..(219): n is a, c, g, or t
  modified_base (295)..(295): a, c, t, g, unknown or other
  misc_feature (295)..(295): n is a, c, g, or t
  modified_base (301)..(305): a, c, t, g, unknown or other
  misc_feature (301)..(305): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctcgagagcacagcggccctgggctgcctggcaaggctacttccagtagcgtgctgagcgggctggcaaggcncatagnnnnn

SEQ ID NO: 117408 - DNA, 347 bp, Homo sapiens
  misc_feature: GYAE6OF01D9KX2.29.30.C08.1.454.CMB.1.raw
  modified_base (225)..(225): a, c, t, g, unknown or other
  misc_feature (225)..(225): n is a, c, g, or t
  modified_base (323)..(323): a, c, t, g, unknown or other
  misc_feature (323)..(323): n is a, c, g, or t
  modified_base (325)..(347): a, c, t, g, unknown or other
  misc_feature (325)..(347): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccgaagggcccatccggtccttccccgtggccgccctgctccgaggancacctcgagagcacagccggcccgtgggctgcctggtcaaggcctacttccacggtagcgtgcctgacggtcgggctgggactaagggcgcaagtgcngnnnnnnnnnnnnnnnnnnnnnnn

SEQ ID NO: 117409 - DNA, 390 bp, Homo sapiens
  misc_feature: GYAE6OF01DONMV.29.30.C08.1.454.CMB.1.raw
  modified_base (333)..(335): a, c, t, g, unknown or other
  misc_feature (333)..(335): n is a, c, g, or t
  modified_base (338)..(390): a, c, t, g, unknown or other
  misc_feature (338)..(390): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaaccaagggcccatcggtccttccccctggccgccctgctccaggacgccacctccgagagcacaggccgccccgtgggcctggcctggtaccaacggacttaccttccaacgtagcgtgcctggagccggggactgggacgtaaggcgcaataggnnnagnnnnnnnnnnnnnnnnnnnnnnnnnnnnnnnnnnnnnnnnnnnnnnnnnnnnn

SEQ ID NO: 117410 - DNA, 306 bp, Homo sapiens
  misc_feature: GYAE6OF01CKYGK.29.30.C08.1.454.CMB.1.raw
  modified_base (299)..(306): a, c, t, g, unknown or other
  misc_feature (299)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcgtcttcccctcggcgccctgctcaggagcacctccgagagcacacgcgccgtgggctgcctgtcaaggctacttccacgtagcgtgctgagcggctggcaggcgcagtgnnnnnnnn

SEQ ID NO: 117411 - DNA, 391 bp, Homo sapiens
  misc_feature: GYAE6OF01E151N.29.30.C08.1.454.CMB.1.raw
  modified_base (370)..(391): a, c, t, g, unknown or other
  misc_feature (370)..(391): n is a, c, g, or t
tcagatagagtactcacgaccggtgctcgatttagtctgacgtcaaagggaaaggggctggagtgggtggccaacataaaccaagatggaagtgaacagtactatgtggactctgtggaagggccgattcaccatctccagagacaacgccaaagaactcactgtcctcctcacgcctccaccgaacgggcccagtccggtccttcccccgtgggccgccctgcctccgaggacgccacctccgagagccacgacggccggccccgtggggcctcggcccgtgggtaccaaacgggtacctaaccttccgaacggttaggcggtcgcgtggacgggccgggtcgtcgggacgaacgggccggtacatagnnnnnnnnnnnnnnnnnnnnnn

SEQ ID NO: 117412 - DNA, 406 bp, Homo sapiens
  misc_feature: GYAE6OF01AEARE.29.30.C08.1.454.CMB.1.raw
  modified_base (350)..(351): a, c, t, g, unknown or other
  misc_feature (350)..(351): n is a, c, g, or t
  modified_base (355)..(406): a, c, t, g, unknown or other
  misc_feature (355)..(406): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccgaagggccccatccggtccttccccctgggccgcccctgcctcccgaggacgccaccctccgaggacgcacgacgccggccctgggctcggcccgttgggtaccaacgggaccttacttcccacggttagcgtgcctggacggcggggctgggaccaagggccacagtagtnngtcnnnnnnnnnnnnnnnnnnnnnnnnnnnnnnnnnnnnnnnnnnnnnnnnnnnn

SEQ ID NO: 117413 - DNA, 310 bp, Homo sapiens
  misc_feature: GYAE6OF01COIKD.29.30.C08.1.454.CMB.1.raw
  modified_base (217)..(217): a, c, t, g, unknown or other
  misc_feature (217)..(217): n is a, c, g, or t
  modified_base (305)..(310): a, c, t, g, unknown or other
  misc_feature (305)..(310): n is a, c, g, or t
tcagatagagtactcacgaccggtgctcgatttagtctgacgtcaaagggaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggancacctccgagagcacagcggcctgggctgcctggtcaaggactacttccgacgtagcgtgctggagcgggctgggcaaggcgcatagnnnnnn

SEQ ID NO: 117414 - DNA, 363 bp, Homo sapiens
  misc_feature: GYAE6OF01EVFUZ.29.30.C08.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (301)..(301): a, c, t, g, unknown or other
  misc_feature (301)..(301): n is a, c, g, or t
  modified_base (331)..(363): a, c, t, g, unknown or other
  misc_feature (331)..(363): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctcaggngcacctccgagngcacagccggccctgggctgccgttggtacaaggtactaccttccagtacgcgtagccgtgaggccggggtntcgggaccgaaaggggccgacgaagtaggnnnnnnnnnnnnnnnnnnnnnnnnnnnnnnnnn

SEQ ID NO: 117415 - DNA, 309 bp, Homo sapiens
  misc_feature: GYAE6OF01APV6V.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttccccctggctccctgctccaggacgcacctccgagagcacagcggccctgggctgcctggtcaaggactacttccacgtagcgtgctgagcgggctggcaaggcgcatgnnnnn

SEQ ID NO: 117416 - DNA, 321 bp, Homo sapiens
  misc_feature: GYAE6OF01DA9MP.29.30.C08.1.454.CMB.1.raw
  modified_base (220)..(220): a, c, t, g, unknown or other
  misc_feature (220)..(220): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (307)..(321): a, c, t, g, unknown or other
  misc_feature (307)..(321): n is a, c, g, or t
tcagatagagtactcacgaccggtgctcgatttagtctgacgtcaaagggaaagggctggagtgggtggccaacataaaccaagatggaagtgaacagtactatgtggactctgtgaaggccgattcaccatctccagagacaacgccaagaactcactgtctcctcagcctccaccaacgggcccatcggtccttccccgtggccgccctgctccaggngcacctccgagagcacaggccggcctggctcgcctggtcaagactacttccacgtgcgtnctgaggcggcnggcaaggccnagtagnnnnnnnnnnnnnnn

SEQ ID NO: 117417 - DNA, 352 bp, Homo sapiens
  misc_feature: GYAE6OF01ARCUV.29.30.C08.1.454.CMB.1.raw
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (320)..(352): a, c, t, g, unknown or other
  misc_feature (320)..(352): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctgccnccctgctccaggcgcacctcgagancacngccgccgtggctgcctggacaaggtactctccacgtacggcgtagctggacggcgggcgtggaccgaacgggcactaagtgncngcnnnnnnnnnnnnnnnnnnnnnnnnnnnnnnnnn

SEQ ID NO: 117418 - DNA, 313 bp, Homo sapiens
  misc_feature: GYAE6OF01BQVAU.29.30.C08.1.454.CMB.1.raw
  modified_base (242)..(242): a, c, t, g, unknown or other
  misc_feature (242)..(242): n is a, c, g, or t
  modified_base (284)..(284): a, c, t, g, unknown or other
  misc_feature (284)..(284): n is a, c, g, or t
  modified_base (308)..(313): a, c, t, g, unknown or other
  misc_feature (308)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccaagggcccatcggtcttccccctggccgcccctgcctccgaggagccacctccgagagcacngccggccctgggctgcctggtcaaggctactccagtagcgtnctgagcggctggcaggcgcatagnnnnnn

SEQ ID NO: 117419 - DNA, 367 bp, Homo sapiens
  misc_feature: GYAE6OF01DW4A0.29.30.C08.1.454.CMB.1.raw
  modified_base (351)..(367): a, c, t, g, unknown or other
  misc_feature (351)..(367): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccgaagggcccatccggtccttcccccgtggccgccctgcctccgaggacgccacctccgagacgcgacgggccggcccgtgggcctcggccgtggtaccaaagggtaccttaccgttccacggtacgcggttgcgtggacggcggggtctgggaccgaagggcgacagtaggnnnnnnnnnnnnnnnnn

SEQ ID NO: 117420 - DNA, 314 bp, Homo sapiens
  misc_feature: GYAE6OF01AOXS9.29.30.C08.1.454.CMB.1.raw
  modified_base (306)..(314): a, c, t, g, unknown or other
  misc_feature (306)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctgcgccctgctccaggagcacctccgagagcacagcggccctgggctgcctggtcaaggactacttccacgtagcgtgctgacgcgggctggcaagggcgcatagnnnnnnnnn

SEQ ID NO: 117421 - DNA, 348 bp, Homo sapiens
  misc_feature: GYAE6OF01EB1IB.29.30.C08.1.454.CMB.1.raw
  modified_base (334)..(348): a, c, t, g, unknown or other
  misc_feature (334)..(348): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccgaacgggcccagtccggtccttccccctggccgccctgcctccgaggcgcacctccgagacgcacgagccggcccgtgggctcgccgtggtacaaggaccttaccgttccacgtagcgtgctggacggcgggctcggacgaagggcgcagtagnnnnnnnnnnnnnnn

SEQ ID NO: 117422 - DNA, 322 bp, Homo sapiens
  misc_feature: GYAE6OF01BWPQT.29.30.C08.1.454.CMB.1.raw
  modified_base (219)..(219): a, c, t, g, unknown or other
  misc_feature (219)..(219): n is a, c, g, or t
  modified_base (310)..(322): a, c, t, g, unknown or other
  misc_feature (310)..(322): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctcgagagcacagccggccctgggctgccctgggtacaaggtctacttccagtagccgtgctgagccgggctggcaggcgacataggnnnnnnnnnnnnn

SEQ ID NO: 117423 - DNA, 393 bp, Homo sapiens
  misc_feature: GYAE6OF01DXS5Y.29.30.C08.1.454.CMB.1.raw
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (366)..(393): a, c, t, g, unknown or other
  misc_feature (366)..(393): n is a, c, g, or t
tcagatagagtactcacgaccggtgctcgatttagtctgacgtcaaaggggaaaggggctggagtgggtggccaacataaaccaagatggaagtgaacagtactatgtggactctggtgaagggccgattcaccatctccagagacaacgccaagaactcactgtcctcctcacgccctcccgaaccgaacgggcccctagtccggttcccttcccccgnggccgtcccctgccctaccgagggacncctaccgtccgagacgcacgacggccggcccgtgggcctcggcgtaggtacgaaggtacttaccttccgacgttacgcgtacgacgtgacggcggcgtggaccgaacgggcgcaagtgnnnnnnnnnnnnnnnnnnnnnnnnnnnn

SEQ ID NO: 117424 - DNA, 462 bp, Homo sapiens
  misc_feature: GYAE6OF01AYJW0.29.30.C08.1.454.CMB.1.raw
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (409)..(462): a, c, t, g, unknown or other
  misc_feature (409)..(462): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcacgcctccaccaacgggccccatccggttccttcccccgtggccgcccctgcctccgaggacgccaccgtccgagacgccacgacgcccgggccccgtggggcctcggccgttcgggtaccgaaacgggtaccttaacccgtttcccgaacggtacggccggttcgccggttaggaacggggccgggggtccgttaggggaccgaaacggggccgtaccgaagttacggnacgcagntcnnnnnnnnnnnnnnnnnnnnnnnnnnnnnnnnnnnnnnnnnnnnnnnnnnnnnn

SEQ ID NO: 117425 - DNA, 314 bp, Homo sapiens
  misc_feature: GYAE6OF01EV6ZY.29.30.C08.1.454.CMB.1.raw
  modified_base (219)..(219): a, c, t, g, unknown or other
  misc_feature (219)..(219): n is a, c, g, or t
  modified_base (308)..(314): a, c, t, g, unknown or other
  misc_feature (308)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagccggccctgggctgcctggtacaaggactacttccacgtagcgtgctggagcgggctggcaaggcgcatagnnnnnnn

SEQ ID NO: 117426 - DNA, 335 bp, Homo sapiens
  misc_feature: GYAE6OF01ECCM7.29.30.C08.1.454.CMB.1.raw
  modified_base (313)..(313): a, c, t, g, unknown or other
  misc_feature (313)..(313): n is a, c, g, or t
  modified_base (321)..(322): a, c, t, g, unknown or other
  misc_feature (321)..(322): n is a, c, g, or t
  modified_base (324)..(335): a, c, t, g, unknown or other
  misc_feature (324)..(335): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgaccaagaactcactgtctcctcagcctccaccaaggcccatcggtccttcccctggccgccctgcctccgaggacgcacctccgagacgcacagccggccctgggctgcctggtacgaaggacttacttccacgtagcgtgctgaggccgggctgggcaagggcncaagtagnngnnnnnnnnnnnn

SEQ ID NO: 117427 - DNA, 312 bp, Homo sapiens
  misc_feature: GYAE6OF01A6L5X.29.30.C08.1.454.CMB.1.raw
  modified_base (304)..(312): a, c, t, g, unknown or other
  misc_feature (304)..(312): n is a, c, g, or t
tcagatagagtactcacgaccggtgctcgatttagtctgacgtcaaaggggaaaggggctggagtgggtggccaacataaaccaagatggaagtgaacagtactatgtggactctgtgaaggccgattcaccatctccagagacaacgccaagaactcactgtctcctcagcctccaccaagggccccatcggtccttcccctggcgccctgctccaggagccacctccgagagcacagccggccctgggctgcctggtcaagctacttcacgtagcgtgctgagcggctggcaaggcgcatgnnnnnnnnn

SEQ ID NO: 117428 - DNA, 386 bp, Homo sapiens
  misc_feature: GYAE6OF01BFXQL.29.30.C08.1.454.CMB.1.raw
  modified_base (161)..(161): a, c, t, g, unknown or other
  misc_feature (161)..(161): n is a, c, g, or t
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (358)..(386): a, c, t, g, unknown or other
  misc_feature (358)..(386): n is a, c, g, or t
tcagatagagtactcacgaccggtgctcgatttagtctgacgtcaaaagggaaaggggctggagtgggtggccaacataaaaccaagatggaagtgaacagtactatgtggactctgtggaagggctattccacatctcagagacacacaaagactcactntctcctcacgccctaccaaccgaacggccctagttccggtccttcccccgnggccctccctgcctaccgaggactccaccgtccgaancgacacgacgccgccgtgggctgcgtggacaaggtaccttaccttcccaaggttacgccgttagccgtgacgggtccggacgtcgacggtaaggcacgataggnancgnnnnnnnnnnnnnnnnnnnnnnnnnnnnn

SEQ ID NO: 117429 - DNA, 390 bp, Homo sapiens
  misc_feature: GYAE6OF01CEO54.29.30.C08.1.454.CMB.1.raw
  modified_base (359)..(361): a, c, t, g, unknown or other
  misc_feature (359)..(361): n is a, c, g, or t
  modified_base (363)..(390): a, c, t, g, unknown or other
  misc_feature (363)..(390): n is a, c, g, or t
tcagatagagtactcacgaccggtgctcgatttagtctgacgtcaaaaggggaaaggggctggagtgggtggccaacaataaaccaagatggaagtgaacagtactatgtggactctgtggaagggccgattcaccatctccagagacaacgccaagaactcactgtcctcctcacgccctccaaccgaacggggcccatccgggttcccttccccccgtggcccgcccctgcctccgaggacgccaccgtccgagacgcacgacgccggcccgtgggctcgccgtggtacaaggtactacctttcccgaacggtgcgtgcgtggacggccgggctggaccgaagggtccacaagtgcnnncnnnnnnnnnnnnnnnnnnnnnnnnnnnn

SEQ ID NO: 117430 - DNA, 308 bp, Homo sapiens
  misc_feature: GYAE6OF01B53WH.29.30.C08.1.454.CMB.1.raw
  modified_base (274)..(274): a, c, t, g, unknown or other
  misc_feature (274)..(274): n is a, c, g, or t
  modified_base (288)..(288): a, c, t, g, unknown or other
  misc_feature (288)..(288): n is a, c, g, or t
  modified_base (305)..(308): a, c, t, g, unknown or other
  misc_feature (305)..(308): n is a, c, g, or t
tcagatagagtactcacgaccggtgctcgatttagtctgacgtcaaagggaaaggggcgtggaggtggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtancgtgctgagcgggntggcaaggcgtcatagnnnn

SEQ ID NO: 117431 - DNA, 366 bp, Homo sapiens
  misc_feature: GYAE6OF01BQPL9.29.30.C08.1.454.CMB.1.raw
  modified_base (354)..(366): a, c, t, g, unknown or other
  misc_feature (354)..(366): n is a, c, g, or t
tcagatagagtactcacgaccggtgctcgatttagtctgacgtcaaaggggaaaggggctggaggtggggtggccaacataaaccaagatggaagtgaacagtactatgtggactctgtgaagggccgattcaccatctccagagacaacgccaagaactcactgtctcctcacgcctaccaccgaacgggcccagtccggtcccttccccgtggccgcccgtgcctccgagggctccaccgtcgagagccacgacgccggcccgtggggctcggccgttggaccaagggtaccttacgttaccaggtacgcgtcgcgtggacggcgggtcgtcggacgaaggcgtacaagtgnnnnnnnnnnnnn

SEQ ID NO: 117432 - DNA, 439 bp, Homo sapiens
  misc_feature: GYAE6OF01D163R.29.30.C08.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (399)..(439): a, c, t, g, unknown or other
  misc_feature (399)..(439): n is a, c, g, or t
tcagatagagtactcacgaccggtgctcgatttagtctgacgtcaaaggggaaagggggctgggagtggggtggccaacataaaaccaagatggaagtgaacagtactatgtggactcgtgtaggaagggccgattcaccatctccgagagacaacgccaaagaactcactgtctcctcacgcctaccaaccgaacgggcccctagtccggtcccttccccccgtgggccncccctgcctaccgagggaccncacccgtccggagacgccaccgtacggcccggtcccggtgggccctacggccggttggtaacgaacgggtaacttacccttacgtaccggtagccgtcggccgtacggagggtcgggccgtagggacgaacgggccgacgtatagcnnnnnnnnnnnnnnnnnnnnnnnnnnnnnnnnnnnnnnnnn

SEQ ID NO: 117433 - DNA, 329 bp, Homo sapiens
  misc_feature: GYAE6OF01CNOX9.29.30.C08.1.454.CMB.1.raw
  modified_base (218)..(218): a, c, t, g, unknown or other
  misc_feature (218)..(218): n is a, c, g, or t
  modified_base (307)..(329): a, c, t, g, unknown or other
  misc_feature (307)..(329): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaaagaactcactgtctcctcagcctccaccgaggcccatcggtcttcccctggcgccctgctccaggancacctccgagagcacagccggccctgggctgcctggtacaaggctacttccacgtagcgtgctgagcgggctggcaaggcgctaatagnnnnnnnnnnnnnnnnnnnnnnn

SEQ ID NO: 117434 - DNA, 327 bp, Homo sapiens
  misc_feature: GYAE6OF01DT8ZQ.29.30.C08.1.454.CMB.1.raw
  modified_base (245)..(245): a, c, t, g, unknown or other
  misc_feature (245)..(245): n is a, c, g, or t
  modified_base (312)..(312): a, c, t, g, unknown or other
  misc_feature (312)..(312): n is a, c, g, or t
  modified_base (318)..(327): a, c, t, g, unknown or other
  misc_feature (318)..(327): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccgaagggcccatccggtccttccccctggccgccctgctccgaggacgccacctccgagacgcacgnggccggccctgggcctgccgtggtcaagactacttccacgtagcgtgctgagcgggctggcaaggcncatagnnnnnnnnnn

SEQ ID NO: 117435 - DNA, 312 bp, Homo sapiens
  misc_feature: GYAE6OF01EYWWN.29.30.C08.1.454.CMB.1.raw
  modified_base (301)..(301): a, c, t, g, unknown or other
  misc_feature (301)..(301): n is a, c, g, or t
  modified_base (307)..(312): a, c, t, g, unknown or other
  misc_feature (307)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcncatagnnnnnn

SEQ ID NO: 117436 - DNA, 302 bp, Homo sapiens
  misc_feature: GYAE6OF01CXX0S.29.30.C08.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (294)..(302): a, c, t, g, unknown or other
  misc_feature (294)..(302): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctcaccaggcccatcggtcttccctgcgcctgctccaggngcactcgagngcacagcgccctgggctgcctggtcaaggctactcacgtagcgtgctgagcgggctggcaaggcgacatagnnnnnnnnn

SEQ ID NO: 117437 - DNA, 331 bp, Homo sapiens
  misc_feature: GYAE6OF01DTMDY.29.30.C08.1.454.CMB.1.raw
  modified_base (317)..(331): a, c, t, g, unknown or other
  misc_feature (317)..(331): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggacgcacctccgagacgcacagcggccctgggctgccgtggtcaaggtacctacgttccagtagcgtgctggaggcgggtctgggacaagggcgcaatggnnnnnnnnnnnnnnn

SEQ ID NO: 117438 - DNA, 318 bp, Homo sapiens
  misc_feature: GYAE6OF01EH4V2.29.30.C08.1.454.CMB.1.raw
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (297)..(297): a, c, t, g, unknown or other
  misc_feature (297)..(297): n is a, c, g, or t
  modified_base (299)..(318): a, c, t, g, unknown or other
  misc_feature (299)..(318): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctcaccaaggcccatcgtcttccccnggcnccctgctcagncacctcgangcacngcgcctggntgcctggtcaaggactacttcacgtagcgttgctggagcgggctggcaagggcgcagtagnannnnnnnnnnnnnnnnnnnn

SEQ ID NO: 117439 - DNA, 311 bp, Homo sapiens
  misc_feature: GYAE6OF01DR4IT.29.30.C08.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcacttgtctcctcagcctccaccaaggcccatcggtcttcccctgccnccctgctcgaggagcacctcgagagcacgagccggccctgggctgcctggcaaggacttaccttccgacgtagcgtgctgaggcggntggcaaggcgcatgnnnnnn

SEQ ID NO: 117440 - DNA, 313 bp, Homo sapiens
  misc_feature: GYAE6OF01ENUP9.29.30.C08.1.454.CMB.1.raw
  modified_base (304)..(313): a, c, t, g, unknown or other
  misc_feature (304)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctcaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnn

SEQ ID NO: 117441 - DNA, 359 bp, Homo sapiens
  misc_feature: GYAE6OF01CAQ2C.29.30.C08.1.454.CMB.1.raw
  modified_base (333)..(359): a, c, t, g, unknown or other
  misc_feature (333)..(359): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcacgcctccaccaaacgggcccaatcggttccttcccccctgggccgcccctgctccgaggagccacctccgaagagcaacgacgcggccccgtgggctcgccgtggtacaaaggacctacttaccaagtacgcgtgctggagcggctaggcaagggcgcagtagnnnnnnnnnnnnnnnnnnnnnnnnnnn

SEQ ID NO: 117442 - DNA, 363 bp, Homo sapiens
  misc_feature: GYAE6OF01B2R03.29.30.C08.1.454.CMB.1.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
  modified_base (334)..(363): a, c, t, g, unknown or other
  misc_feature (334)..(363): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcacgcctccaccgaacgggcccattccggtccttccccctggccgccctgcctccagganccacctccgagacgcacaggccggcccgtgggcctgccgtggtcgaaggtactacttccagtacgcgtgctggacgcgggtctgggcaagggccnctaagtacggnnnnnnnnnnnnnnnnnnnnnnnnnnnnnn

SEQ ID NO: 117443 - DNA, 325 bp, Homo sapiens
  misc_feature: GYAE6OF01BVTX4.29.30.C08.1.454.CMB.1.raw
  modified_base (298)..(298): a, c, t, g, unknown or other
  misc_feature (298)..(298): n is a, c, g, or t
  modified_base (314)..(325): a, c, t, g, unknown or other
  misc_feature (314)..(325): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagacgcacagccggccccgtgggctggccctggtacaaggtactacttccacgtgcgtgctagaggcgggntggcaaggcgcagtgnnnnnnnnnnnn

SEQ ID NO: 117444 - DNA, 364 bp, Homo sapiens
  misc_feature: GYAE6OF01A2C6C.29.30.C08.1.454.CMB.1.raw
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (319)..(364): a, c, t, g, unknown or other
  misc_feature (319)..(364): n is a, c, g, or t
tcagatagagtactcacgaccggtgctcgatttagtctgacgtcaaagggaaaggggctggagtgggtggccaaacataaaccaagatggaagtgaacagtactatgtggactctgtgaagggccgattcaccatctccagagacaacgccaagaactcactgtctcctcagccctccaccaagggcccatcggtcttccccctggcgccctgctcaggngcacctccgagagcaacngccggccctggggcctgccgtggtaccaaggacctacttcccacgtagcgtgctgaggcggctggacaacgggcacgatgnnnnnnnnnnnnnnnnnnnnnnnnnnnnnnnnnnnnnnnnnnnnnn

SEQ ID NO: 117445 - DNA, 312 bp, Homo sapiens
  misc_feature: GYAE6OF01DULII.29.30.C08.1.454.CMB.1.raw
  modified_base (219)..(219): a, c, t, g, unknown or other
  misc_feature (219)..(219): n is a, c, g, or t
  modified_base (306)..(312): a, c, t, g, unknown or other
  misc_feature (306)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccagganaacctccgagagcacagccggccctgggctgcctggtcaaggactacttccacgtagcgtgctgagcgggctggcaaggcgcatagnnnnnnn

SEQ ID NO: 117446 - DNA, 403 bp, Homo sapiens
  misc_feature: GYAE6OF01BFMC2.29.30.C08.1.454.CMB.1.raw
  modified_base (228)..(228): a, c, t, g, unknown or other
  misc_feature (228)..(228): n is a, c, g, or t
  modified_base (359)..(359): a, c, t, g, unknown or other
  misc_feature (359)..(359): n is a, c, g, or t
  modified_base (361)..(362): a, c, t, g, unknown or other
  misc_feature (361)..(362): n is a, c, g, or t
  modified_base (364)..(403): a, c, t, g, unknown or other
  misc_feature (364)..(403): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccgaacggccctatccggtccttcccccgtggccgccctgcctccagggacnccacctccgagacgcactacggccggcccctgggaccttggaccctggggtacaaacggtaccttaccttcccgacggttacgcgttcgctggacgggccggggtactgggaccaagggcgtactaagtgncnncnnnnnnnnnnnnnnnnnnnnnnnnnnnnnnnnnnnnnnnn

SEQ ID NO: 117447 - DNA, 479 bp, Homo sapiens
  misc_feature: GYAE6OF01BTFGD.29.30.C08.1.454.CMB.1.raw
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (410)..(479): a, c, t, g, unknown or other
  misc_feature (410)..(479): n is a, c, g, or t
tcagatagagtactcacgaccggtgctcgatttagtctgacgtcaaaaggggaaaggggctgggagtgggtggccaacataaaaccaagatggaagtgaacagtactatgtggactctgtggaagggccgattcaccatctccagagacaacgccaagaactcactgtctcctcagccctccaccaacgggcccagtccggtccttccccctggccgtccctgcctccagggacgccacctccgaagacgccaacgacggccgggccccgtggggcctacggcccgttgggtaccgaaagggtaccttaccgtttacccgaacggtacggtccgttggccgttaggacggggccggggcgttacggggaacccgaaaaggggcccgtaacgtaagttaacggngcnangnnnnnnnnnnnnnnnnnnnnnnnnnnnnnnnnnnnnnnnnnnnnnnnnnnnnnnnnnnnnnnnnnnnnnn

SEQ ID NO: 117448 - DNA, 341 bp, Homo sapiens
  misc_feature: GYAE6OF01A0U6T.29.30.C08.1.454.CMB.1.raw
  modified_base (235)..(235): a, c, t, g, unknown or other
  misc_feature (235)..(235): n is a, c, g, or t
  modified_base (322)..(341): a, c, t, g, unknown or other
  misc_feature (322)..(341): n is a, c, g, or t
tcagatagagtactcacgaccggtgctcgatttagtctgacgtcaaagggaaaggggctggagtgggtggccaacataaaccaagatggaagtgacagtactatgtggactctgtgaagggccgattcaccatctccagagacaacgccaagaactcactgtctcctcagcctccaccaagggcccatcggtcttcccctggccgccctgctccaggcgcacctccgagagcacngccggcccgtgggctgcctggtacaaggctacttccacgtagcgtgccgtgacggccggggctcggggcgaacgggcgcgactaggnnnnnnnnnnnnnnnnnnnn

SEQ ID NO: 117449 - DNA, 455 bp, Homo sapiens
  misc_feature: GYAE6OF01EK6WA.29.30.C08.1.454.CMB.1.raw
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (391)..(392): a, c, t, g, unknown or other
  misc_feature (391)..(392): n is a, c, g, or t
  modified_base (394)..(455): a, c, t, g, unknown or other
  misc_feature (394)..(455): n is a, c, g, or t
tcagatagagtactcacgaccggtgctcgatttagtctgacgtcaaaaggggaaagggggctggagtggggtggccaacataaaaccaagatggaagtgaacagtactatgtggactctgtgaagggccgattcaccatctcagagacacgcaagactcactgtctcctcacgcctccaccgaacgggcccagtccggttccttccccccgtggcccggtcccctggcctccgagggacaccacccgtaccggagacgccacacggccgggtccccgtgggcctcgccgtgggtacaacggtacttaccttacccgacgttacgcgtcggctaggacggcggggtctacgggaacggagggtcccgactaagtacggctngtagcatnagnnannnnnnnnnnnnnnnnnnnnnnnnnnnnnnnnnnnnnnnnnnnnnnnnnnnnnnnnnnnnnn

SEQ ID NO: 117450 - DNA, 497 bp, Homo sapiens
  misc_feature: GYAE6OF01C8CT7.29.30.C08.1.454.CMB.1.raw
  modified_base (453)..(497): a, c, t, g, unknown or other
  misc_feature (453)..(497): n is a, c, g, or t
tcagatagagtactcacgaccggtgctcgatttagtctgacgtcaaaggggaaaggggctgggagtggggtggccaacataaaccaagatggaagtgaacagtactatgtggactctggtggaacgggccgattccaccatcctccagagacaacgccaaagaactcactgtcctcctcgacgccctccaaccgaacggggccccagttccggttccttccccccgtgggccgcccccttcggccgacccgagggactacccaccgtaccggagacgaccaacgacggtcccgggtcccggtgggtccgtccggtaccgtaggggttaccgaaaacgggttacccttaccgttaccgaaccgggttaggtcccggttgccggttaagggaccggggtccggggttaccgggtacgggactaaaccggggccgtaactaggaggcaggcctagnnnnnnnnnnnnnnnnnnnnnnnnnnnnnnnnnnnnnnnnnnnnn

SEQ ID NO: 117451 - DNA, 494 bp, Homo sapiens
  misc_feature: GYAE6OF01BALU4.29.30.C08.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (463)..(463): a, c, t, g, unknown or other
  misc_feature (463)..(463): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
tcagatagagtactcacgaccggtgctcgattttagtctgacgtcaaagggaaaggggtcgtggagtgggtggccaaccaggtaaaccaagatggaagtgaacagtactatcgtggactctgtgtaagggcccgtattcaccatcttccagagacaacgccaaagaacgtcactgtctcctcagcctcaccaagggcccatcggtcttcccctgccnccctgcctccaggngcncctcangcacagccgccctggcacgcgtgacaaggcttactaccagtgacgtgcgtagaggccgggaccgtgggacctaagggccgactaagttaggnagngnancgcgacgngacagnttcatcgcgaancgtctcgnaacttgcnctnccagcntcagtcctgcngancngcncagcngcacngncnccngcngttcgcngccngttcgtntctaaggctcaggtcntcggcggcgttgcgngaacncgnaagngngn

SEQ ID NO: 117452 - DNA, 423 bp, Homo sapiens
  misc_feature: GYAE6OF01DH4G1.29.30.C08.1.454.CMB.1.raw
  modified_base (388)..(388): a, c, t, g, unknown or other
  misc_feature (388)..(388): n is a, c, g, or t
  modified_base (390)..(423): a, c, t, g, unknown or other
  misc_feature (390)..(423): n is a, c, g, or t
tcagatagagtactcacgaccggtgctcgatttagtctgacgtcaaaggggaaaggggctgggagtgggtggccaacataaaccaagatggaagtgaacagtactatgtggactctgtgaagggccgattcaccatctccagagacaacgccaagaactcactgtcctcctcacgcctccaaccgacgggcccatccgggtccttcccccgtggccgccctgcctaccgaggacgccctacctcccggaggacgccaacacggcccggccccgtggggcctacggcccgttgggtaccgaaacggtacccttaccgtttcccgaacggtacggccggttcgccgtgggacggccggggtctcggggacgaacgggccgaacagtacgngnnnnnnnnnnnnnnnnnnnnnnnnnnnnnnnnnn

SEQ ID NO: 117453 - DNA, 524 bp, Homo sapiens
  misc_feature: GYAE6OF01ENJ6T.29.30.C08.1.454.CMB.1.raw
  modified_base (139)..(139): a, c, t, g, unknown or other
  misc_feature (139)..(139): n is a, c, g, or t
  modified_base (264)..(264): a, c, t, g, unknown or other
  misc_feature (264)..(264): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (454)..(456): a, c, t, g, unknown or other
  misc_feature (454)..(456): n is a, c, g, or t
  modified_base (458)..(458): a, c, t, g, unknown or other
  misc_feature (458)..(458): n is a, c, g, or t
  modified_base (460)..(461): a, c, t, g, unknown or other
  misc_feature (460)..(461): n is a, c, g, or t
  modified_base (463)..(464): a, c, t, g, unknown or other
  misc_feature (463)..(464): n is a, c, g, or t
  modified_base (466)..(476): a, c, t, g, unknown or other
  misc_feature (466)..(476): n is a, c, g, or t
  modified_base (478)..(524): a, c, t, g, unknown or other
  misc_feature (478)..(524): n is a, c, g, or t
tcagatagagtactcacgaccggtgctcgatttagtctgacgtcaaaaggggaaaggggctggagtggggtggccaacataaaccaagatggaagtgaacagtactatgtggactctgtgaacgggcccgtattcaccntcctccagagaccaacgccaagactcactgtcctccctcacgtccctcccaacgaacgggcccctagttcccgggttccctttccccccgtggccccggtccccctcgcccgtaccgacgggacnccccgtacccgttacccggagaccgaccaaccggaccgggcccccgggtcccgtggggtcctccggttaccggtcggtacggaacggttacccttacccgttacccgtacggtacggtcgtcggtcgtcgggacgggccgggtcgtacgggaaccggaacgggccggtaaccgnggtacgngctgancgnnncngnncnncnnnnnnnnnnncnnnnnnnnnnnnnnnnnnnnnnnnnnnnnnnnnnnnnnnnnnnnnnn

SEQ ID NO: 117454 - DNA, 194 bp, Homo sapiens
  misc_feature: GYAE6OF01CZAHV.29.30.C08.1.454.CMB.1.raw
  modified_base (165)..(165): a, c, t, g, unknown or other
  misc_feature (165)..(165): n is a, c, g, or t
  modified_base (186)..(194): a, c, t, g, unknown or other
  misc_feature (186)..(194): n is a, c, g, or t
tcagatagagtactcacgaccggtgctcgatttagtctgacgtcaaagggaaagggctggagtgggtggccaacataaaccaagatggaagtgaacagtactatgtggactctgtgaaggccgattcaccatctcagagacaacgcaagaactcactgtctcctnacgccacacgacgcagttccnnnnnnnnn

SEQ ID NO: 117455 - DNA, 625 bp, Homo sapiens
  misc_feature: GYAE6OF01BZIX4.29.30.C08.1.454.CMB.1.raw
  modified_base (145)..(145): a, c, t, g, unknown or other
  misc_feature (145)..(145): n is a, c, g, or t
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (372)..(372): a, c, t, g, unknown or other
  misc_feature (372)..(372): n is a, c, g, or t
  modified_base (376)..(377): a, c, t, g, unknown or other
  misc_feature (376)..(377): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
  modified_base (459)..(459): a, c, t, g, unknown or other
  misc_feature (459)..(459): n is a, c, g, or t
  modified_base (493)..(493): a, c, t, g, unknown or other
  misc_feature (493)..(493): n is a, c, g, or t
tcagatagagtactcacgaccggtgctcgatttagtctgacgtcaaagggaaaggggctggagtgggtggccaacataaaaccaagatggtaagtgaacagtactatgtggactctgtagaagggccgattcaccatctcagganacaacgctaagaactcactgttactcctcacgcctccaaccgaagggcccagtccggtcctttccccgnggtccgcccgtgctccgaggacgccaccgtccgaagacncaacgacgcccggtcccgtgggtcctgccgtaggtacgaacggttcctaccgttccaaggtacgcgttacgctaggacggccggtgtcgggacaaacggtccacgtagacggctgagtncggnngtnagtcgncggtgcgcgttntaacgctagttggaactgccgtaagttcgngaattccgaggttccacggtgtccttcgganctagacaaccgtggacttaccagtcctaaggtcnttaacggcaggttaacggtcaaccgtgagacgtggacttatccggctaaagggtccgaaccgttaaggcggtccggattacccgggtatcggtacttccggaccgtgggcctacgtaccgtttggaaccggg

SEQ ID NO: 117456 - DNA, 402 bp, Homo sapiens
  misc_feature: GYAE6OF01DN64S.29.30.C08.1.454.CMB.1.raw
  modified_base (376)..(402): a, c, t, g, unknown or other
  misc_feature (376)..(402): n is a, c, g, or t
tcagatagagtactcacgaccggtgctcgatttagtctgacgtcaaagggaaaggggctggaggtgggtggccaacataaaccaagatggaagtgaacagtactatgtggactctgtggaaggccgattcaccatctcagagacacgccaagaactcactgtcctcctcacgccctccaaccgaagggccccagtccggttcccttcccccgtgggcccgcccctgcctccgagggacgccaccgtccgagacgccgacgacggcccgggcccggtgggcctcggccggtcggtacgaaggtaccttaccttccgacgtacggcggtcgtcggtaggcggccgggacgtcgggacgtaacgggcgtacgagtaggnnnnnnnnnnnnnnnnnnnnnnnnnnn

SEQ ID NO: 117457 - DNA, 345 bp, Homo sapiens
  misc_feature: GYAE6OF01BDHE3.29.30.C08.1.454.CMB.1.raw
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
  modified_base (324)..(345): a, c, t, g, unknown or other
  misc_feature (324)..(345): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaaccgaagggccccagtccggtccttcccccgtggccgccctgcctccaggganccacctccggagagcacagccggccctgggctgcctggtacaaggctacttcccagtagcgtgctgaggcgggctggcaaggcgacatacgngnnnnnnnnnnnnnnnnnnnnnn

SEQ ID NO: 117458 - DNA, 354 bp, Homo sapiens
  misc_feature: GYAE6OF01EUEKQ.29.30.C08.1.454.CMB.1.raw
  modified_base (208)..(208): a, c, t, g, unknown or other
  misc_feature (208)..(208): n is a, c, g, or t
  modified_base (232)..(232): a, c, t, g, unknown or other
  misc_feature (232)..(232): n is a, c, g, or t
  modified_base (315)..(318): a, c, t, g, unknown or other
  misc_feature (315)..(318): n is a, c, g, or t
  modified_base (320)..(354): a, c, t, g, unknown or other
  misc_feature (320)..(354): n is a, c, g, or t
tcagatagagtactcacgaccggtgctcgattttagtctgacgtcaaaagggaaaggggctggagtgggtggccaacataaaaccaagatggaagtgaacagtactatgtggactctgtgaagggccgattcaccatctccagagacaacgccaagaactcactgtctcctcagcctccaccaagggcccatcggtcttcccctggcnccctgctcgaggagcacctcgagngcacaggccggcctgggctgcctgggtacaaggtctacttccacgtagcgtgctgagcgggctgggcaaggcgacattaggcnnnnannnnnnnnnnnnnnnnnnnnnnnnnnnnnnnnnnn

SEQ ID NO: 117459 - DNA, 397 bp, Homo sapiens
  misc_feature: GYAE6OF01DQPJI.29.30.C08.1.454.CMB.1.raw
  modified_base (220)..(220): a, c, t, g, unknown or other
  misc_feature (220)..(220): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (374)..(397): a, c, t, g, unknown or other
  misc_feature (374)..(397): n is a, c, g, or t
tcagatagagtactcacgaccggtgctcgatttagtctgacgtcaaagggaaggggctggagtgggtggccaacaataaaccaagatggaagtgaacagtactatgtggactctgtgaagggccgattcaccatctccagagacaacgccaagaactcactgtctccgtcacgcctccaaccgaacgggcccaagttccggttcccttcccccgtggccncccctgcctaccgaggacacctacccgtccgagacgccaacgtacgcccggtcccgtgggacctggtcccggtggtaacgaaggtacccttacgttacccgaaggtacggtcgtcggntacggaggcgggtntacggacgtaacgcgctanagnnnnnnnnnnnnnnnnnnnnnnnn

SEQ ID NO: 117460 - DNA, 381 bp, Homo sapiens
  misc_feature: GYAE6OF01DW1VT.29.30.C08.1.454.CMB.1.raw
  modified_base (352)..(352): a, c, t, g, unknown or other
  misc_feature (352)..(352): n is a, c, g, or t
  modified_base (354)..(381): a, c, t, g, unknown or other
  misc_feature (354)..(381): n is a, c, g, or t
tcagatagagtactcacgaccggtgctcgatttagtctgacgtcaaagggaaaggggctggagtgggtggccaacataaaccaagatggaagtgaacagtactatgtggactctggtgaagggccgattcaccatctccagagacaacgccaaagaactcactgtctcctcagcctccaaccgaagggccccagtccggtccctttcccccgtggccgccctgcctccagggacgccaccctccgagacgccacacggccggccctggggctcggcctggacaacggtacttaccttccgaacggtgcgtgtccgtggagggccgggatgggaccgaagggcgctagtacgntnnnnnnnnnnnnnnnnnnnnnnnnnnnn

SEQ ID NO: 117461 - DNA, 327 bp, Homo sapiens
  misc_feature: GYAE6OF01A46ND.29.30.C08.1.454.CMB.1.raw
  modified_base (314)..(327): a, c, t, g, unknown or other
  misc_feature (314)..(327): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtcctcctcagcctccaccaacgggccccatccggtccttccccctggccgcccctgctccaggagccaccctccgagagccacagccggccctgggctgcctggtcaaggctacttccacgtagcgtgctgagcgggctggcaggcgcatgnnnnnnnnnnnnnn

SEQ ID NO: 117462 - DNA, 337 bp, Homo sapiens
  misc_feature: GYAE6OF01AYQYC.29.30.C08.1.454.CMB.1.raw
  modified_base (222)..(222): a, c, t, g, unknown or other
  misc_feature (222)..(222): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (303)..(337): a, c, t, g, unknown or other
  misc_feature (303)..(337): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggancacctcgagagcacagcggcctgggctgctggcaagctactcagtancgtgntagagcgggctggacaaggtcgacatagnnnnnnnnnnnnnnnnnnnnnnnnnnnnnnnnnnn

SEQ ID NO: 117463 - DNA, 321 bp, Homo sapiens
  misc_feature: GYAE6OF01EWIPM.29.30.C08.1.454.CMB.1.raw
  modified_base (307)..(307): a, c, t, g, unknown or other
  misc_feature (307)..(307): n is a, c, g, or t
  modified_base (315)..(321): a, c, t, g, unknown or other
  misc_feature (315)..(321): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctggcctggtacaaggacttacttccacgtagcgtgctggagcgggctgggacaagggccncgataggnnnnnnn

SEQ ID NO: 117464 - DNA, 315 bp, Homo sapiens
  misc_feature: GYAE6OF01ENNZ6.29.30.C08.1.454.CMB.1.raw
  modified_base (220)..(220): a, c, t, g, unknown or other
  misc_feature (220)..(220): n is a, c, g, or t
  modified_base (305)..(315): a, c, t, g, unknown or other
  misc_feature (305)..(315): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtccttcccctggcgccctgctcaggancacctcgagagcacagccggccctgggctgcctggtcaaggactactccagtgcgtgctggagcgggctggacgaggcagatagnnnnnnnnnnn

SEQ ID NO: 117465 - DNA, 704 bp, Homo sapiens
  misc_feature: GYAE6OF01AIAKN.29.30.C08.1.454.CMB.1.raw
  modified_base (177)..(177): a, c, t, g, unknown or other
  misc_feature (177)..(177): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
tcagatagagtactcacgaccggtgctcgatttagtctgacgtcaaagggaaaggggctggagtgggtggccaacataaaccaagatggaagtgaacagtactattgtggactctggtggaacgggcgacttcaccatctcagagacaacggccaagactcactgtcctcctcgacncctacccgaccgacggccctagttccggttcctccccgtacggccgaccccttggaccctccgaagggacctccgacccgtccggaaagcgacccgacggtaccggtcccggtcccggttgggaaccgttccggtacccggtttggggtaaaccgaaaccggttaccttacccggttaccgtaaccggtacggtcgtacggtccggtcggacggcggtcgtacgggaacgacgggacgacgtacgtaggcacncggtancgtcgtaacncgtcaagngacgacttnaggccacgcgtcactacgtctacgtacgtctacgtacgtcgtacgcgtacgcgtacgtcgtcgtacgtacgtacgtacgtacgtacggtacgtacgtacgtactacgtacgacgtactacgttaccgtacgtacgtacgttactcgtactacgtactaccgcgtccgtacggtacggtaccgtacgtacgtacgtacgtacgcgtacactaactacgtacgtaccgtcgtacgtacgtacg

SEQ ID NO: 117466 - DNA, 424 bp, Homo sapiens
  misc_feature: GYAE6OF01DY7KA.29.30.C08.1.454.CMB.1.raw
  modified_base (267)..(267): a, c, t, g, unknown or other
  misc_feature (267)..(267): n is a, c, g, or t
  modified_base (372)..(373): a, c, t, g, unknown or other
  misc_feature (372)..(373): n is a, c, g, or t
  modified_base (375)..(424): a, c, t, g, unknown or other
  misc_feature (375)..(424): n is a, c, g, or t
tcagatagagtactcacgaccggtgctcgatttagtctgacgtcaaaggggaaaggggctggagtgggtggccaacataaaccaagatggaagtgaacagtactatgtggactctgtggaagggccgattcaccatctcagagacaacgcaagaactcactgtctcctcagcctccacgaacgggcccagtccggtccctttaccccgtggccgccctgcctccgaggcgaccaccctcggaagcgaccacgtacgcccgggtccgnggggcctcgcccggttgggtaacgaaggtaccttaccgttccgaagttacggccgtaggctgggacggcggggtctcgggaactaacggggcctacgaatggctnnannnnnnnnnnnnnnnnnnnnnnnnnnnnnnnnnnnnnnnnnnnnnnnnnn

SEQ ID NO: 117467 - DNA, 361 bp, Homo sapiens
  misc_feature: GYAE6OF01EWYG3.29.30.C08.1.454.CMB.1.raw
  modified_base (346)..(346): a, c, t, g, unknown or other
  misc_feature (346)..(346): n is a, c, g, or t
  modified_base (354)..(361): a, c, t, g, unknown or other
  misc_feature (354)..(361): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccgaacgggcccaatccggtcccttcccccgtggcccgccctgcctccgaggacgcccacctcccggaagacgccaacgacggccccggtccccgtaggggccttcgccgttggtaccaacggtacctacttccacgtagcgtgctggagccgggctggacgaaggcncgagtagnnnnnnnn

SEQ ID NO: 117468 - DNA, 419 bp, Homo sapiens
  misc_feature: GYAE6OF01ECYS4.29.30.C08.1.454.CMB.1.raw
  modified_base (141)..(141): a, c, t, g, unknown or other
  misc_feature (141)..(141): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (364)..(419): a, c, t, g, unknown or other
  misc_feature (364)..(419): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccattcaccatctccaganacaacgccaagaactcactgtctcctcagccctccaaccgaacgggcccatccggtccttcccccnggccnccctgctccaggactcaccctcgagacgcacgacggccggtccctgggctcgccgttaggcaaaggccttaccttcccgaaggttcgccggtatccgtggaggccgggtctggggccaaaggggcccgaagtagtaggctngctncgcnagnnnnnnnnnnnnnnnnnnnnnnnnnnnnnnnnnnnnnnnnnnnnnnnnnnnnnnnn

SEQ ID NO: 117469 - DNA, 430 bp, Homo sapiens
  misc_feature: GYAE6OF01BVFAL.29.30.C08.1.454.CMB.1.raw
  modified_base (237)..(237): a, c, t, g, unknown or other
  misc_feature (237)..(237): n is a, c, g, or t
  modified_base (369)..(370): a, c, t, g, unknown or other
  misc_feature (369)..(370): n is a, c, g, or t
  modified_base (375)..(430): a, c, t, g, unknown or other
  misc_feature (375)..(430): n is a, c, g, or t
tcagatagagtactcacgaccggtgctcgattttagtctgacgtcaaagggaaaggggctggagtgggtggccaacataaaccaagatggaagtgaacagtactatgtggactctgtgaagggccgattcaccatctccagagacaacgcaagactcactgtctcctcacgcctccaaccgaagggccccagttccggtccctttccccccgtggcccgccctgcctcccgagggcnccacctccgaggagcacgacggccggcccgtgggctcgccgtcggtacgaacggacttacctccgaacgttacggccgtaggccgtggacgggtccggggcgtcgggaccaaacgggccgcggtaatacggnngctgnnnnnnnnnnnnnnnnnnnnnnnnnnnnnnnnnnnnnnnnnnnnnnnnnnnnnnnn

SEQ ID NO: 117470 - DNA, 304 bp, Homo sapiens
  misc_feature: GYAE6OF02FHNUA.29.30.C08.1.454.CMB.1.raw
  modified_base (302)..(304): a, c, t, g, unknown or other
  misc_feature (302)..(304): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnn

SEQ ID NO: 117471 - DNA, 307 bp, Homo sapiens; identical to SEQ ID NO: 117094
  misc_feature: GYAE6OF02GBJ37.29.30.C08.1.454.CMB.1.raw
  modified_base (304)..(307): a, c, t, g, unknown or other
  misc_feature (304)..(307): n is a, c, g, or t

SEQ ID NO: 117472 - DNA, 309 bp, Homo sapiens; identical to SEQ ID NO: 117160
  misc_feature: GYAE6OF02IUX65.29.30.C08.1.454.CMB.1.raw
  modified_base (305)..(309): a, c, t, g, unknown or other
  misc_feature (305)..(309): n is a, c, g, or t

SEQ ID NO: 117473 - DNA, 308 bp, Homo sapiens
  misc_feature: GYAE6OF02FX1AW.29.30.C08.1.454.CMB.1.raw
  modified_base (303)..(308): a, c, t, g, unknown or other
  misc_feature (303)..(308): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnn

SEQ ID NO: 117474 - DNA, 309 bp, Homo sapiens; identical to SEQ ID NO: 117098
  misc_feature: GYAE6OF02I1W7E.29.30.C08.1.454.CMB.1.raw
  modified_base (304)..(309): a, c, t, g, unknown or other
  misc_feature (304)..(309): n is a, c, g, or t

SEQ ID NO: 117475 - DNA, 308 bp, Homo sapiens; identical to SEQ ID NO: 117129
  misc_feature: GYAE6OF02IRQM7.29.30.C08.1.454.CMB.1.raw
  modified_base (305)..(308): a, c, t, g, unknown or other
  misc_feature (305)..(308): n is a, c, g, or t

SEQ ID NO: 117476 - DNA, 306 bp, Homo sapiens; identical to SEQ ID NO: 117135
  misc_feature: GYAE6OF02GE1GR.29.30.C08.1.454.CMB.1.raw
  modified_base (304)..(306): a, c, t, g, unknown or other
  misc_feature (304)..(306): n is a, c, g, or t

SEQ ID NO: 117477 - DNA, 353 bp, Homo sapiens
  misc_feature: GYAE6OF02FTM7O.29.30.C08.1.454.CMB.1.raw
  modified_base (312)..(353): a, c, t, g, unknown or other
  misc_feature (312)..(353): n is a, c, g, or t
tcagatagagtactcacgaccggtgctcgatttagtctgacgtcaaagggaaaggggtcgtggaggtgggtggccaacataaaccaagatggaagtgaaccagtactatgtggactctggtgaacgggccgatttcaccatctccagagacaacgccaagaactcactgtctcctcagcctccaccaagggcccatcggtcttccccctggcgcccctgctcccaggagcacctccgagagcacagcggcctgggctgacctgtcaaggctactccagtagcgtgctgagcgggctggccaaggcgcatagnnnnnnnnnnnnnnnnnnnnnnnnnnnnnnnnnnnnnnnnnn

SEQ ID NO: 117478 - DNA, 308 bp, Homo sapiens; identical to SEQ ID NO: 117092
  misc_feature: GYAE6OF02GG7P5.29.30.C08.1.454.CMB.1.raw
  modified_base (304)..(308): a, c, t, g, unknown or other
  misc_feature (304)..(308): n is a, c, g, or t

SEQ ID NO: 117479 - DNA, 324 bp, Homo sapiens
  misc_feature: GYAE6OF02IVM9Y.29.30.C08.1.454.CMB.1.raw
  modified_base (282)..(282): a, c, t, g, unknown or other
  misc_feature (282)..(282): n is a, c, g, or t
  modified_base (308)..(324): a, c, t, g, unknown or other
  misc_feature (308)..(324): n is a, c, g, or t
tcagatagagtactcacgaccggtgctcgatttagtctgacgtcaaagggaaaggggctggagtgggtggcctaacataaaccaagattggaagtgaacagtactatgtggactctgtgaagggccgattcaccgatctccagagacaacggccaagaactcactgtctcctcagcctccaccaagggcccatcggtcttcccctggccgccctgctccaggagcacctccgagagcacagcggccctgggctgcctggtcaaggctactccacgtagcgtnctgagcgggctggcaaggcgcatagnnnnnnnnnnnnnnnnn

SEQ ID NO: 117480 - DNA, 306 bp, Homo sapiens
  misc_feature: GYAE6OF02IUREK.29.30.C08.1.454.CMB.1.raw
  modified_base (305)..(306): a, c, t, g, unknown or other
  misc_feature (305)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcggcctgctccaggagcacctccgagagcacagcggccctgggctgcctggtcaaggactacttccacgtagcgtgctgagcgggctggcaaggcgcatagnn

SEQ ID NO: 117481 - DNA, 308 bp, Homo sapiens
  misc_feature: GYAE6OF02HG4PF.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggacttcccctggcgccctgctccaagagcacctctgggggcacagcggccctgggctgcctggtcaaggactacttccacgtagcgtgctgagcgggctggcaaggcgcatagnnnnn

SEQ ID NO: 117482 - DNA, 308 bp, Homo sapiens; identical to SEQ ID NO: 117092
  misc_feature: GYAE6OF02I2FCE.29.30.C08.1.454.CMB.1.raw
  modified_base (304)..(308): a, c, t, g, unknown or other
  misc_feature (304)..(308): n is a, c, g, or t

SEQ ID NO: 117483 - DNA, 306 bp, Homo sapiens; identical to SEQ ID NO: 117135
  misc_feature: GYAE6OF02IVY8M.29.30.C08.1.454.CMB.1.raw
  modified_base (304)..(306): a, c, t, g, unknown or other
  misc_feature (304)..(306): n is a, c, g, or t

SEQ ID NO: 117484 - DNA, 315 bp, Homo sapiens
  misc_feature: GYAE6OF02FFW9I.29.30.C08.1.454.CMB.1.raw
  modified_base (304)..(315): a, c, t, g, unknown or other
  misc_feature (304)..(315): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggcctgggctgcctggtcaaggactacttccacgtagcgtgctgagcgggctggcaaggcgcatagnnnnnnnnnnnn

SEQ ID NO: 117485 - DNA, 308 bp, Homo sapiens; identical to SEQ ID NO: 117129
  misc_feature: GYAE6OF02GM8I2.29.30.C08.1.454.CMB.1.raw
  modified_base (305)..(308): a, c, t, g, unknown or other
  misc_feature (305)..(308): n is a, c, g, or t

SEQ ID NO: 117486 - DNA, 309 bp, Homo sapiens; identical to SEQ ID NO: 117160
  misc_feature: GYAE6OF02G07SM.29.30.C08.1.454.CMB.1.raw
  modified_base (305)..(309): a, c, t, g, unknown or other
  misc_feature (305)..(309): n is a, c, g, or t

SEQ ID NO: 117487 - DNA, 492 bp, Homo sapiens
  misc_feature: GYAE6OF02JK4IH.29.30.C08.1.454.CMB.1.raw
  modified_base (280)..(280): a, c, t, g, unknown or other
  misc_feature (280)..(280): n is a, c, g, or t
  modified_base (465)..(492): a, c, t, g, unknown or other
  misc_feature (465)..(492): n is a, c, g, or t
tcagatagagtactcacgaccggtgctcgatttagtctgacgtcaaagggaaaggggctggaatgggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggagttacaaggcatacttccaccactgggccgggcacctggtcagcgntctcctcacgcctccaccgaacgggcccagtccggtcccttccccgtggccaccctcctaccaagacgccacctcgtcgggggccacgacgcgacgcccgtgggctcgccgtggtacgaacgggaccttactccgacgtacgcgtcgctggacggcgggctcgggacgaacgggcgacagtagcnnnnnnnnnnnnnnnnnnnnnnnnnnnn

SEQ ID NO: 117488 - DNA, 308 bp, Homo sapiens; identical to SEQ ID NO: 117129
  misc_feature: GYAE6OF02IE4TB.29.30.C08.1.454.CMB.1.raw
  modified_base (305)..(308): a, c, t, g, unknown or other
  misc_feature (305)..(308): n is a, c, g, or t

SEQ ID NO: 117489 - DNA, 322 bp, Homo sapiens
  misc_feature: GYAE6OF02GS4G0.29.30.C08.1.454.CMB.1.raw
  modified_base (306)..(322): a, c, t, g, unknown or other
  misc_feature (306)..(322): n is a, c, g, or t
tcagatagagtactcacgaccggtgctcgatttagtctgacgtcaaagggaaaggggctggagtgggtggccaacataaaccaagatggaagtgaaccagtactatgtggactctgtgaagggccgattcaccatctccagagacaacgccaagaactcactgtctcctcagcctccaccaagggcccatcggtcttcccctggcgccctgctccaggagcacctccggagagcacagccgcctgggctgcctggtcaaggactacttccacgtagcgtgctgagcgggctggcaaggcgcatagnnnnnnnnnnnnnnnnn

SEQ ID NO: 117490 - DNA, 340 bp, Homo sapiens
  misc_feature: GYAE6OF02FZ0OY.29.30.C08.1.454.CMB.1.raw
  modified_base (315)..(340): a, c, t, g, unknown or other
  misc_feature (315)..(340): n is a, c, g, or t
tcagatagagtactcacgaccggtgctcgatttagtctgacgtcaaagggaaaggggctggagtgggtggccaacactaaaccaagatggaagtgaaccagtactatgtggactctgtgaagggccgattcaccatcctccagagacaacgccaaagaactcactgtctcctcagcctccaccaacgggcccatcggtcttcccctggcgaccctgcctcccaggacgcacctccggagagcacagcggccctgggctgcctggtcaaggaatactccacgtagcgtgctgacgcgggctggcaaggcgcatagnnnnnnnnnnnnnnnnnnnnnnnnnn

SEQ ID NO: 117491 - DNA, 309 bp, Homo sapiens
  misc_feature: GYAE6OF02GH04T.29.30.C08.1.454.CMB.1.raw
  modified_base (306)..(309): a, c, t, g, unknown or other
  misc_feature (306)..(309): n is a, c, g, or t
tcagatagagtactcacgaccggtgctcgatttagtctgacgtcaaagggaaagtggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcatagnnnn

SEQ ID NO: 117492 - DNA, 307 bp, Homo sapiens; identical to SEQ ID NO: 117110
  misc_feature: GYAE6OF02I88J0.29.30.C08.1.454.CMB.1.raw
  modified_base (305)..(307): a, c, t, g, unknown or other
  misc_feature (305)..(307): n is a, c, g, or t

SEQ ID NO: 117493 - DNA, 309 bp, Homo sapiens; identical to SEQ ID NO: 117232
  misc_feature: GYAE6OF02IUNHJ.29.30.C08.1.454.CMB.1.raw
  modified_base (304)..(309): a, c, t, g, unknown or other
  misc_feature (304)..(309): n is a, c, g, or t

SEQ ID NO: 117494 - DNA, 307 bp, Homo sapiens
  misc_feature: GYAE6OF02F38HH.29.30.C08.1.454.CMB.1.raw
  modified_base (303)..(307): a, c, t, g, unknown or other
  misc_feature (303)..(307): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnnn

SEQ ID NO: 117495 - DNA, 308 bp, Homo sapiens
  misc_feature: GYAE6OF02GAC33.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaaggcgcatagnnnnn

SEQ ID NO: 117496 - DNA, 691 bp, Homo sapiens
  misc_feature: GYAE6OF02J42MF.29.30.C08.1.454.CMB.1.raw
  modified_base (184)..(184): a, c, t, g, unknown or other
  misc_feature (184)..(184): n is a, c, g, or t
  modified_base (654)..(654): a, c, t, g, unknown or other
  misc_feature (654)..(654): n is a, c, g, or t
  modified_base (656)..(691): a, c, t, g, unknown or other
  misc_feature (656)..(691): n is a, c, g, or t
tcagatagagtactcacgaccggtgctcgatttagtctgacgtcaaagggaaagggctggaatgggtctcaagtattgctggtagtggtgatagcacatacacgcagccagtcgtcggacggcctcaccagtccacggaggactagttacaacactactattgttacagaactaagtacgaacncgccgtaggacggtacgacggacgtaccgtaccggttacttaattacgttcgtcggtccgtccgttaccgttaccgaccgggttagggtaacggttagggaaccttaccgacggtacccttaaccgtaccccggtaccgaacccgggtcggggtcccgggtacccgtacctccggtcggtccgtaccgtccccgtcctacccgacccgtaccccgtaccccgtaacccggtaacccggtacccgttccctacccggtttcccccgttccccgtacccgaccgtacccctacccgtaccgacggaacggcccgtcccgtaccggggcggaccggacccacgtccggccgtccggtccggtacggtccgtaccggtaccgtaacggtaaccgtaaccgttcccttaccggtacggacggtcggccggtcggacggtacgggaccgggtccggtacgacggacgacgttcagngnnnnnnnnnnnnnnnnnnnnnnnnnnnnnnnnnnnn

SEQ ID NO: 117497 - DNA, 308 bp, Homo sapiens
  misc_feature: GYAE6OF02I1O0L.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcatcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 117498 - DNA, 421 bp, Homo sapiens
  misc_feature: GYAE6OF02G60CC.29.30.C08.1.454.CMB.1.raw
  modified_base (374)..(374): a, c, t, g, unknown or other
  misc_feature (374)..(374): n is a, c, g, or t
  modified_base (377)..(421): a, c, t, g, unknown or other
  misc_feature (377)..(421): n is a, c, g, or t
tcagatagagtactcacgaccggtgctcgatttagtctgacgtcaaagggaaagggggcctggagtgggtggccaacataaaccaagatggaagtgaacagtacttatagtggtactctgtgaagggccgattcacccatcgtccgagaggacaacggccaagaactcaacttagtctcctcgagcctaaccaccaaagggcccctaatccggtccttcccccgtgggaccggcccccttgtcctacccaaggacgccaaccgtccggaagaacgccaacgacgccgggcccctggggctggcctggtaccaaggtcctaacgttccacggtagacggtcgcgtgacgcgggcctgggccaaggtcgcagtagnccnnnnnnnnnnnnnnnnnnnnnnnnnnnnnnnnnnnnnnnnnnnnn

SEQ ID NO: 117499 - DNA, 315 bp, Homo sapiens
  misc_feature: GYAE6OF02GKRXP.29.30.C08.1.454.CMB.1.raw
  modified_base (306)..(315): a, c, t, g, unknown or other
  misc_feature (306)..(315): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcttccaccaaggacccatcggtcttccccctggcgccctgctccaggagcacctccgagagcacagccgccctgggctgcctggtcaaggactacttccacgtagcgtgctgagcgggctggcaaggcgcatagnnnnnnnnnn

SEQ ID NO: 117500 - DNA, 306 bp, Homo sapiens; identical to SEQ ID NO: 117135
  misc_feature: GYAE6OF02GGTSX.29.30.C08.1.454.CMB.1.raw
  modified_base (304)..(306): a, c, t, g, unknown or other
  misc_feature (304)..(306): n is a, c, g, or t

SEQ ID NO: 117501 - DNA, 308 bp, Homo sapiens; identical to SEQ ID NO: 117092
  misc_feature: GYAE6OF02GSNJD.29.30.C08.1.454.CMB.1.raw
  modified_base (304)..(308): a, c, t, g, unknown or other
  misc_feature (304)..(308): n is a, c, g, or t

SEQ ID NO: 117502 - DNA, 306 bp, Homo sapiens; identical to SEQ ID NO: 117135
  misc_feature: GYAE6OF02F261D.29.30.C08.1.454.CMB.1.raw
  modified_base (304)..(306): a, c, t, g, unknown or other
  misc_feature (304)..(306): n is a, c, g, or t

SEQ ID NO: 117503 - DNA, 307 bp, Homo sapiens; identical to SEQ ID NO: 117094
  misc_feature: GYAE6OF02G1RSB.29.30.C08.1.454.CMB.1.raw
  modified_base (304)..(307): a, c, t, g, unknown or other
  misc_feature (304)..(307): n is a, c, g, or t

SEQ ID NO: 117504 - DNA, 304 bp, Homo sapiens; identical to SEQ ID NO: 117470
  misc_feature: GYAE6OF02GUI4R.29.30.C08.1.454.CMB.1.raw
  modified_base (302)..(304): a, c, t, g, unknown or other
  misc_feature (302)..(304): n is a, c, g, or t

SEQ ID NO: 117505 - DNA, 307 bp, Homo sapiens; identical to SEQ ID NO: 117233
  misc_feature: GYAE6OF02HGRQ2.29.30.C08.1.454.CMB.1.raw
  modified_base (304)..(307): a, c, t, g, unknown or other
  misc_feature (304)..(307): n is a, c, g, or t

SEQ ID NO: 117506 - DNA, 309 bp, Homo sapiens; identical to SEQ ID NO: 117098
  misc_feature: GYAE6OF02I9RM1.29.30.C08.1.454.CMB.1.raw
  modified_base (304)..(309): a, c, t, g, unknown or other
  misc_feature (304)..(309): n is a, c, g, or t

SEQ ID NO: 117507 - DNA, 303 bp, Homo sapiens
  misc_feature: GYAE6OF02H2XV7.29.30.C08.1.454.CMB.1.raw
  modified_base (301)..(303): a, c, t, g, unknown or other
  misc_feature (301)..(303): n is a, c, g, or t
tcagatagagtactcacgaccggtgctcgatttagtctgacgtcaaagggaaagggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcggctggcaaggcgcatagnnn

SEQ ID NO: 117508 - DNA, 306 bp, Homo sapiens
  misc_feature: GYAE6OF02H6XXX.29.30.C08.1.454.CMB.1.raw
  modified_base (305)..(306): a, c, t, g, unknown or other
  misc_feature (305)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnn

SEQ ID NO: 117509 - DNA, 310 bp, Homo sapiens; identical to SEQ ID NO: 117127
  misc_feature: GYAE6OF02G4W8H.29.30.C08.1.454.CMB.1.raw
  modified_base (305)..(310): a, c, t, g, unknown or other
  misc_feature (305)..(310): n is a, c, g, or t

SEQ ID NO: 117510 - DNA, 306 bp, Homo sapiens; identical to SEQ ID NO: 117508
  misc_feature: GYAE6OF02GL8YS.29.30.C08.1.454.CMB.1.raw
  modified_base (305)..(306): a, c, t, g, unknown or other
  misc_feature (305)..(306): n is a, c, g, or t

SEQ ID NO: 117511 - DNA, 309 bp, Homo sapiens; identical to SEQ ID NO: 117098
  misc_feature: GYAE6OF02GF0LY.29.30.C08.1.454.CMB.1.raw
  modified_base (304)..(309): a, c, t, g, unknown or other
  misc_feature (304)..(309): n is a, c, g, or t

SEQ ID NO: 117512 - DNA, 309 bp, Homo sapiens; identical to SEQ ID NO: 117160
  misc_feature: GYAE6OF02HDFDP.29.30.C08.1.454.CMB.1.raw
  modified_base (305)..(309): a, c, t, g, unknown or other
  misc_feature (305)..(309): n is a, c, g, or t

SEQ ID NO: 117513 - DNA, 306 bp, Homo sapiens; identical to SEQ ID NO: 117508
  misc_feature: GYAE6OF02H7WZ4.29.30.C08.1.454.CMB.1.raw
  modified_base (305)..(306): a, c, t, g, unknown or other
  misc_feature (305)..(306): n is a, c, g, or t

SEQ ID NO: 117514 - DNA, 316 bp, Homo sapiens
  misc_feature: GYAE6OF02GYRXP.29.30.C08.1.454.CMB.1.raw
  modified_base (278)..(278): a, c, t, g, unknown or other
  misc_feature (278)..(278): n is a, c, g, or t
  modified_base (304)..(316): a, c, t, g, unknown or other
  misc_feature (304)..(316): n is a, c, g, or t
tcagatagagtactcacgaccggtgctcgatttagtctgacgtcaaagggaagggctggagtgggtaggcaacataaaccaagatggaagtgaacagtactatgtggactctgtgaaggccgattcaccatctccagacgacaacggccaaagaactcactgtctcctcagcctcaccaagggcccatcggtcttcccctggcgccctgctccaggagcacctccgagagcacagcggccctgggctgcctggtcaaggactacttccacgtagcgtnctgagcgggctggcaaggcgcatagnnnnnnnnnnnnn

SEQ ID NO: 117515 - DNA, 307 bp, Homo sapiens; identical to SEQ ID NO: 117094
  misc_feature: GYAE6OF02HVG1S.29.30.C08.1.454.CMB.1.raw
  modified_base (304)..(307): a, c, t, g, unknown or other
  misc_feature (304)..(307): n is a, c, g, or t

SEQ ID NO: 117516 - DNA, 308 bp, Homo sapiens; identical to SEQ ID NO: 117129
  misc_feature: GYAE6OF02II2AK.29.30.C08.1.454.CMB.1.raw
  modified_base (305)..(308): a, c, t, g, unknown or other
  misc_feature (305)..(308): n is a, c, g, or t

SEQ ID NO: 117517 - DNA, 317 bp, Homo sapiens
  misc_feature: GYAE6OF02JMSTW.29.30.C08.1.454.CMB.1.raw
  modified_base (306)..(317): a, c, t, g, unknown or other
  misc_feature (306)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtctcccctggcgccctgctccaggagcaccctccgagacgcacagccggccctgggctgcctggtcaaggctacttccacgtagcgtgctgagcgggctggcaaggcgcagtagnnnnnnnnnnnn

SEQ ID NO: 117518 - DNA, 310 bp, Homo sapiens; identical to SEQ ID NO: 117127
  misc_feature: GYAE6OF02HJ29P.29.30.C08.1.454.CMB.1.raw
  modified_base (305)..(310): a, c, t, g, unknown or other
  misc_feature (305)..(310): n is a, c, g, or t

SEQ ID NO: 117519 - DNA, 308 bp, Homo sapiens; identical to SEQ ID NO: 117129
  misc_feature: GYAE6OF02G3DHS.29.30.C08.1.454.CMB.1.raw
  modified_base (305)..(308): a, c, t, g, unknown or other
  misc_feature (305)..(308): n is a, c, g, or t

SEQ ID NO: 117520 - DNA, 306 bp, Homo sapiens
  misc_feature: GYAE6OF02G02SM.29.30.C08.1.454.CMB.1.raw
  modified_base (303)..(306): a, c, t, g, unknown or other
  misc_feature (303)..(306): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcccgtagcgtgctgagcgggctggcaaggcgcatagnnnn

SEQ ID NO: 117521 - DNA, 308 bp, Homo sapiens; identical to SEQ ID NO: 117092
  misc_feature: GYAE6OF02I97BJ.29.30.C08.1.454.CMB.1.raw
  modified_base (304)..(308): a, c, t, g, unknown or other
  misc_feature (304)..(308): n is a, c, g, or t

SEQ ID NO: 117522 - DNA, 307 bp, Homo sapiens; identical to SEQ ID NO: 117094
  misc_feature: GYAE6OF02HED1Z.29.30.C08.1.454.CMB.1.raw
  modified_base (304)..(307): a, c, t, g, unknown or other
  misc_feature (304)..(307): n is a, c, g, or t

SEQ ID NO: 117523 - DNA, 310 bp, Homo sapiens; identical to SEQ ID NO: 117127
  misc_feature: GYAE6OF02IOW58.29.30.C08.1.454.CMB.1.raw
  modified_base (305)..(310): a, c, t, g, unknown or other
  misc_feature (305)..(310): n is a, c, g, or t

SEQ ID NO: 117524 - DNA, 309 bp, Homo sapiens; identical to SEQ ID NO: 117160
  misc_feature: GYAE6OF02IXKCH.29.30.C08.1.454.CMB.1.raw
  modified_base (305)..(309): a, c, t, g, unknown or other
  misc_feature (305)..(309): n is a, c, g, or t

SEQ ID NO: 117525 - DNA, 310 bp, Homo sapiens; identical to SEQ ID NO: 117127
  misc_feature: GYAE6OF02IZD6Z.29.30.C08.1.454.CMB.1.raw
  modified_base (305)..(310): a, c, t, g, unknown or other
  misc_feature (305)..(310): n is a, c, g, or t

SEQ ID NO: 117526 - DNA, 526 bp, Homo sapiens
  misc_feature: GYAE6OF02GXTHV.29.30.C08.1.454.CMB.1.raw
  modified_base (258)..(258): a, c, t, g, unknown or other
  misc_feature (258)..(258): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
  modified_base (504)..(504): a, c, t, g, unknown or other
  misc_feature (504)..(504): n is a, c, g, or t
  modified_base (524)..(524): a, c, t, g, unknown or other
  misc_feature (524)..(524): n is a, c, g, or t
tcagatagagtactcacgaccggtgctcgatttagtctgacgtcaaagggaaaggggctggggaggtgggtaggccgaacagtaaaccaagggatggaagtagaacaggtacttatgtgggacctcgtgttgaagggtccgattctaccatctccgagagacaacggccaacgaacgtcactgtctctcacgcctccaccaagggcccactcggtcttcccctggccgccctggctccagggacgccacctccgaagngcacacgcggcccctgggactgtacctggtctaacggactaacttccaacgtagcgtgtctcgagcgggctagggccaaagggcgcgacttacggagctgctcattcgngcagtcgacgagtccggcngacgntcngngngngcgcgngngagntcncncncacncncancncncngcgngngagagangtgntattatntntanatatatatntatgtgtcgtcgacgacgacgtagtagtatanagacgacgacgtgtcgtcgngc

SEQ ID NO: 117527 - DNA, 398 bp, Homo sapiens
  misc_feature: GYAE6OF02GPMXN.29.30.C08.1.454.CMB.1.raw
  modified_base (339)..(342): a, c, t, g, unknown or other
  misc_feature (339)..(342): n is a, c, g, or t
  modified_base (344)..(398): a, c, t, g, unknown or other
  misc_feature (344)..(398): n is a, c, g, or t
tcagatagagtactcacgaccggtgctcgatttagtctgacgtcaaagggtaaagggggtcggtggagtgggtcggccaacagtaaaccaagatggaagtgaacagtactagtcgtggactctgtcgaaggggccgacttcaccatctccaggagaccaacggcccaagaacttcactgtctccctactagccctccaccaacgggcccactccggtcttccccctggcgccctgcttccaggagcacctccgacgagcacagccggccctgggctggccctggtcaaggactacttccacgtagcgtgctgagcgggactgggcaaggccgcatagcnnnngnnnnnnnnnnnnnnnnnnnnnnnnnnnnnnnnnnnnnnnnnnnnnnnnnnnnnnn

SEQ ID NO: 117528 - DNA, 306 bp, Homo sapiens; identical to SEQ ID NO: 117135
  misc_feature: GYAE6OF02GLK4G.29.30.C08.1.454.CMB.1.raw
  modified_base (304)..(306): a, c, t, g, unknown or other
  misc_feature (304)..(306): n is a, c, g, or t

SEQ ID NO: 117529 - DNA, 306 bp, Homo sapiens; identical to SEQ ID NO: 117135
  misc_feature: GYAE6OF02G48BT.29.30.C08.1.454.CMB.1.raw
  modified_base (304)..(306): a, c, t, g, unknown or other
  misc_feature (304)..(306): n is a, c, g, or t

SEQ ID NO: 117530 - DNA, 317 bp, Homo sapiens
  misc_feature: GYAE6OF02GW73P.29.30.C08.1.454.CMB.1.raw
  modified_base (306)..(317): a, c, t, g, unknown or other
  misc_feature (306)..(317): n is a, c, g, or t
tcagatagagtactcacgaccggtgctcgatttagtctgacgtcaaagggaaaggggctggagtgggtggccaacataaaccaagatggaagtgaaccagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggaatacttccacgtagcgtgctgagcgggctggcaaggcgcatagnnnnnnnnnnnn

SEQ ID NO: 117531 - DNA, 305 bp, Homo sapiens
  misc_feature: GYAE6OF02GTJZI.29.30.C08.1.454.CMB.1.raw
  modified_base (303)..(305): a, c, t, g, unknown or other
  misc_feature (303)..(305): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnn

SEQ ID NO: 117532 - DNA, 308 bp, Homo sapiens; identical to SEQ ID NO: 117495
  misc_feature: GYAE6OF02FJKRS.29.30.C08.1.454.CMB.1.raw
  modified_base (304)..(308): a, c, t, g, unknown or other
  misc_feature (304)..(308): n is a, c, g, or t

SEQ ID NO: 117533 - DNA, 330 bp, Homo sapiens
  misc_feature: GYAE6OF02HQHF4.29.30.C08.1.454.CMB.1.raw
  modified_base (310)..(330): a, c, t, g, unknown or other
  misc_feature (310)..(330): n is a, c, g, or t
tcagatagagtactcacgaccggtgctcgatttagtctgacgtcaaagggaaaggggctggagtgggtcggccaaacataaaccaacgatggaagtgaacagtactatgtggactctgtgaagggccgattcaccatctccagagacaacgccaagaactcactgtctcctcagcctccaccaagggcccatcggtcttccccctggcgccctgcgtccaggagcacctccgagagcacagcggccctgggctgcctggtcaaggctacttccacgtagcgtgctgagcgggctggcaaggcgcataggnnnnnnnnnnnnnnnnnnnnn

SEQ ID NO: 117534 - DNA, 309 bp, Homo sapiens; identical to SEQ ID NO: 117098
  misc_feature: GYAE6OF02FU6QN.29.30.C08.1.454.CMB.1.raw
  modified_base (304)..(309): a, c, t, g, unknown or other
  misc_feature (304)..(309): n is a, c, g, or t

SEQ ID NO: 117535 - DNA, 315 bp, Homo sapiens
  misc_feature: GYAE6OF02IQ18Z.29.30.C08.1.454.CMB.1.raw
  modified_base (307)..(315): a, c, t, g, unknown or other
  misc_feature (307)..(315): n is a, c, g, or t
tcagatagagtactcacgaccggtgctcgatttagtctgacgtcaaagggaaagggctggagtgggtaggccaaccataaaccaagatcggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggccaaggcgcatagnnnnnnnnn

SEQ ID NO: 117536 - DNA, 307 bp, Homo sapiens
  misc_feature: GYAE6OF02HYRBU.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcgggctggcaaggcgcatagnnnn

SEQ ID NO: 117537 - DNA, 339 bp, Homo sapiens
  misc_feature: GYAE6OF02FFUJ7.29.30.C08.1.454.CMB.1.raw
  modified_base (245)..(245): a, c, t, g, unknown or other
  misc_feature (245)..(245): n is a, c, g, or t
  modified_base (324)..(339): a, c, t, g, unknown or other
  misc_feature (324)..(339): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatccggtccttcccccgtggccgccctgctccgaggacgccacctccgagacgcaccgnggccgtccgtgggctgccgtggtacaaggtcctactccagtagcgtgctggacggccgggctgggcaagggtcacatgnnnnnnnnnnnnnnnn

SEQ ID NO: 117538 - DNA, 308 bp, Homo sapiens
  misc_feature: GYAE6OF02HRVYT.29.30.C08.1.454.CMB.1.raw
  modified_base (303)..(308): a, c, t, g, unknown or other
  misc_feature (303)..(308): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnn

SEQ ID NO: 117539 - DNA, 306 bp, Homo sapiens; identical to SEQ ID NO: 117508
  misc_feature: GYAE6OF02H9K0K.29.30.C08.1.454.CMB.1.raw
  modified_base (305)..(306): a, c, t, g, unknown or other
  misc_feature (305)..(306): n is a, c, g, or t

SEQ ID NO: 117540 - DNA, 307 bp, Homo sapiens; identical to SEQ ID NO: 117110
  misc_feature: GYAE6OF02HN65S.29.30.C08.1.454.CMB.1.raw
  modified_base (305)..(307): a, c, t, g, unknown or other
  misc_feature (305)..(307): n is a, c, g, or t

SEQ ID NO: 117541 - DNA, 309 bp, Homo sapiens; identical to SEQ ID NO: 117160
  misc_feature: GYAE6OF02H99HK.29.30.C08.1.454.CMB.1.raw
  modified_base (305)..(309): a, c, t, g, unknown or other
  misc_feature (305)..(309): n is a, c, g, or t

SEQ ID NO: 117542 - DNA, 311 bp, Homo sapiens; identical to SEQ ID NO: 117240
  misc_feature: GYAE6OF02JBXD4.29.30.C08.1.454.CMB.1.raw
  modified_base (305)..(311): a, c, t, g, unknown or other
  misc_feature (305)..(311): n is a, c, g, or t

SEQ ID NO: 117543 - DNA, 309 bp, Homo sapiens; identical to SEQ ID NO: 117160
  misc_feature: GYAE6OF02GW4J0.29.30.C08.1.454.CMB.1.raw
  modified_base (305)..(309): a, c, t, g, unknown or other
  misc_feature (305)..(309): n is a, c, g, or t

SEQ ID NO: 117544 - DNA, 342 bp, Homo sapiens
  misc_feature: GYAE6OF02INMYS.29.30.C08.1.454.CMB.1.raw
  modified_base (319)..(319): a, c, t, g, unknown or other
  misc_feature (319)..(319): n is a, c, g, or t
  modified_base (321)..(342): a, c, t, g, unknown or other
  misc_feature (321)..(342): n is a, c, g, or t
tcagatagagtactcacgaccggtgctcgatttagtctgacgtcaaagggaaaggggctggagtgggtggaccaacactaaaccgaagatggaagtgaacagtactatgtggactctgtgaagggcccgatttcaccatctccagagacaacgccaagaactcacctggtctcctcagcctccaccaagggcccaatcggtcttccccctggccgccctgctccaggacgcacctccgagagcacagcggccctgggctgcctggtcaaggactacgttccacgtagccgtcgctgagcgggctggcaaggcgcatagncnnnnnnnnnnnnnnnnnnnnnn

SEQ ID NO: 117545 - DNA, 571 bp, Homo sapiens
  misc_feature: GYAE6OF02GI3VK.29.30.C08.1.454.CMB.1.raw
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
  modified_base (493)..(493): a, c, t, g, unknown or other
  misc_feature (493)..(493): n is a, c, g, or t
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (545)..(571): a, c, t, g, unknown or other
  misc_feature (545)..(571): n is a, c, g, or t
tcagatagagtactcacgaccggtgctcgatttagtctgacgtcaaaaggggaaaagggggcctcggtagtcgggttgggcccaaacggactaaaaccaagaaattggtaaaggtgaaacagtaactaaacttggtcggacgttcctggtgaaaaacgggtccggacttcgacccactcgtccacgagacaacgtccgaagaactcactcgtcgtccctcaggccctccacccaaagggccccgtatcggtcgttccccctggggccgcccgtgctccctaggacgtccaccctcccgaagtacgcgaccaaggccgggcccggtcgggctaggcccttgggtccaaaggacctaacgtttcccaacgttaagccggttgacttgaaagtcggggtcgttcgggtcccaaaaggggtttcccggcctaagttaaaccggttcgccaaggacncgactgganattaacgaatgtggctgcacactctgtctctntcttccccncactctgactactactatctgngcggcgtgngacgcgnanagnnnnnnnnnnnnnnnnnnnnnnnnnnn

SEQ ID NO: 117546 - DNA, 305 bp, Homo sapiens; identical to SEQ ID NO: 117091
  misc_feature: GYAE6OF02HOU9U.29.30.C08.1.454.CMB.1.raw
  modified_base (304)..(305): a, c, t, g, unknown or other
  misc_feature (304)..(305): n is a, c, g, or t

SEQ ID NO: 117547 - DNA, 308 bp, Homo sapiens
  misc_feature: GYAE6OF02HOTV7.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcgggctggcaaggcgcatagnnnnn

SEQ ID NO: 117548 - DNA, 307 bp, Homo sapiens
  misc_feature: GYAE6OF02H8AMM.29.30.C08.1.454.CMB.1.raw
  modified_base (305)..(307): a, c, t, g, unknown or other
  misc_feature (305)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcaccctcctccaagagcacctctgggggcacagcagccctgggctgcctggtcaaggactacttccacgtagcgtgctgagcgggctggcaaggcgcatagnnn

SEQ ID NO: 117549 - DNA, 306 bp, Homo sapiens; identical to SEQ ID NO: 117508
  misc_feature: GYAE6OF02HZ3AP.29.30.C08.1.454.CMB.1.raw
  modified_base (305)..(306): a, c, t, g, unknown or other
  misc_feature (305)..(306): n is a, c, g, or t

SEQ ID NO: 117550 - DNA, 308 bp, Homo sapiens; identical to SEQ ID NO: 117203
  misc_feature: GYAE6OF02ID170.29.30.C08.1.454.CMB.1.raw
  modified_base (304)..(308): a, c, t, g, unknown or other
  misc_feature (304)..(308): n is a, c, g, or t

SEQ ID NO: 117551 - DNA, 313 bp, Homo sapiens
  misc_feature: GYAE6OF02GV7IT.29.30.C08.1.454.CMB.1.raw
  modified_base (305)..(313): a, c, t, g, unknown or other
  misc_feature (305)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnn

SEQ ID NO: 117552 - DNA, 307 bp, Homo sapiens
  misc_feature: GYAE6OF02IGGRJ.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcaccctcctccaagagcacctctgggggcacagcagccctgggctgcctggtcaaggactacttccacgtagcggctgagcgggctggcaaggcgcatagnnnn

SEQ ID NO: 117553 - DNA, 310 bp, Homo sapiens; identical to SEQ ID NO: 117166
  misc_feature: GYAE6OF02GDUJL.29.30.C08.1.454.CMB.1.raw
  modified_base (306)..(310): a, c, t, g, unknown or other
  misc_feature (306)..(310): n is a, c, g, or t

SEQ ID NO: 117554 - DNA, 310 bp, Homo sapiens; identical to SEQ ID NO: 117133
  misc_feature: GYAE6OF02GXPBG.29.30.C08.1.454.CMB.1.raw
  modified_base (304)..(310): a, c, t, g, unknown or other
  misc_feature (304)..(310): n is a, c, g, or t

SEQ ID NO: 117555 - DNA, 306 bp, Homo sapiens; identical to SEQ ID NO: 117508
  misc_feature: GYAE6OF02H76VF.29.30.C08.1.454.CMB.1.raw
  modified_base (305)..(306): a, c, t, g, unknown or other
  misc_feature (305)..(306): n is a, c, g, or t

SEQ ID NO: 117556 - DNA, 310 bp, Homo sapiens; identical to SEQ ID NO: 117127
  misc_feature: GYAE6OF02HFHMP.29.30.C08.1.454.CMB.1.raw
  modified_base (305)..(310): a, c, t, g, unknown or other
  misc_feature (305)..(310): n is a, c, g, or t

SEQ ID NO: 117557 - DNA, 337 bp, Homo sapiens
  misc_feature: GYAE6OF02FPP8C.29.30.C08.1.454.CMB.1.raw
  modified_base (309)..(310): a, c, t, g, unknown or other
  misc_feature (309)..(310): n is a, c, g, or t
  modified_base (312)..(337): a, c, t, g, unknown or other
  misc_feature (312)..(337): n is a, c, g, or t
tcagatagagtactcacgaccggtgctcgatttagtctgacgtcaaagggaaagggggcgtgggagtgggtggccaacataaacccaaggatggaagtgaacagtactatgtggactctgtcgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccagtagcgtgctgagcgggctggcaaggcgcatagnngnnnnnnnnnnnnnnnnnnnnnnnnnn

SEQ ID NO: 117558 - DNA, 356 bp, Homo sapiens
  misc_feature: GYAE6OF02I9AV8.29.30.C08.1.454.CMB.1.raw
  modified_base (172)..(172): a, c, t, g, unknown or other
  misc_feature (172)..(172): n is a, c, g, or t
  modified_base (205)..(205): a, c, t, g, unknown or other
  misc_feature (205)..(205): n is a, c, g, or t
  modified_base (329)..(356): a, c, t, g, unknown or other
  misc_feature (329)..(356): n is a, c, g, or t
tcagatagagtactcacgaccggtgctcgatttagtctgacgtcaaagggaaaggggctggagtgggtggccaaccataaaccaaggatggaaggtgaacagtactatgtggactctgtggaagggccgattcaccatcctcagagacaacgcaagaactcactgtctcctnagcctccaccgaagggcccatcggtcttccccnggccgccctgcctccgaggacgccaccgtccgaagagccaactagccggccctggggctgactggtacaaggactacttccacgtagcgtgctgaggcgggctcggcaaggcgacaagtaggcnnnnnnnnnnnnnnnnnnnnnnnnnnnn

SEQ ID NO: 117559 - DNA, 305 bp, Homo sapiens; identical to SEQ ID NO: 117091
  misc_feature: GYAE6OF02HX6FT.29.30.C08.1.454.CMB.1.raw
  modified_base (304)..(305): a, c, t, g, unknown or other
  misc_feature (304)..(305): n is a, c, g, or t

SEQ ID NO: 117560 - DNA, 428 bp, Homo sapiens
  misc_feature: GYAE6OF02HJ4BV.29.30.C08.1.454.CMB.1.raw
  modified_base (423)..(428): a, c, t, g, unknown or other
  misc_feature (423)..(428): n is a, c, g, or t
tcagatagagtactcacgaccggtgctcgatttagtctgacgtcaaagggaaaggggctggagtggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactactccacgtagcgtgctgagcgggctggcaaggcgcatagnnnnnn

SEQ ID NO: 117561 - DNA, 308 bp, Homo sapiens; identical to SEQ ID NO: 117129
  misc_feature: GYAE6OF02H1XO8.29.30.C08.1.454.CMB.1.raw
  modified_base (305)..(308): a, c, t, g, unknown or other
  misc_feature (305)..(308): n is a, c, g, or t

SEQ ID NO: 117562 - DNA, 310 bp, Homo sapiens; identical to SEQ ID NO: 117166
  misc_feature: GYAE6OF02G1VYK.29.30.C08.1.454.CMB.1.raw
  modified_base (306)..(310): a, c, t, g, unknown or other
  misc_feature (306)..(310): n is a, c, g, or t

SEQ ID NO: 117563 - DNA, 306 bp, Homo sapiens; identical to SEQ ID NO: 117508
  misc_feature: GYAE6OF02ICJGG.29.30.C08.1.454.CMB.1.raw
  modified_base (305)..(306): a, c, t, g, unknown or other
  misc_feature (305)..(306): n is a, c, g, or t

SEQ ID NO: 117564 - DNA, 308 bp, Homo sapiens; identical to SEQ ID NO: 117129
  misc_feature: GYAE6OF02F86KJ.29.30.C08.1.454.CMB.1.raw
  modified_base (305)..(308): a, c, t, g, unknown or other
  misc_feature (305)..(308): n is a, c, g, or t

SEQ ID NO: 117565 - DNA, 306 bp, Homo sapiens
  misc_feature: GYAE6OF02FRRW3.29.30.C08.1.454.CMB.1.raw
  modified_base (304)..(306): a, c, t, g, unknown or other
  misc_feature (304)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtacgtgctgagcgggctggcaaggcgcatagnnn

SEQ ID NO: 117566 - DNA, 314 bp, Homo sapiens
  misc_feature: GYAE6OF02H7HY6.29.30.C08.1.454.CMB.1.raw
  modified_base (307)..(314): a, c, t, g, unknown or other
  misc_feature (307)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtggaagggccgattcaccatctccagagacaacgccaagaactcactgtctcctcagcctccaccaagggcccatccggtcttcccctggcgccctgctccaggagcacctccgagagcacagcggccctgggctgcctggtcaaggactacttccacgtagcgtgctgagcgggctggcaaggcgcatagnnnnnnnn

SEQ ID NO: 117567 - DNA, 309 bp, Homo sapiens; identical to SEQ ID NO: 117160
  misc_feature: GYAE6OF02FKW98.29.30.C08.1.454.CMB.1.raw
  modified_base (305)..(309): a, c, t, g, unknown or other
  misc_feature (305)..(309): n is a, c, g, or t

SEQ ID NO: 117568 - DNA, 308 bp, Homo sapiens; identical to SEQ ID NO: 117129
  misc_feature: GYAE6OF02H85UF.29.30.C08.1.454.CMB.1.raw
  modified_base (305)..(308): a, c, t, g, unknown or other
  misc_feature (305)..(308): n is a, c, g, or t

SEQ ID NO: 117569 - DNA, 309 bp, Homo sapiens; identical to SEQ ID NO: 117160
  misc_feature: GYAE6OF02GQ9U0.29.30.C08.1.454.CMB.1.raw
  modified_base (305)..(309): a, c, t, g, unknown or other
  misc_feature (305)..(309): n is a, c, g, or t

SEQ ID NO: 117570 - DNA, 313 bp, Homo sapiens
  misc_feature: GYAE6OF02I5E3X.29.30.C08.1.454.CMB.1.raw
  modified_base (301)..(313): a, c, t, g, unknown or other
  misc_feature (301)..(313): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcaccctcctccaagacgcacctctggggcacagcagcctgggctgcctggtcaaggctacttccacgtagcgtgctgagcggctggcaggcgcgatagnnnnnnnnnnnnn

SEQ ID NO: 117571 - DNA, 328 bp, Homo sapiens
  misc_feature: GYAE6OF02GJ365.29.30.C08.1.454.CMB.1.raw
  modified_base (282)..(282): a, c, t, g, unknown or other
  misc_feature (282)..(282): n is a, c, g, or t
  modified_base (310)..(328): a, c, t, g, unknown or other
  misc_feature (310)..(328): n is a, c, g, or t
tcagatagagtactcacgaccggtgctcgatttagtctgacgtcaaagggaaagggggcgtggagtgggtcggccaacataaaccaagatggaagtgaacagtactactgtggactctgtgaaggccgattcaccatctccagagacaacgccaagaactcactgtctcctcagcctccaccaagggcccatcggtctcccctggcgccctgctccaggagcacctccggagagcacagcggccctgggctgcctggtcaaggactactcccacgtagcgtncctgacgcgggctggcaaggcgcatagnnnnnnnnnnnnnnnnnnn

SEQ ID NO: 117572 - DNA, 307 bp, Homo sapiens; identical to SEQ ID NO: 117110
  misc_feature: GYAE6OF02GO8GP.29.30.C08.1.454.CMB.1.raw
  modified_base (305)..(307): a, c, t, g, unknown or other
  misc_feature (305)..(307): n is a, c, g, or t

SEQ ID NO: 117573 - DNA, 307 bp, Homo sapiens; identical to SEQ ID NO: 117110
  misc_feature: GYAE6OF02HC4SY.29.30.C08.1.454.CMB.1.raw
  modified_base (305)..(307): a, c, t, g, unknown or other
  misc_feature (305)..(307): n is a, c, g, or t

SEQ ID NO: 117574 - DNA, 321 bp, Homo sapiens
  misc_feature: GYAE6OF02JJP86.29.30.C08.1.454.CMB.1.raw
  modified_base (308)..(321): a, c, t, g, unknown or other
  misc_feature (308)..(321): n is a, c, g, or t
tcagatagagtactcacgaccggtgctcgatttagtctgacgtcaaagggaaaggggcgtggagtgggtggccaacataaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagccacagcggccctgggctggcctggtacaaggctacttccacgtagcgtgctgagcgggctaggcaaggcgcatacgnnnnnnnnnnnnnn

SEQ ID NO: 117575 - DNA, 311 bp, Homo sapiens; identical to SEQ ID NO: 117240
  misc_feature: GYAE6OF02GENC1.29.30.C08.1.454.CMB.1.raw
  modified_base (305)..(311): a, c, t, g, unknown or other
  misc_feature (305)..(311): n is a, c, g, or t

SEQ ID NO: 117576 - DNA, 310 bp, Homo sapiens; identical to SEQ ID NO: 117127
  misc_feature: GYAE6OF02GBXOO.29.30.C08.1.454.CMB.1.raw
  modified_base (305)..(310): a, c, t, g, unknown or other
  misc_feature (305)..(310): n is a, c, g, or t

SEQ ID NO: 117577 - DNA, 308 bp, Homo sapiens; identical to SEQ ID NO: 117288
  misc_feature: GYAE6OF02HO6SC.29.30.C08.1.454.CMB.1.raw
  modified_base (306)..(308): a, c, t, g, unknown or other
  misc_feature (306)..(308): n is a, c, g, or t

SEQ ID NO: 117578 - DNA, 308 bp, Homo sapiens
  misc_feature: GYAE6OF02IMYRI.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggagctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnn

SEQ ID NO: 117579 - DNA, 308 bp, Homo sapiens; identical to SEQ ID NO: 117129
  misc_feature: GYAE6OF02H3X3S.29.30.C08.1.454.CMB.1.raw
  modified_base (305)..(308): a, c, t, g, unknown or other
  misc_feature (305)..(308): n is a, c, g, or t

SEQ ID NO: 117580 - DNA, 309 bp, Homo sapiens; identical to SEQ ID NO: 117160
  misc_feature: GYAE6OF02G3OJY.29.30.C08.1.454.CMB.1.raw
  modified_base (305)..(309): a, c, t, g, unknown or other
  misc_feature (305)..(309): n is a, c, g, or t

SEQ ID NO: 117581 - DNA, 316 bp, Homo sapiens
  misc_feature: GYAE6OF02HXQVU.29.30.C08.1.454.CMB.1.raw
  modified_base (305)..(316): a, c, t, g, unknown or other
  misc_feature (305)..(316): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnnn

SEQ ID NO: 117582 - DNA, 403 bp, Homo sapiens
  misc_feature: GYAE6OF02F8ELP.29.30.C08.1.454.CMB.1.raw
  modified_base (319)..(319): a, c, t, g, unknown or other
  misc_feature (319)..(319): n is a, c, g, or t
  modified_base (325)..(326): a, c, t, g, unknown or other
  misc_feature (325)..(326): n is a, c, g, or t
  modified_base (328)..(328): a, c, t, g, unknown or other
  misc_feature (328)..(328): n is a, c, g, or t
  modified_base (330)..(331): a, c, t, g, unknown or other
  misc_feature (330)..(331): n is a, c, g, or t
  modified_base (333)..(339): a, c, t, g, unknown or other
  misc_feature (333)..(339): n is a, c, g, or t
  modified_base (341)..(403): a, c, t, g, unknown or other
  misc_feature (341)..(403): n is a, c, g, or t
tcagatagagtactcacgaccggtgctcgatttagtctgacgtcaaagggaaagggggtcgtggagtgggtggccgtaacattaaaccaagattggaagtgaacagtactatgtggactctgtgaagggccgattcgaccatctccagagacgaacgccaagaactcactgtctcctcagcctccgaccaaacgggccccaatacggtcttccccctggcgccctgctccaggagcacctccgagaggcacagcggccctgggctagcctggtcaaggctaacttccacgtagcgtagctgagcgggctggacaaggcncatagnngnannannnnnnnannnnnnnnnnnnnnnnnnnnnnnnnnnnnnnnnnnnnnnnnnnnnnnnnnnnnnnnnnnnnnn

SEQ ID NO: 117583 - DNA, 308 bp, Homo sapiens; identical to SEQ ID NO: 117129
  misc_feature: GYAE6OF02GY4GA.29.30.C08.1.454.CMB.1.raw
  modified_base (305)..(308): a, c, t, g, unknown or other
  misc_feature (305)..(308): n is a, c, g, or t

SEQ ID NO: 117584 - DNA, 385 bp, Homo sapiens
  misc_feature: GYAE6OF02I2XPQ.29.30.C08.1.454.CMB.1.raw
  modified_base (313)..(317): a, c, t, g, unknown or other
  misc_feature (313)..(317): n is a, c, g, or t
  modified_base (319)..(319): a, c, t, g, unknown or other
  misc_feature (319)..(319): n is a, c, g, or t
  modified_base (328)..(385): a, c, t, g, unknown or other
  misc_feature (328)..(385): n is a, c, g, or t
tcagatagagtactcacgaccggtgctcgatttagtctgacgtcaaagggaaagggggctggaggtgggtagggccaaccataaaccaagatcggaagtgaacagtactatgtggactctgtgaaggccgattcaccatctccagagacaacgccaagaactcactgtctcctcagcctccaccaagggcccatcggtcttcccctggcgccctgctccaggagcgacctccgagagcacagccggccctgggctgcctggtcaaggactacttccacgtagcgtgctgagcgggctgggcaaggcgcatagnnnnntnatgcgatannnnnnnnnnnnnnnnnnnnnnnnnnnnnnnnnnnnnnnnnnnnnnnnnnnnnnnnnn

SEQ ID NO: 117585 - DNA, 307 bp, Homo sapiens; identical to SEQ ID NO: 117104
  misc_feature: GYAE6OF02ICD6I.29.30.C08.1.454.CMB.1.raw
  modified_base (303)..(307): a, c, t, g, unknown or other
  misc_feature (303)..(307): n is a, c, g, or t

SEQ ID NO: 117586 - DNA, 308 bp, Homo sapiens
  misc_feature: GYAE6OF02IN82M.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggactacttccacgtagcgtgctgagcgggctggcaaggcgcatagnnnnn

SEQ ID NO: 117587 - DNA, 308 bp, Homo sapiens; identical to SEQ ID NO: 117203
  misc_feature: GYAE6OF02HSMGW.29.30.C08.1.454.CMB.1.raw
  modified_base (304)..(308): a, c, t, g, unknown or other
  misc_feature (304)..(308): n is a, c, g, or t

SEQ ID NO: 117588 - DNA, 308 bp, Homo sapiens; identical to SEQ ID NO: 117129
  misc_feature: GYAE6OF02IB40F.29.30.C08.1.454.CMB.1.raw
  modified_base (305)..(308): a, c, t, g, unknown or other
  misc_feature (305)..(308): n is a, c, g, or t

SEQ ID NO: 117589 - DNA, 333 bp, Homo sapiens
  misc_feature: GYAE6OF02ISRC5.29.30.C08.1.454.CMB.1.raw
  modified_base (293)..(293): a, c, t, g, unknown or other
  misc_feature (293)..(293): n is a, c, g, or t
  modified_base (308)..(333): a, c, t, g, unknown or other
  misc_feature (308)..(333): n is a, c, g, or t
tcagatagagtactcacgaccggtgctcgatttagtctgacgtcaaagggaaagggctggagtgggtggccaacagtaaaccaagatggaagtgaacagtactatgtggactctgtgaaggccgattcaccatctccagagacaacgccaagaactcgactgtctccttcagcctccacctaagggcccatcggtcttcccctggcgccctgctccaggagcgacctccgagagcacagcggccctgggctgcctggtcaaggactacttccacgtagcgtgctgagcgggtntggcaggcgcatagnnnnnnnnnnnnnnnnnnnnnnnnnn

SEQ ID NO: 117590 - DNA, 311 bp, Homo sapiens
  misc_feature: GYAE6OF02JLKD5.29.30.C08.1.454.CMB.1.raw
  modified_base (305)..(311): a, c, t, g, unknown or other
  misc_feature (305)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggactactccacgtagcgtgctgagcgggctggcaaggcgcatagnnnnnnn

SEQ ID NO: 117591 - DNA, 309 bp, Homo sapiens
  misc_feature: GYAE6OF02G7XNC.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagccacctccgagagcacagcggccctgggctgcctggtcaggctacttccacgtagcgtgctgagcgggctggcaaggcgcatagnnnnnn

SEQ ID NO: 117592 - DNA, 308 bp, Homo sapiens; identical to SEQ ID NO: 117129
  misc_feature: GYAE6OF02IM659.29.30.C08.1.454.CMB.1.raw
  modified_base (305)..(308): a, c, t, g, unknown or other
  misc_feature (305)..(308): n is a, c, g, or t

SEQ ID NO: 117593 - DNA, 334 bp, Homo sapiens
  misc_feature: GYAE6OF02JG59I.29.30.C08.1.454.CMB.1.raw
  modified_base (220)..(220): a, c, t, g, unknown or other
  misc_feature (220)..(220): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (317)..(334): a, c, t, g, unknown or other
  misc_feature (317)..(334): n is a, c, g, or t
tcagatagagtactcacgaccggtgctcgatttagtctgacgtcaaagggaaagggctggagtgggtggccaacataaaccaagatggaagtgaacagtactatgtaggactctgtgaagggccgattcaccatctccagagacaacgccaagaactcactgtctcctcagcctcaccaagggcccatcggtcttcccctggcgccctgcctccaggacnccacctccgagacgcacagcggccctgggctgcctggtcaagactactccacgtagcgtgcnggacncggggcctaggggccaagggcgcgataggnnnnnnnnnnnnnnnnnn

SEQ ID NO: 117594 - DNA, 309 bp, Homo sapiens
  misc_feature: GYAE6OF02G7SPG.29.30.C08.1.454.CMB.1.raw
  modified_base (303)..(309): a, c, t, g, unknown or other
  misc_feature (303)..(309): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttcacgtagcgtgctgagcgggctggcaaggcgcatagnnnnnnn

SEQ ID NO: 117595 - DNA, 333 bp, Homo sapiens
  misc_feature: GYAE6OF02I12LM.29.30.C08.1.454.CMB.1.raw
  modified_base (227)..(227): a, c, t, g, unknown or other
  misc_feature (227)..(227): n is a, c, g, or t
  modified_base (282)..(282): a, c, t, g, unknown or other
  misc_feature (282)..(282): n is a, c, g, or t
  modified_base (311)..(333): a, c, t, g, unknown or other
  misc_feature (311)..(333): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgngacgcacacgcggcccgtcggcgtcgcctggtcaaggactacttccacgtagcgngctgagcgggcgtggcgaaggcgcatagnnnnnnnnnnnnnnnnnnnnnnn

SEQ ID NO: 117596 - DNA, 310 bp, Homo sapiens
  misc_feature: GYAE6OF02GV1D1.29.30.C08.1.454.CMB.1.raw
  modified_base (289)..(289): a, c, t, g, unknown or other
  misc_feature (289)..(289): n is a, c, g, or t
  modified_base (305)..(310): a, c, t, g, unknown or other
  misc_feature (305)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggntggcaaggcgcatagnnnnnn

SEQ ID NO: 117597 - DNA, 308 bp, Homo sapiens; identical to SEQ ID NO: 117129
  misc_feature: GYAE6OF02I43V9.29.30.C08.1.454.CMB.1.raw
  modified_base (305)..(308): a, c, t, g, unknown or other
  misc_feature (305)..(308): n is a, c, g, or t

SEQ ID NO: 117598 - DNA, 305 bp, Homo sapiens
  misc_feature: GYAE6OF02FJ454.29.30.C08.1.454.CMB.1.raw
  modified_base (304)..(305): a, c, t, g, unknown or other
  misc_feature (304)..(305): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactattccacgtagcgtgctgagcgggctggcaaggcgcatagnn

SEQ ID NO: 117599 - DNA, 307 bp, Homo sapiens; identical to SEQ ID NO: 117094
  misc_feature: GYAE6OF02FYW3J.29.30.C08.1.454.CMB.1.raw
  modified_base (304)..(307): a, c, t, g, unknown or other
  misc_feature (304)..(307): n is a, c, g, or t

SEQ ID NO: 117600 - DNA, 309 bp, Homo sapiens; identical to SEQ ID NO: 117160
  misc_feature: GYAE6OF02GLTH1.29.30.C08.1.454.CMB.1.raw
  modified_base (305)..(309): a, c, t, g, unknown or other
  misc_feature (305)..(309): n is a, c, g, or t

SEQ ID NO: 117601 - DNA, 328 bp, Homo sapiens
  misc_feature: GYAE6OF02IK5VP.29.30.C08.1.454.CMB.1.raw
  modified_base (224)..(224): a, c, t, g, unknown or other
  misc_feature (224)..(224): n is a, c, g, or t
  modified_base (310)..(328): a, c, t, g, unknown or other
  misc_feature (310)..(328): n is a, c, g, or t
tcagatagagtactcacgaccggtgctcgatttagtctgacgtcaaagggaaagggggctgggagtgggtggccaacataaaccaagatggaagtgaacagtactatgtggactctgtgaagggccgattcaccatctccagagacaacgccaagaacgtcactgtctcctcagcctccaccaacgggcccatccggtcttcccctggcgccctgctccaggancacctcgagagcacagcggccctgggctgctggtcaaggctactcacgtagccgtagctgagcgggactcggcaaggcgacatagnnnnnnnnnnnnnnnnnnn

SEQ ID NO: 117602 - DNA, 307 bp, Homo sapiens; identical to SEQ ID NO: 117110
  misc_feature: GYAE6OF02I6X42.29.30.C08.1.454.CMB.1.raw
  modified_base (305)..(307): a, c, t, g, unknown or other
  misc_feature (305)..(307): n is a, c, g, or t

SEQ ID NO: 117603 - DNA, 343 bp, Homo sapiens
  misc_feature: GYAE6OF02IT4L0.29.30.C08.1.454.CMB.1.raw
  modified_base (319)..(319): a, c, t, g, unknown or other
  misc_feature (319)..(319): n is a, c, g, or t
  modified_base (321)..(343): a, c, t, g, unknown or other
  misc_feature (321)..(343): n is a, c, g, or t
tcagatagagtactcacgaccggtgctcgatttagtctgacgtcaaagggaaagggggtcgtggagtgggtcggccgaaacataaaaccaagattggaagtgaacagtactatgtggactctgtgaaggccgattcaccatctccagagacaacgccaagaactcacttgtctcctcagtacctccaccaagggcccatcggtcttcccctggcgccctgcgtccaggagcacctccgagagcacagcggccctgggctgcctggtcaaggactacttccacgtagcgtgctgagcgggctgggccaaggcgcagtagngnnnnnnnnnnnnnnnnnnnnnnn

SEQ ID NO: 117604 - DNA, 305 bp, Homo sapiens
  misc_feature: GYAE6OF02IL79Y.29.30.C08.1.454.CMB.1.raw
  modified_base (304)..(305): a, c, t, g, unknown or other
  misc_feature (304)..(305): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatagnn

SEQ ID NO: 117605 - DNA, 309 bp, Homo sapiens; identical to SEQ ID NO: 117160
  misc_feature: GYAE6OF02GX01P.29.30.C08.1.454.CMB.1.raw
  modified_base (305)..(309): a, c, t, g, unknown or other
  misc_feature (305)..(309): n is a, c, g, or t

SEQ ID NO: 117606 - DNA, 309 bp, Homo sapiens
  misc_feature: GYAE6OF02H2I60.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtgaccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 117607 - DNA, 312 bp, Homo sapiens; identical to SEQ ID NO: 117301
  misc_feature: GYAE6OF02I8QVW.29.30.C08.1.454.CMB.1.raw
  modified_base (306)..(312): a, c, t, g, unknown or other
  misc_feature (306)..(312): n is a, c, g, or t

SEQ ID NO: 117608 - DNA, 309 bp, Homo sapiens
  misc_feature: GYAE6OF02H5P0Z.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnn

SEQ ID NO: 117609 - DNA, 323 bp, Homo sapiens
  misc_feature: GYAE6OF02G7WQE.29.30.C08.1.454.CMB.1.raw
  modified_base (306)..(323): a, c, t, g, unknown or other
  misc_feature (306)..(323): n is a, c, g, or t
tcagatagagtactcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgcctccaggagcacctccgagagcacagcggccctgggctgcctggtcaaggctacttccacgtagcgtgctgagcgggctggcaaggcgcatagnnnnnnnnnnnnnnnnnn

SEQ ID NO: 117610 - DNA, 328 bp, Homo sapiens
  misc_feature: GYAE6OF02FOJ7A.29.30.C08.1.454.CMB.1.raw
  modified_base (309)..(328): a, c, t, g, unknown or other
  misc_feature (309)..(328): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcgactgtctcctcagcctccaccaagggcccatcggtcttcccctggcgccctgctccaggagcaccgtccgagagcacagcggccctgggctggcctggtcaaggctacttccacgtagcgtgctgagcggggctgggcaagggcgcatagnnnnnnnnnnnnnnnnnnnn

SEQ ID NO: 117611 - DNA, 311 bp, Homo sapiens; identical to SEQ ID NO: 117270
  misc_feature: GYAE6OF02IZ06G.29.30.C08.1.454.CMB.1.raw
  modified_base (306)..(311): a, c, t, g, unknown or other
  misc_feature (306)..(311): n is a, c, g, or t

SEQ ID NO: 117612 - DNA, 308 bp, Homo sapiens; identical to SEQ ID NO: 117129
  misc_feature: GYAE6OF02JDSNZ.29.30.C08.1.454.CMB.1.raw
  modified_base (305)..(308): a, c, t, g, unknown or other
  misc_feature (305)..(308): n is a, c, g, or t

SEQ ID NO: 117613 - DNA, 316 bp, Homo sapiens
  misc_feature: GYAE6OF02HN9QH.29.30.C08.1.454.CMB.1.raw
  modified_base (306)..(316): a, c, t, g, unknown or other
  misc_feature (306)..(316): n is a, c, g, or t
tcagatagagtactcacgaccggtgctcgatttagtctgacgtcaaagggaaagggctggagtgggtggccaacataaaccaagatggaagtgaacagtactatgtgggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggacctacttccacgtagcgtgctgagcgggctggcaaggcgcatagnnnnnnnnnnn

SEQ ID NO: 117614 - DNA, 308 bp, Homo sapiens; identical to SEQ ID NO: 117129
  misc_feature: GYAE6OF02HB5OX.29.30.C08.1.454.CMB.1.raw
  modified_base (305)..(308): a, c, t, g, unknown or other
  misc_feature (305)..(308): n is a, c, g, or t

SEQ ID NO: 117615 - DNA, 308 bp, Homo sapiens
  misc_feature: GYAE6OF02IRVJY.29.30.C08.1.454.CMB.1.raw
  modified_base (306)..(308): a, c, t, g, unknown or other
  misc_feature (306)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctggcaaggcgcatagnnn

SEQ ID NO: 117616 - DNA, 309 bp, Homo sapiens; identical to SEQ ID NO: 117160
  misc_feature: GYAE6OF02HJ33G.29.30.C08.1.454.CMB.1.raw
  modified_base (305)..(309): a, c, t, g, unknown or other
  misc_feature (305)..(309): n is a, c, g, or t

SEQ ID NO: 117617 - DNA, 309 bp, Homo sapiens; identical to SEQ ID NO: 117160
  misc_feature: GYAE6OF02F4NGA.29.30.C08.1.454.CMB.1.raw
  modified_base (305)..(309): a, c, t, g, unknown or other
  misc_feature (305)..(309): n is a, c, g, or t

SEQ ID NO: 117618 - DNA, 309 bp, Homo sapiens; identical to SEQ ID NO: 117232
  misc_feature: GYAE6OF02GL75Y.29.30.C08.1.454.CMB.1.raw
  modified_base (304)..(309): a, c, t, g, unknown or other
  misc_feature (304)..(309): n is a, c, g, or t

SEQ ID NO: 117619 - DNA, 309 bp, Homo sapiens; identical to SEQ ID NO: 117160
  misc_feature: GYAE6OF02HT77T.29.30.C08.1.454.CMB.1.raw
  modified_base (305)..(309): a, c, t, g, unknown or other
  misc_feature (305)..(309): n is a, c, g, or t

SEQ ID NO: 117620 - DNA, 305 bp, Homo sapiens
  misc_feature: GYAE6OF02FGGFQ.29.30.C08.1.454.CMB.1.raw
  modified_base (304)..(305): a, c, t, g, unknown or other
  misc_feature (304)..(305): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcatagnn

SEQ ID NO: 117621 - DNA, 309 bp, Homo sapiens
  misc_feature: GYAE6OF02GMMNZ.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaggcgcatagnnnnnn

SEQ ID NO: 117622 - DNA, 319 bp, Homo sapiens
  misc_feature: GYAE6OF02IHVR8.29.30.C08.1.454.CMB.1.raw
  modified_base (309)..(319): a, c, t, g, unknown or other
  misc_feature (309)..(319): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctcagagacaacgccaagaactcactgtctcctcagcctccaccaagggcccatcggtccttcccctggcgcccctgcctccgaggacgcacctccgagagcacagccggcctgggctgcctggtcaaggtctacgttcacgtagcgtgctgagcgggtctggcaaggcgcatagnnnnnnnnnnn

SEQ ID NO: 117623 - DNA, 334 bp, Homo sapiens
  misc_feature: GYAE6OF02I626C.29.30.C08.1.454.CMB.1.raw
  modified_base (319)..(334): a, c, t, g, unknown or other
  misc_feature (319)..(334): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatccggtcttcccctggccgccctgctccaggagccacctccgagacgcacacgcggcccctgggcctcgcctagggtccaaggactacttccacgtagcgtgctcgagcgggctggcaaggcgcacgtagcnnnnnnnnnnnnnnnn

SEQ ID NO: 117624 - DNA, 308 bp, Homo sapiens; identical to SEQ ID NO: 117129
  misc_feature: GYAE6OF02FP6QV.29.30.C08.1.454.CMB.1.raw
  modified_base (305)..(308): a, c, t, g, unknown or other
  misc_feature (305)..(308): n is a, c, g, or t

SEQ ID NO: 117625 - DNA, 311 bp, Homo sapiens
  misc_feature: GYAE6OF02IVELO.29.30.C08.1.454.CMB.1.raw
  modified_base (303)..(311): a, c, t, g, unknown or other
  misc_feature (303)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggacttccacgtagcgtgctgagcgggctggcaaggcgcatagnnnnnnnnn

SEQ ID NO: 117626 - DNA, 308 bp, Homo sapiens; identical to SEQ ID NO: 117129
  misc_feature: GYAE6OF02HQXZG.29.30.C08.1.454.CMB.1.raw
  modified_base (305)..(308): a, c, t, g, unknown or other
  misc_feature (305)..(308): n is a, c, g, or t

SEQ ID NO: 117627 - DNA, 307 bp, Homo sapiens
  misc_feature: GYAE6OF02IPH29.29.30.C08.1.454.CMB.1.raw
  modified_base (306)..(307): a, c, t, g, unknown or other
  misc_feature (306)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaaggactacttccacgtagcgtgctgagcgggctggcaaggcgcatagnn

SEQ ID NO: 117628 - DNA, 309 bp, Homo sapiens; identical to SEQ ID NO: 117160
  misc_feature: GYAE6OF02G4T0O.29.30.C08.1.454.CMB.1.raw
  modified_base (305)..(309): a, c, t, g, unknown or other
  misc_feature (305)..(309): n is a, c, g, or t

SEQ ID NO: 117629 - DNA, 310 bp, Homo sapiens
  misc_feature: GYAE6OF02GUU59.29.30.C08.1.454.CMB.1.raw
  modified_base (303)..(310): a, c, t, g, unknown or other
  misc_feature (303)..(310): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnnn

SEQ ID NO: 117630 - DNA, 223 bp, Homo sapiens
  misc_feature: GYAE6OF02HDE90.29.30.C08.1.454.CMB.1.raw
  modified_base (212)..(223): a, c, t, g, unknown or other
  misc_feature (212)..(223): n is a, c, g, or t
tcagatagagtactcacgaccggtgctcgatttagtctgacgtcaaagggaaaggggaccgacggtcatcgtgtcctcagcctccaccaagggcccatcggtcttcccctggcaccctcctccaagagcacctctggggcacagcggcctgggctgcctggtcaaggactacttccagacgacgctctgagcgggctggcaaggcgcatagnnnnnnnnnnnn

SEQ ID NO: 117631 - DNA, 305 bp, Homo sapiens
  misc_feature: GYAE6OF02HPDBI.29.30.C08.1.454.CMB.1.raw
  modified_base (305)..(305): a, c, t, g, unknown or other
  misc_feature (305)..(305): n is a, c, g, or t
tcagatagagtactcacgaccggtgctcgatttagtctgacgtcaaagggaaaggggctggagtgggtgaccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagn

SEQ ID NO: 117632 - DNA, 310 bp, Homo sapiens
  misc_feature: GYAE6OF02J1MO6.29.30.C08.1.454.CMB.1.raw
  modified_base (230)..(230): a, c, t, g, unknown or other
  misc_feature (230)..(230): n is a, c, g, or t
  modified_base (303)..(310): a, c, t, g, unknown or other
  misc_feature (303)..(310): n is a, c, g, or t
tcagatagagtactcacgaccggtgctcgatttagtctgacgtcaaagggaaggggcgtggagtgggtgaccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagngcacagcggcctgggctgcctggtcaaggactacttccacgtagcgtgctgagcgggctggcaggcgcatagnnnnnnnn

SEQ ID NO: 117633 - DNA, 307 bp, Homo sapiens; identical to SEQ ID NO: 117094
  misc_feature: GYAE6OF02I25W6.29.30.C08.1.454.CMB.1.raw
  modified_base (304)..(307): a, c, t, g, unknown or other
  misc_feature (304)..(307): n is a, c, g, or t

SEQ ID NO: 117634 - DNA, 310 bp, Homo sapiens
  misc_feature: GYAE6OF02IM1EY.29.30.C08.1.454.CMB.1.raw
  modified_base (305)..(310): a, c, t, g, unknown or other
  misc_feature (305)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggactacttccacgtagcgtgctggagcgggctggcaaggcgcatagnnnnnn

SEQ ID NO: 117635 - DNA, 311 bp, Homo sapiens
  misc_feature: GYAE6OF02IVCOH.29.30.C08.1.454.CMB.1.raw
  modified_base (305)..(311): a, c, t, g, unknown or other
  misc_feature (305)..(311): n is a, c, g, or t
tcagatagagtactcacgaccggtgctcgatttagtctgacgtcaaagggaaaggggactggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnn

SEQ ID NO: 117636 - DNA, 306 bp, Homo sapiens; identical to SEQ ID NO: 117508
  misc_feature: GYAE6OF02G7A46.29.30.C08.1.454.CMB.1.raw
  modified_base (305)..(306): a, c, t, g, unknown or other
  misc_feature (305)..(306): n is a, c, g, or t

SEQ ID NO: 117637 - DNA, 377 bp, Homo sapiens
  misc_feature: GYAE6OF02HZKK2.29.30.C08.1.454.CMB.1.raw
  modified_base (238)..(238): a, c, t, g, unknown or other
  misc_feature (238)..(238): n is a, c, g, or t
  modified_base (320)..(320): a, c, t, g, unknown or other
  misc_feature (320)..(320): n is a, c, g, or t
  modified_base (327)..(377): a, c, t, g, unknown or other
  misc_feature (327)..(377): n is a, c, g, or t
tcagatagagtactcacgaccggtgctcgatttagtctgacgtcaaagggtaaagggggtcggtggagtgggtcggccaacagtaaaccaagatggaagtgaacagtactagtcgtggactctgtgaggggccgattcaccatctccagagaccaacggcccaagaactcactgtctccctactagccctccaccaacgggcccactccggtcttcccctggcgccctgctccaggancacctccgagagcacagccggccctgggctgcctgtcaaggctacttccacgtgcgttgctgagcgggactgggcaaggccncagtagnnnnnnnnnnnnnnnnnnnnnnnnnnnnnnnnnnnnnnnnnnnnnnnnnnn

SEQ ID NO: 117638 - DNA, 308 bp, Homo sapiens
  misc_feature: GYAE6OF02IG1PX.29.30.C08.1.454.CMB.1.raw
  modified_base (303)..(308): a, c, t, g, unknown or other
  misc_feature (303)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcgccctgggctgcctggtcaaggctacttccacgtagcgtgctgagcgggctggcaaggcgcatagnnnnnn

SEQ ID NO: 117639 - DNA, 308 bp, Homo sapiens
  misc_feature: GYAE6OF02H3KF0.29.30.C08.1.454.CMB.1.raw
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccagggcccatcggtcttcccctggcgccctgctccaggagcacctccgagagcacagcggccctgggctgcctggtcaaggactacttccacgtagcgtgctgagcgggctggcaaggcgcatagnnnnn

SEQ ID NO: 117640 - DNA, 308 bp, Homo sapiens; identical to SEQ ID NO: 117129
  misc_feature: GYAE6OF02H02H3.29.30.C08.1.454.CMB.1.raw
  modified_base (305)..(308): a, c, t, g, unknown or other
  misc_feature (305)..(308): n is a, c, g, or t

SEQ ID NO: 117641 - DNA, 308 bp, Homo sapiens
  misc_feature: GYAE6OF02H6UU0.29.30.C08.1.454.CMB.1.raw
  modified_base (232)..(232): a, c, t, g, unknown or other
  misc_feature (232)..(232): n is a, c, g, or t
  modified_base (298)..(298): a, c, t, g, unknown or other
  misc_feature (298)..(298): n is a, c, g, or t
  modified_base (303)..(308): a, c, t, g, unknown or other
  misc_feature (303)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctcaccaagggcccatcggtcttcccctggcgccctgctccaggagcacctcgagagcanagcggccctgggctgcctggtcaaaggctacttccacgtagcgtgctgagcgggctggcaaggcgnatagnnnnnn

SEQ ID NO: 117642 - DNA, 386 bp, Homo sapiens
  misc_feature: GYAE6OF02GC0SW.29.30.C08.1.454.CMB.1.raw
  modified_base (320)..(320): a, c, t, g, unknown or other
  misc_feature (320)..(320): n is a, c, g, or t
  modified_base (322)..(326): a, c, t, g, unknown or other
  misc_feature (322)..(326): n is a, c, g, or t
  modified_base (328)..(329): a, c, t, g, unknown or other
  misc_feature (328)..(329): n is a, c, g, or t
  modified_base (331)..(331): a, c, t, g, unknown or other
  misc_feature (331)..(331): n is a, c, g, or t
  modified_base (333)..(386): a, c, t, g, unknown or other
  misc_feature (333)..(386): n is a, c, g, or t
tcagatagagtactcacgaccggtgctcgatttagtctgacgtcaaagggaaaggggctgggagtggggtggcccaacataaaccaagatggaagtgaacagtactatgtggactctgtgaagggccgattcaccatctccagagacaacgccaagaactcactgtctcctcagcctccaccaagggcccatcggtcttccccctggcgccctgctccgaggagcacctccgagcgcgacagcggccctgggcctgcctggtcaaggactacttccagtacgcgtgactggacgcggggctggctaaggcgacagtacgncnnnnngnngngnnnnnnnnnnnnnnnnnnnnnnnnnnnnnnnnnnnnnnnnnnnnnnnnnnnnnn

SEQ ID NO: 117643 - DNA, 307 bp, Homo sapiens; identical to SEQ ID NO: 117110
  misc_feature: GYAE6OF02IYI3P.29.30.C08.1.454.CMB.1.raw
  modified_base (305)..(307): a, c, t, g, unknown or other
  misc_feature (305)..(307): n is a, c, g, or t

SEQ ID NO: 117644 - DNA, 310 bp, Homo sapiens
  misc_feature: GYAE6OF02H26Z6.29.30.C08.1.454.CMB.1.raw
  modified_base (304)..(310): a, c, t, g, unknown or other
  misc_feature (304)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggaccgattcaccatctccagagacaacgccaagaactcactgtctcctcagcctccaccaagggcccatcggtcttcccctggcgccctgctccaggagcacctccgagagcacagcggccctgggctgcctggtcaaggctacttccacgtagcgtgctgagcgggctggcaaggcgcatagnnnnnnn

SEQ ID NO: 117645 - DNA, 311 bp, Homo sapiens
  misc_feature: GYAE6OF02H5WQ4.29.30.C08.1.454.CMB.1.raw
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtcttcccctggcgccctgctccaggagcacctccgagagcacagcggccctgggctgcctggtcaaggactacttccacgtagcgtgctgagcgggctggcaaggcgcatagnnnnnn

SEQ ID NO: 117646 - DNA, 310 bp, Homo sapiens; identical to SEQ ID NO: 117127
  misc_feature: GYAE6OF02ICRJV.29.30.C08.1.454.CMB.1.raw
  modified_base (305)..(310): a, c, t, g, unknown or other
  misc_feature (305)..(310): n is a, c, g, or t

SEQ ID NO: 117647 - DNA, 308 bp, Homo sapiens
  misc_feature: GYAE6OF02HO7DN.29.30.C08.1.454.CMB.1.raw
  modified_base (303)..(308): a, c, t, g, unknown or other
  misc_feature (303)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggactacttcacgtagcgtgctgagcgggctggcaaggcgcatagnnnnnn

SEQ ID NO: 117648 - DNA, 308 bp, Homo sapiens; identical to SEQ ID NO: 117129
  misc_feature: GYAE6OF02GR2JY.29.30.C08.1.454.CMB.1.raw
  modified_base (305)..(308): a, c, t, g, unknown or other
  misc_feature (305)..(308): n is a, c, g, or t

SEQ ID NO: 117649 - DNA, 309 bp, Homo sapiens; identical to SEQ ID NO: 117115
  misc_feature: GYAE6OF02HR7RR.29.30.C08.1.454.CMB.1.raw
  modified_base (306)..(309): a, c, t, g, unknown or other
  misc_feature (306)..(309): n is a, c, g, or t

SEQ ID NO: 117650 - DNA, 356 bp, Homo sapiens
  misc_feature: GYAE6OF02HHQQ9.29.30.C08.1.454.CMB.1.raw
  modified_base (288)..(288): a, c, t, g, unknown or other
  misc_feature (288)..(288): n is a, c, g, or t
  modified_base (316)..(317): a, c, t, g, unknown or other
  misc_feature (316)..(317): n is a, c, g, or t
  modified_base (319)..(356): a, c, t, g, unknown or other
  misc_feature (319)..(356): n is a, c, g, or t
tcagatagagtactcacgaccggtgctcgatttagtctgacgtcaaagggaaaggggcgtggagtgggtggccaacactaaaccaagattggaagtgaacagtactatgtggactctgtgaagggccgattcaccatctccagagacaacgccaagaactcacttgtctcctcagtacctccaccaagggcccatcggtcttccccctggcgccctgcgtccaggtagcacctccgagagcacagcggccctgggctgcctggtcaaggactacttccagtagccgtnctgagcgggctggcaaggcgcagtaggnngnnnnnnnnnnnnnnnnnnnnnnnnnnnnnnnnnnnnnn

SEQ ID NO: 117651 - DNA, 424 bp, Homo sapiens
  misc_feature: GYAE6OF02FFAZ6.29.30.C08.1.454.CMB.1.raw
  modified_base (133)..(133): a, c, t, g, unknown or other
  misc_feature (133)..(133): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (398)..(424): a, c, t, g, unknown or other
  misc_feature (398)..(424): n is a, c, g, or t
tcagatagagtactcacgaccggtgctcgatttagtctgacgtcaaagggaaggggctggagtgggtggccaacataaaccaagatggaagtgaacagtactatgtggactctgtgaaggccattcaccatcnccagagacaacgccaagaactcactgtctcctcacgccctccaccgaacgggccctagtccggtcccttcccccgnggcccgtccctgcctaccgagggacncccaaccgtcccggagacgccgaaccgcggtcccggtccgtggggtacctcggtacccgttagggtaaccgaaacggttacccttaccgttacccggaggttacggtcggtcggtcgttagggacgggtccggggcgtacgggaccaacggggccataagagnnnnnnnnnnnnnnnnnnnnnnnnnnn

SEQ ID NO: 117652 - DNA, 308 bp, Homo sapiens; identical to SEQ ID NO: 117129
  misc_feature: GYAE6OF02GEVC1.29.30.C08.1.454.CMB.1.raw
  modified_base (305)..(308): a, c, t, g, unknown or other
  misc_feature (305)..(308): n is a, c, g, or t

SEQ ID NO: 117653 - DNA, 309 bp, Homo sapiens; identical to SEQ ID NO: 117160
  misc_feature: GYAE6OF02FYCXF.29.30.C08.1.454.CMB.1.raw
  modified_base (305)..(309): a, c, t, g, unknown or other
  misc_feature (305)..(309): n is a, c, g, or t

SEQ ID NO: 117654 - DNA, 340 bp, Homo sapiens
  misc_feature: GYAE6OF02JJIGR.29.30.C08.1.454.CMB.1.raw
  modified_base (315)..(340): a, c, t, g, unknown or other
  misc_feature (315)..(340): n is a, c, g, or t
tcagatagagtactcacgaccggtgctcgatttagtctgacgtcaaagggaaagggggctggagtgggtgggccaacattaaaccaagatggaagtgaaccagtactatgtggactctgtgaagggccgagttcaccatcgtccagagacaacgccaagaactcactgtctcctcagcctccaccagggcccatcggtcttcccctggcgccctgctccaggacgcacctccgagacgcaccagcggcccctgggctgccctggtccaaggactacttccacgtagcgtgctgagcgggctggcaggcgcatagnnnnnnnnnnnnnnnnnnnnnnnnnn

SEQ ID NO: 117655 - DNA, 309 bp, Homo sapiens; identical to SEQ ID NO: 117232
  misc_feature: GYAE6OF02GRIVU.29.30.C08.1.454.CMB.1.raw
  modified_base (304)..(309): a, c, t, g, unknown or other
  misc_feature (304)..(309): n is a, c, g, or t

SEQ ID NO: 117656 - DNA, 310 bp, Homo sapiens; identical to SEQ ID NO: 117127
  misc_feature: GYAE6OF02FMILZ.29.30.C08.1.454.CMB.1.raw
  modified_base (305)..(310): a, c, t, g, unknown or other
  misc_feature (305)..(310): n is a, c, g, or t

SEQ ID NO: 117657 - DNA, 309 bp, Homo sapiens; identical to SEQ ID NO: 117160
  misc_feature: GYAE6OF02JT504.29.30.C08.1.454.CMB.1.raw
  modified_base (305)..(309): a, c, t, g, unknown or other
  misc_feature (305)..(309): n is a, c, g, or t

SEQ ID NO: 117658 - DNA, 337 bp, Homo sapiens
  misc_feature: GYAE6OF02HIJM8.29.30.C08.1.454.CMB.1.raw
  modified_base (228)..(228): a, c, t, g, unknown or other
  misc_feature (228)..(228): n is a, c, g, or t
  modified_base (312)..(337): a, c, t, g, unknown or other
  misc_feature (312)..(337): n is a, c, g, or t
tcagatagagtactcacgaccggtgctcgatttagtctgacgtcaaagggaaagggggtcgtgggagtggggtgggccaacataaaccaaggatggaagtgaacagtactatgtggactctgtcgaagggccgattcaccatctccagagacaacgccaagaactcactgtctcctcagcctccaccaagggcccatcggtcttcccctggcgccctgctccaggacncacctccgagagcacagcggccctgggctgcctggtcaaggctacttcacgtagcgtgctgagcgggctggcaaggcgcatagnnnnnnnnnnnnnnnnnnnnnnnnnn

SEQ ID NO: 117659 - DNA, 309 bp, Homo sapiens
  misc_feature: GYAE6OF02JLD1I.29.30.C08.1.454.CMB.1.raw
  modified_base (303)..(309): a, c, t, g, unknown or other
  misc_feature (303)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggctacttccagtagcgtgctggagcgggctggcaaggcgcatagnnnnnnn

SEQ ID NO: 117660 - DNA, 311 bp, Homo sapiens
  misc_feature: GYAE6OF02GIRMP.29.30.C08.1.454.CMB.1.raw
  modified_base (305)..(311): a, c, t, g, unknown or other
  misc_feature (305)..(311): n is a, c, g, or t
tcagatagagtactcacgaccggtgctcgatttagtctgacgtcaaagggaagggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctcccaggagcacctccgagagcacagcggccctgggctgcctggtcaaggactacttccacgtagcgtgctgagcgggctggcaaggcgcatagnnnnnnn

SEQ ID NO: 117661 - DNA, 307 bp, Homo sapiens; identical to SEQ ID NO: 117233
  misc_feature: GYAE6OF02I462G.29.30.C08.1.454.CMB.1.raw
  modified_base (304)..(307): a, c, t, g, unknown or other
  misc_feature (304)..(307): n is a, c, g, or t

SEQ ID NO: 117662 - DNA, 317 bp, Homo sapiens
  misc_feature: GYAE6OF02ILK7G.29.30.C08.1.454.CMB.1.raw
  modified_base (280)..(280): a, c, t, g, unknown or other
  misc_feature (280)..(280): n is a, c, g, or t
  modified_base (305)..(317): a, c, t, g, unknown or other
  misc_feature (305)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcacctgtctcctcagcctccaccaagggcccatcggtcttcccctggccgccctgctccaggacgcacctcgagagcacagcggccctgggctgcctggtcaaggctacttccacgtagcgtnctgagcgggctggcaggcgcatagnnnnnnnnnnnnn

SEQ ID NO: 117663 - DNA, 307 bp, Homo sapiens
  misc_feature: GYAE6OF02F284R.29.30.C08.1.454.CMB.1.raw
  modified_base (218)..(218): a, c, t, g, unknown or other
  misc_feature (218)..(218): n is a, c, g, or t
  modified_base (302)..(307): a, c, t, g, unknown or other
  misc_feature (302)..(307): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagcggccctgggctgcctggtcaaggctacttccagtagcgtgctgagcgggctggcaaggcgcatagnnnnnn

SEQ ID NO: 117664 - DNA, 326 bp, Homo sapiens
  misc_feature: GYAE6OF02FIGUX.29.30.C08.1.454.CMB.1.raw
  modified_base (275)..(275): a, c, t, g, unknown or other
  misc_feature (275)..(275): n is a, c, g, or t
  modified_base (304)..(326): a, c, t, g, unknown or other
  misc_feature (304)..(326): n is a, c, g, or t
tcagatagagtactcacgaccggtgctcgatttagtctgacgtcaaagggaaaggggctggagtgggtggccaacataaaccaagatggaagtgaacagtactatgtaggactctgtgaacgggccgattcaccatctccagagacaacgccaaggaacctcactgtcctcctcagcctccaccaagggcccagtcggtcttccccctggccgccctgctccaggagcacctccgagagcacagcgcctggctgcctgtcaggctactcacgtancgtgctgagcgggctggcaggcgcatagnnnnnnnnnnnnnnnnnnnnnnn

SEQ ID NO: 117665 - DNA, 309 bp, Homo sapiens; identical to SEQ ID NO: 117115
  misc_feature: GYAE6OF02FWMP2.29.30.C08.1.454.CMB.1.raw
  modified_base (306)..(309): a, c, t, g, unknown or other
  misc_feature (306)..(309): n is a, c, g, or t

SEQ ID NO: 117666 - DNA, 307 bp, Homo sapiens
  misc_feature: GYAE6OF02IG61K.29.30.C08.1.454.CMB.1.raw
  modified_base (287)..(287): a, c, t, g, unknown or other
  misc_feature (287)..(287): n is a, c, g, or t
  modified_base (303)..(307): a, c, t, g, unknown or other
  misc_feature (303)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggctacttccacgtagcgtgctgagcgggntggcaaggcgcatagnnnnn

SEQ ID NO: 117667 - DNA, 309 bp, Homo sapiens; identical to SEQ ID NO: 117160
  misc_feature: GYAE6OF02GS4GP.29.30.C08.1.454.CMB.1.raw
  modified_base (305)..(309): a, c, t, g, unknown or other
  misc_feature (305)..(309): n is a, c, g, or t

SEQ ID NO: 117668 - DNA, 307 bp, Homo sapiens
  misc_feature: GYAE6OF02FSX0C.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagctgctgagcgggctggcaaggcgcatagnnnn

SEQ ID NO: 117669 - DNA, 310 bp, Homo sapiens
  misc_feature: GYAE6OF02G90TO.29.30.C08.1.454.CMB.1.raw
  modified_base (306)..(310): a, c, t, g, unknown or other
  misc_feature (306)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctcctccaagagcacctctgggggcacagcagccctgggctgcctggtcaaggactacttccacgtagcgtgctgagcgggctggcaaggcgcatagnnnnn

SEQ ID NO: 117670 - DNA, 308 bp, Homo sapiens
  misc_feature: GYAE6OF02FGRJX.29.30.C08.1.454.CMB.1.raw
  modified_base (303)..(308): a, c, t, g, unknown or other
  misc_feature (303)..(308): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggcctgggctgcctggtcaaggactacttccacgtagcgtgctgagcgggctggcaggcgcatagnnnnnn

SEQ ID NO: 117671 - DNA, 327 bp, Homo sapiens
  misc_feature: GYAE6OF02I50ZT.29.30.C08.1.454.CMB.1.raw
  modified_base (232)..(232): a, c, t, g, unknown or other
  misc_feature (232)..(232): n is a, c, g, or t
  modified_base (308)..(311): a, c, t, g, unknown or other
  misc_feature (308)..(311): n is a, c, g, or t
  modified_base (313)..(327): a, c, t, g, unknown or other
  misc_feature (313)..(327): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctcagagacaacgccaagaactcactgtctcctcagcctccacaaggcccatcggtctccccgtggcgccctgctccaggacgcacctcgagacgcacngcggccctgggctcgccgtggtcaaggtactaccttccgacgtagcgtgctgagcggctggcaacggcgctgagcnnnngnnnnnnnnnnnnnnn

SEQ ID NO: 117672 - DNA, 310 bp, Homo sapiens
  misc_feature: GYAE6OF02JAP98.29.30.C08.1.454.CMB.1.raw
  modified_base (305)..(310): a, c, t, g, unknown or other
  misc_feature (305)..(310): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctggcaaggcgcatagnnnnnn

SEQ ID NO: 117673 - DNA, 313 bp, Homo sapiens; identical to SEQ ID NO: 117551
  misc_feature: GYAE6OF02GGVUV.29.30.C08.1.454.CMB.1.raw
  modified_base (305)..(313): a, c, t, g, unknown or other
  misc_feature (305)..(313): n is a, c, g, or t

SEQ ID NO: 117674 - DNA, 307 bp, Homo sapiens; identical to SEQ ID NO: 117110
  misc_feature: GYAE6OF02FVV2Z.29.30.C08.1.454.CMB.1.raw
  modified_base (305)..(307): a, c, t, g, unknown or other
  misc_feature (305)..(307): n is a, c, g, or t

SEQ ID NO: 117675 - DNA, 308 bp, Homo sapiens
  misc_feature: GYAE6OF02G397B.29.30.C08.1.454.CMB.1.raw
  modified_base (303)..(308): a, c, t, g, unknown or other
  misc_feature (303)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggcgccctgtccaggagcacctccgagagcacagcggccctgggctgcctggtcaaggctactccagtagcgtgctgaggcgggctgggcaaggcgcatgnnnnnn

SEQ ID NO: 117676 - DNA, 314 bp, Homo sapiens
  misc_feature: GYAE6OF02H0JRD.29.30.C08.1.454.CMB.1.raw
  modified_base (306)..(314): a, c, t, g, unknown or other
  misc_feature (306)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgcagtagnnnnnnnnn

SEQ ID NO: 117677 - DNA, 309 bp, Homo sapiens
  misc_feature: GYAE6OF02FM72F.29.30.C08.1.454.CMB.1.raw
  modified_base (303)..(309): a, c, t, g, unknown or other
  misc_feature (303)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccagtagcgtgtgagcgggctggcaaggcgcatagnnnnnnn

SEQ ID NO: 117678 - DNA, 309 bp, Homo sapiens
  misc_feature: GYAE6OF02HIJWL.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggctacttccacgtagcgtgctgagcgggctggcaaggcgcatagnnnnn

SEQ ID NO: 117679 - DNA, 310 bp, Homo sapiens; identical to SEQ ID NO: 117166
  misc_feature: GYAE6OF02FL6M0.29.30.C08.1.454.CMB.1.raw
  modified_base (306)..(310): a, c, t, g, unknown or other
  misc_feature (306)..(310): n is a, c, g, or t

SEQ ID NO: 117680 - DNA, 333 bp, Homo sapiens
  misc_feature: GYAE6OF02FLOYE.29.30.C08.1.454.CMB.1.raw
  modified_base (311)..(333): a, c, t, g, unknown or other
  misc_feature (311)..(333): n is a, c, g, or t
tcagatagagtactcacgaccggtgctcgatttagtctgacgtcaaagggaaggggttggggagtgggtggccaacataaaccaagatgggaagtgaacagtacctatgtggactctgtgaagggccgattcaccatctccagaggacaacgccaagaactcactgtctcctcagcctccaccaagggcccatcggtccttccccctggcgccctgcctccaggagcacctccgagacgcacagcggccctgggctgcctggtcaaggctacttccacgtagcgtgctgagcgggctggcaggcgcatagnnnnnnnnnnnnnnnnnnnnnnn

SEQ ID NO: 117681 - DNA, 309 bp, Homo sapiens; identical to SEQ ID NO: 117115
  misc_feature: GYAE6OF02FSLFF.29.30.C08.1.454.CMB.1.raw
  modified_base (306)..(309): a, c, t, g, unknown or other
  misc_feature (306)..(309): n is a, c, g, or t

SEQ ID NO: 117682 - DNA, 308 bp, Homo sapiens; identical to SEQ ID NO: 117092
  misc_feature: GYAE6OF02HGI5I.29.30.C08.1.454.CMB.1.raw
  modified_base (304)..(308): a, c, t, g, unknown or other
  misc_feature (304)..(308): n is a, c, g, or t

SEQ ID NO: 117683 - DNA, 351 bp, Homo sapiens
  misc_feature: GYAE6OF02HPZKB.29.30.C08.1.454.CMB.1.raw
  modified_base (274)..(274): a, c, t, g, unknown or other
  misc_feature (274)..(274): n is a, c, g, or t
  modified_base (306)..(307): a, c, t, g, unknown or other
  misc_feature (306)..(307): n is a, c, g, or t
  modified_base (309)..(351): a, c, t, g, unknown or other
  misc_feature (309)..(351): n is a, c, g, or t
tcagatagagtactcacgaccggtgctcgatttagtctgacgtcaaaggggaaagggggctggagtgggtggccaacataaaccaagatggaagtgaacagtactatggtggactctgtgaagggccgattcaccatctccagagacaacgccaagaactcactgtctcctcagcctccaccaaggccatcggtctcccctggcgccctgctccaggagcaccgtccgagagcacagcggccctgggctgcctggtcaagactacttcacgtancgtgctgagcgggctggcgaaggcgcagtagnngnnnnnnnnnnnnnnnnnnnnnnnnnnnnnnnnnnnnnnnnnnn

SEQ ID NO: 117684 - DNA, 311 bp, Homo sapiens
  misc_feature: GYAE6OF02ID9EQ.29.30.C08.1.454.CMB.1.raw
  modified_base (305)..(311): a, c, t, g, unknown or other
  misc_feature (305)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagccgtgctgagcgggctggcaaggcgcatagnnnnnnn

SEQ ID NO: 117685 - DNA, 307 bp, Homo sapiens; identical to SEQ ID NO: 117110
  misc_feature: GYAE6OF02IZRTC.29.30.C08.1.454.CMB.1.raw
  modified_base (305)..(307): a, c, t, g, unknown or other
  misc_feature (305)..(307): n is a, c, g, or t

SEQ ID NO: 117686 - DNA, 307 bp, Homo sapiens
  misc_feature: GYAE6OF02HZKOS.29.30.C08.1.454.CMB.1.raw
  modified_base (304)..(307): a, c, t, g, unknown or other
  misc_feature (304)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnn

SEQ ID NO: 117687 - DNA, 309 bp, Homo sapiens
  misc_feature: GYAE6OF02F0GHU.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactactccacgtagcgtgctgagcgggctggcaaggcgcatagnnnnnn

SEQ ID NO: 117688 - DNA, 311 bp, Homo sapiens; identical to SEQ ID NO: 117240
  misc_feature: GYAE6OF02GA9VS.29.30.C08.1.454.CMB.1.raw
  modified_base (305)..(311): a, c, t, g, unknown or other
  misc_feature (305)..(311): n is a, c, g, or t

SEQ ID NO: 117689 - DNA, 309 bp, Homo sapiens
  misc_feature: GYAE6OF02I0ADC.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtgcgtgctgagcgggctggcaaggcgcatagnnnnnn

SEQ ID NO: 117690 - DNA, 313 bp, Homo sapiens
  misc_feature: GYAE6OF02GOUI0.29.30.C08.1.454.CMB.1.raw
  modified_base (308)..(313): a, c, t, g, unknown or other
  misc_feature (308)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggacgcacctccgagagcacagccggccctgggctgcctggtcaaggactacttccacgtagcgtgctgagcgggctggcaaggcgcatagnnnnnn

SEQ ID NO: 117691 - DNA, 369 bp, Homo sapiens
  misc_feature: GYAE6OF02GAVVG.29.30.C08.1.454.CMB.1.raw
  modified_base (310)..(311): a, c, t, g, unknown or other
  misc_feature (310)..(311): n is a, c, g, or t
  modified_base (317)..(318): a, c, t, g, unknown or other
  misc_feature (317)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (327)..(369): a, c, t, g, unknown or other
  misc_feature (327)..(369): n is a, c, g, or t
tcagatagagtactcacgaccggtgctcgatttagtctgacgtcaaaggggaaagggggctggagtgggtggccaacataaaccaagatggaagtgaacagtactatgtggactctgtgaagggccgattcaccatctccagagacaacgccaagaactcactgtctcctcagcctccacaagggcccatcggtcttccccctggcgccctgctccgaggagcacctccgagagcacagcggccctgggctgcctggtcaaggctacttccagtagcgtgctgagcgggctggcaagggcgcaagtagcnngcagcnncngnganannnnnnnnnnnnnnnnnnnnnnnnnnnnnnnnnnnnnnnnnnn

SEQ ID NO: 117692 - DNA, 310 bp, Homo sapiens
  misc_feature: GYAE6OF02H5I57.29.30.C08.1.454.CMB.1.raw
  modified_base (306)..(310): a, c, t, g, unknown or other
  misc_feature (306)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcggctggcaaggcgcagtagnnnnn

SEQ ID NO: 117693 - DNA, 310 bp, Homo sapiens
  misc_feature: GYAE6OF02IYWBV.29.30.C08.1.454.CMB.1.raw
  modified_base (304)..(310): a, c, t, g, unknown or other
  misc_feature (304)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctcgagagcacagcggccctgggctgcctggtcaaggactacttccagtagcgtgctgagcgggctggcaaggcgcatagnnnnnnn

SEQ ID NO: 117694 - DNA, 341 bp, Homo sapiens
  misc_feature: GYAE6OF02H8EZT.29.30.C08.1.454.CMB.1.raw
  modified_base (308)..(313): a, c, t, g, unknown or other
  misc_feature (308)..(313): n is a, c, g, or t
  modified_base (315)..(341): a, c, t, g, unknown or other
  misc_feature (315)..(341): n is a, c, g, or t
tcagatagagtactcacgaccggtgctcgatttagtctgacgtcaaagggaaaggggtcgtggagtgggtggccaacataaaccaagatggaagtgaacagtacctatgtggactctggtgaagggccgattcaccatctccagagacaacgccaagaactcactgtctcctcagcctccaccaaggcccatcggtcttcccctggcgcccgtgctccaggagccacctccgagagcacagcggccctgggctgcctggtcaaggctacttccacgtagcgtgctgagcggctggcaaggcgcatagnnnnnngnnnnnnnnnnnnnnnnnnnnnnnnnnn

SEQ ID NO: 117695 - DNA, 309 bp, Homo sapiens
  misc_feature: GYAE6OF02G72FE.29.30.C08.1.454.CMB.1.raw
  modified_base (306)..(309): a, c, t, g, unknown or other
  misc_feature (306)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagccacagcggccctgggctgcctggtcaaggactacttccacgtagcgtgctgagcgggctggcaaggcgcatagnnnn

SEQ ID NO: 117696 - DNA, 311 bp, Homo sapiens
  misc_feature: GYAE6OF02HHRJK.29.30.C08.1.454.CMB.1.raw
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagccacagcggccctgggctgcctggtcaaggactacttccacgtagcgtgctgagcgggctggcaaggcgcatagnnnnnn

SEQ ID NO: 117697 - DNA, 345 bp, Homo sapiens
  misc_feature: GYAE6OF02JFQ5Y.29.30.C08.1.454.CMB.1.raw
  modified_base (202)..(202): a, c, t, g, unknown or other
  misc_feature (202)..(202): n is a, c, g, or t
  modified_base (218)..(218): a, c, t, g, unknown or other
  misc_feature (218)..(218): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (327)..(345): a, c, t, g, unknown or other
  misc_feature (327)..(345): n is a, c, g, or t
tcagatagagtactcacgaccggtgctcgatttagtctgacgtcaaagggaaggggacgtggagtgggtggccaacgataaaccaagatggaagtgaacagtactatgtggactctgtgaagggccgattcaccatctccagagacaacgccaagaactcactgtctcctcagcctcaccagggcccatccggtcttccccnggccgccctgctaccnggacgcacctccgagacgccactagccggccctgggctggcctggtacaggacctacttccacgtacgcgtgcctggacgcgggctggcgaaggcggcattacgncngnnnnnnnnnnnnnnnnnnn

SEQ ID NO: 117698 - DNA, 326 bp, Homo sapiens
  misc_feature: GYAE6OF02JFTDC.29.30.C08.1.454.CMB.1.raw
  modified_base (310)..(326): a, c, t, g, unknown or other
  misc_feature (310)..(326): n is a, c, g, or t
tcagatagagtactcacgaccggtgctcgatttagtctgacgtcaaagggaaaggggctgggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggacgcacctccgagagcacagcggccctgggctgcctggtcaaggactacttccacgtagcgtgctgagcgggctggcaaggcgacatacgnnnnnnnnnnnnnnnnn

SEQ ID NO: 117699 - DNA, 325 bp, Homo sapiens
  misc_feature: GYAE6OF02H5311.29.30.C08.1.454.CMB.1.raw
  modified_base (277)..(277): a, c, t, g, unknown or other
  misc_feature (277)..(277): n is a, c, g, or t
  modified_base (310)..(325): a, c, t, g, unknown or other
  misc_feature (310)..(325): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggacgcacctccgagagcacagccggccctgggctgcctggtcaaggactacttccacgtancgttgctgagcgggctggcgaaggcgcagtagnnnnnnnnnnnnnnnn

SEQ ID NO: 117700 - DNA, 330 bp, Homo sapiens
  misc_feature: GYAE6OF02HNAHG.29.30.C08.1.454.CMB.1.raw
  modified_base (312)..(330): a, c, t, g, unknown or other
  misc_feature (312)..(330): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccccgtggcgccctggctccaggagcacctccgagagcacagcggccctgggctgcctggtcaaggactacttccacgtagcgtgctgagcgggctgggacaaggcgacataggnnnnnnnnnnnnnnnnnnn

SEQ ID NO: 117701 - DNA, 313 bp, Homo sapiens
  misc_feature: GYAE6OF02FHG2F.29.30.C08.1.454.CMB.1.raw
  modified_base (303)..(313): a, c, t, g, unknown or other
  misc_feature (303)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggctacttccagtagcgtgctgagcgggctgggcaaggcgcatagnnnnnnnnnnn

SEQ ID NO: 117702 - DNA, 306 bp, Homo sapiens
  misc_feature: GYAE6OF02H96DI.29.30.C08.1.454.CMB.1.raw
  modified_base (299)..(299): a, c, t, g, unknown or other
  misc_feature (299)..(299): n is a, c, g, or t
  modified_base (305)..(306): a, c, t, g, unknown or other
  misc_feature (305)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcncatagnn

SEQ ID NO: 117703 - DNA, 309 bp, Homo sapiens
  misc_feature: GYAE6OF02GEVDM.29.30.C08.1.454.CMB.1.raw
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccagtagcgtgctgagcgggctggcaaggcgcatagnnnnnn

SEQ ID NO: 117704 - DNA, 308 bp, Homo sapiens
  misc_feature: GYAE6OF02GE9MH.29.30.C08.1.454.CMB.1.raw
  modified_base (302)..(308): a, c, t, g, unknown or other
  misc_feature (302)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggcgccctgctccaggagcacctccgagagcacagcggcctgggctgcctggtcaaggactacttccagtagcgtgctgagcgggctggcaaggcgcatagnnnnnnn

SEQ ID NO: 117705 - DNA, 309 bp, Homo sapiens
  misc_feature: GYAE6OF02HOYMW.29.30.C08.1.454.CMB.1.raw
  modified_base (305)..(309): a, c, t, g, unknown or other
  misc_feature (305)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggcgccctgctccaggagcacctccgagagcacagcggccctggctgcctggtcaaggctacttccacgtagcgtgctgagcgggctggcaagggcgcatagnnnnn

SEQ ID NO: 117706 - DNA, 313 bp, Homo sapiens
  misc_feature: GYAE6OF02F3753.29.30.C08.1.454.CMB.1.raw
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggctacttccacgtagcgtgctgagcgggctggcaaggcgcagtagnnnnnnnn

SEQ ID NO: 117707 - DNA, 396 bp, Homo sapiens
  misc_feature: GYAE6OF02GER8R.29.30.C08.1.454.CMB.1.raw
  modified_base (347)..(348): a, c, t, g, unknown or other
  misc_feature (347)..(348): n is a, c, g, or t
  modified_base (350)..(354): a, c, t, g, unknown or other
  misc_feature (350)..(354): n is a, c, g, or t
  modified_base (356)..(396): a, c, t, g, unknown or other
  misc_feature (356)..(396): n is a, c, g, or t
tcagatagagtactcacgaccggtgctcgatttagtctgacgtcaaagggaaagggggctggaggtgggtggccaacataaaccaaggatggaagtgaacagtactagtgtggactctgtgaagggcccgattcaccatctccagagacaacggccaagaactcactgtctcctcacgcctcccaccaaggggccccagttccggtccttccccccgtgggccgcccctgcctacccaggacgccacctccgaagagaccacagcggccctgggcttgcctaggtcaaggacctacttccacgtagcgtgcctggacgaccggggctagggcaaggcgactaatagnnannnnngnnnnnnnnnnnnnnnnnnnnnnnnnnnnnnnnnnnnnnnnn

SEQ ID NO: 117708 - DNA, 326 bp, Homo sapiens
  misc_feature: GYAE6OF02JAQS8.29.30.C08.1.454.CMB.1.raw
  modified_base (236)..(236): a, c, t, g, unknown or other
  misc_feature (236)..(236): n is a, c, g, or t
  modified_base (310)..(326): a, c, t, g, unknown or other
  misc_feature (310)..(326): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtcttccccctgggccgcccctgcctccgaggagcacctccganagcacagccggccctgggcctgcctggtacaacggactactccagtacgcgtgctgagcggctgcagcgcatgnnnnnnnnnnnnnnnnn

SEQ ID NO: 117709 - DNA, 305 bp, Homo sapiens
  misc_feature: GYAE6OF02H25KW.29.30.C08.1.454.CMB.1.raw
  modified_base (300)..(305): a, c, t, g, unknown or other
  misc_feature (300)..(305): n is a, c, g, or t
tcagatagagtactcacgaccggtgctcgatttagtctgacgtcaaagggaaagggctggagtgggtggccaacataaaaccaagatggaagtgaacagtactatgtggactctgtgaagggccgattcaccatctcagagacaacgccaagaactcactgtctcctcagcctccaccaagggcccatcggtcttccccctggcgccctgctccaggagcacctccgagagcacagcggcctgggctgctggcaaggctacttccagtagcgtgctgagcggtctggcaaggcgcatagnnnnnn

SEQ ID NO: 117710 - DNA, 311 bp, Homo sapiens
  misc_feature: GYAE6OF02INZKV.29.30.C08.1.454.CMB.1.raw
  modified_base (305)..(311): a, c, t, g, unknown or other
  misc_feature (305)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggccgccctgctccaggagcacctcgagagcacagcggccctgggctgcctggtcaaggactacttccacgtagcgtgctgagcgggctggcaaggcgcagtagnnnnnnn

SEQ ID NO: 117711 - DNA, 312 bp, Homo sapiens
  misc_feature: GYAE6OF02HI5LW.29.30.C08.1.454.CMB.1.raw
  modified_base (300)..(300): a, c, t, g, unknown or other
  misc_feature (300)..(300): n is a, c, g, or t
  modified_base (306)..(312): a, c, t, g, unknown or other
  misc_feature (306)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggccctgggctgcctggtcaaggactacttccacgtagcgtgctgagcgggctggcaaggcncatagnnnnnnn

SEQ ID NO: 117712 - DNA, 317 bp, Homo sapiens
  misc_feature: GYAE6OF02FZBF7.29.30.C08.1.454.CMB.1.raw
  modified_base (277)..(277): a, c, t, g, unknown or other
  misc_feature (277)..(277): n is a, c, g, or t
  modified_base (305)..(317): a, c, t, g, unknown or other
  misc_feature (305)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctactccacgtagcgtnctgagcgggctggcaaggcgcgatacgnnnnnnnnnnnnn

SEQ ID NO: 117713 - DNA, 313 bp, Homo sapiens
  misc_feature: GYAE6OF02HS6L3.29.30.C08.1.454.CMB.1.raw
  modified_base (307)..(313): a, c, t, g, unknown or other
  misc_feature (307)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggccgccctgctccaggagcacctccgagagcacagcgccctgggctgcctggtcaaggactacttccacgtagcgtgctgagcgggctggcaaggcgcataggnnnnnnn

SEQ ID NO: 117714 - DNA, 324 bp, Homo sapiens
  misc_feature: GYAE6OF02HZMPF.29.30.C08.1.454.CMB.1.raw
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (302)..(302): a, c, t, g, unknown or other
  misc_feature (302)..(302): n is a, c, g, or t
  modified_base (308)..(324): a, c, t, g, unknown or other
  misc_feature (308)..(324): n is a, c, g, or t
tcagatagagtactcacgaccggtgctcgatttagtctgacgtcaaagggaaaggggctgggagtgggtggccaacataaaccaagatggaagtgaacagtactatgtggactctgtgaagggccgattcaccatctccagagacaacgccaagaactcactgtctcctcagcctccaccaagggcccatcggtcttccccnggcgccctgctccaggcncacctcgagacgcacagcggcctgggctgcctggtacaaggctacttccacgtagcgtgctgagcgggctggacaaggccgngatagnnnnnnnnnnnnnnnnn

SEQ ID NO: 117715 - DNA, 320 bp, Homo sapiens
  misc_feature: GYAE6OF02F78RD.29.30.C08.1.454.CMB.1.raw
  modified_base (308)..(320): a, c, t, g, unknown or other
  misc_feature (308)..(320): n is a, c, g, or t
tcagatagagtactcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgccctggtccaaggactacttccacgtagcgtgctgagcgggctggcaaggcgcatagnnnnnnnnnnnnn

SEQ ID NO: 117716 - DNA, 353 bp, Homo sapiens
  misc_feature: GYAE6OF02GQGS5.29.30.C08.1.454.CMB.1.raw
  modified_base (170)..(170): a, c, t, g, unknown or other
  misc_feature (170)..(170): n is a, c, g, or t
  modified_base (316)..(321): a, c, t, g, unknown or other
  misc_feature (316)..(321): n is a, c, g, or t
  modified_base (324)..(353): a, c, t, g, unknown or other
  misc_feature (324)..(353): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctccagagacaacgccaagaactcactgtctcctnagcctccaccaagggcccatcggtctcccctggcgccctgctccgaggagccgacctccgagacgcacgaggccggccctgggctgccgtggtcaaggctacttccacgtagccgtgctgagtcgggctggcaagggcgcagtagnnnnnngannnnnnnnnnnnnnnnnnnnnnnnnnnnnn

SEQ ID NO: 117717 - DNA, 308 bp, Homo sapiens
  misc_feature: GYAE6OF02FV100.29.30.C08.1.454.CMB.1.raw
  modified_base (219)..(219): a, c, t, g, unknown or other
  misc_feature (219)..(219): n is a, c, g, or t
  modified_base (304)..(308): a, c, t, g, unknown or other
  misc_feature (304)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagccggcctgggctgcctggtcaaggctacttccacgtagcgtgctgagcgggctggcaaggcgcatagnnnnn

SEQ ID NO: 117718 - DNA, 318 bp, Homo sapiens
  misc_feature: GYAE6OF02G3BGO.29.30.C08.1.454.CMB.1.raw
  modified_base (207)..(207): a, c, t, g, unknown or other
  misc_feature (207)..(207): n is a, c, g, or t
  modified_base (310)..(318): a, c, t, g, unknown or other
  misc_feature (310)..(318): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccaagggcccatcggtcttcccctggccnccctgcctccaggagccacctccgagacgcacagcggccctgggctgcctggtcaacggactactccacgtagcgtgctgaggcggctggcaaggcgcatagnnnnnnnnn

SEQ ID NO: 117719 - DNA, 313 bp, Homo sapiens
  misc_feature: GYAE6OF02F8JVL.29.30.C08.1.454.CMB.1.raw
  modified_base (230)..(230): a, c, t, g, unknown or other
  misc_feature (230)..(230): n is a, c, g, or t
  modified_base (308)..(313): a, c, t, g, unknown or other
  misc_feature (308)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagngcacagccggccctgggctgcctggcaaggactacttccacgtagcgtgctgaggcgggctgggcaaggcgacatagnnnnnn

SEQ ID NO: 117720 - DNA, 313 bp, Homo sapiens
  misc_feature: GYAE6OF02IKXLQ.29.30.C08.1.454.CMB.1.raw
  modified_base (200)..(200): a, c, t, g, unknown or other
  misc_feature (200)..(200): n is a, c, g, or t
  modified_base (304)..(313): a, c, t, g, unknown or other
  misc_feature (304)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggccatcggtcttccccnggcgccctgctccaggagcacctccgagagcacagcggccctgggctgcctggtcaaggactacttccacgtagcgtgctgagcgggctggcaaggcgcatagnnnnnnnnnn

SEQ ID NO: 117721 - DNA, 313 bp, Homo sapiens
  misc_feature: GYAE6OF02GK92T.29.30.C08.1.454.CMB.1.raw
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctgggcaaggcgcatagnnnnnnnn

SEQ ID NO: 117722 - DNA, 331 bp, Homo sapiens
  misc_feature: GYAE6OF02G6WJD.29.30.C08.1.454.CMB.1.raw
  modified_base (317)..(331): a, c, t, g, unknown or other
  misc_feature (317)..(331): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgcgtgacggcgggtcgtcggacgacgggcgacagtagnnnnnnnnnnnnnnn

SEQ ID NO: 117723 - DNA, 217 bp, Homo sapiens
  misc_feature: GYAE6OF02H3NPT.29.30.C08.1.454.CMB.1.raw
  modified_base (210)..(217): a, c, t, g, unknown or other
  misc_feature (210)..(217): n is a, c, g, or t
tcagatagagtactcacgaccggtgctcgatttagtctgacgtcaaagggaaagggaccacggtcatcgtgtcctcagcctccaccaagggcccatcggtcttcccctcggcaccctcctccaagacgcacctctggggcacagcggccctgggctgcctggtcaaggctactcagacgacgctctgagcgggctggcaaggcgcatagnnnnnnnn

SEQ ID NO: 117724 - DNA, 360 bp, Homo sapiens
  misc_feature: GYAE6OF02IFB47.29.30.C08.1.454.CMB.1.raw
  modified_base (164)..(164): a, c, t, g, unknown or other
  misc_feature (164)..(164): n is a, c, g, or t
  modified_base (216)..(216): a, c, t, g, unknown or other
  misc_feature (216)..(216): n is a, c, g, or t
  modified_base (332)..(333): a, c, t, g, unknown or other
  misc_feature (332)..(333): n is a, c, g, or t
  modified_base (336)..(360): a, c, t, g, unknown or other
  misc_feature (336)..(360): n is a, c, g, or t
tcagatagagtactcacgaccggtgctcgatttagtctgacgtcaaagggaaaggggcgtggagtgggtggccgaacagtaaaccaagatggaagtagaacagtactatgtggactctgtgaaggcgatcaccatctcagagacaacgcaagaactcactgtcnctcagcctccacagggcccatcgtcctccctggcgccctgacctcgaggacnccaacctccgagcgacacagccgggcccttggggctcgcccgttggtccaaggggtacctaccgttccacgtagcgttagctggacgcgggcttgggaccaaggcgtcaaactggnnatnnnnnnnnnnnnnnnnnnnnnnnnn

SEQ ID NO: 117725 - DNA, 317 bp, Homo sapiens
  misc_feature: GYAE6OF02H1LJJ.29.30.C08.1.454.CMB.1.raw
  modified_base (310)..(317): a, c, t, g, unknown or other
  misc_feature (310)..(317): n is a, c, g, or t
tcagatagagtactcacgaccggtgctcgatttagtctgacgtcaaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctgggcaaggcgcaagtagnnnnnnnn

SEQ ID NO: 117726 - DNA, 317 bp, Homo sapiens
  misc_feature: GYAE6OF02IKC7J.29.30.C08.1.454.CMB.1.raw
  modified_base (307)..(317): a, c, t, g, unknown or other
  misc_feature (307)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggcgccctgctccaggagcacctccgagagcacagcggcccctgggctgcctggtcaaggctacttccacgtagcgtgctggagcgggctggcaaggcgcatagnnnnnnnnnnn

SEQ ID NO: 117727 - DNA, 310 bp, Homo sapiens
  misc_feature: GYAE6OF02IH0RA.29.30.C08.1.454.CMB.1.raw
  modified_base (305)..(310): a, c, t, g, unknown or other
  misc_feature (305)..(310): n is a, c, g, or t
tcagatagagtactcacgaccggtgctcgatttagtctgacgtcaaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttcccctggccgccctgctccaggagcacctccgagagcacagcggccctgggctgcctggtcaaggctacttccacgtagcgtgctgagcgggctggcaaggcgcatagnnnnnn

SEQ ID NO: 117728 - DNA, 311 bp, Homo sapiens
  misc_feature: GYAE6OF02HSKI4.29.30.C08.1.454.CMB.1.raw
  modified_base (307)..(311): a, c, t, g, unknown or other
  misc_feature (307)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccacgtagcgtgctgagcgggctggcaaggcgacatagnnnnn

SEQ ID NO: 117729 - DNA, 305 bp, Homo sapiens
  misc_feature: GYAE6OF02IQFYF.29.30.C08.1.454.CMB.1.raw
  modified_base (288)..(288): a, c, t, g, unknown or other
  misc_feature (288)..(288): n is a, c, g, or t
  modified_base (298)..(298): a, c, t, g, unknown or other
  misc_feature (298)..(298): n is a, c, g, or t
  modified_base (303)..(305): a, c, t, g, unknown or other
  misc_feature (303)..(305): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctcgctccaggagcacctcgagagcacagcggccctgggctgcctggtcaaggactacttcacgtagcgtgctgagcgggntggcaaggcncatgnnn

SEQ ID NO: 117730 - DNA, 314 bp, Homo sapiens
  misc_feature: GYAE6OF02GN9ZP.29.30.C08.1.454.CMB.1.raw
  modified_base (261)..(261): a, c, t, g, unknown or other
  misc_feature (261)..(261): n is a, c, g, or t
  modified_base (299)..(299): a, c, t, g, unknown or other
  misc_feature (299)..(299): n is a, c, g, or t
  modified_base (305)..(314): a, c, t, g, unknown or other
  misc_feature (305)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggnttacttccacgtagcgtgctgagcgggctggcaaggcncatagnnnnnnnnnn

SEQ ID NO: 117731 - DNA, 310 bp, Homo sapiens
  misc_feature: GYAE6OF02F412Z.29.30.C08.1.454.CMB.1.raw
  modified_base (305)..(310): a, c, t, g, unknown or other
  misc_feature (305)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactacttccagtagcgtgctgagcgggctggcaaggcgcatagnnnnnn

SEQ ID NO: 117732 - DNA, 369 bp, Homo sapiens
  misc_feature: GYAE6OF02H5HSN.29.30.C08.1.454.CMB.1.raw
  modified_base (180)..(180): a, c, t, g, unknown or other
  misc_feature (180)..(180): n is a, c, g, or t
  modified_base (319)..(320): a, c, t, g, unknown or other
  misc_feature (319)..(320): n is a, c, g, or t
  modified_base (322)..(323): a, c, t, g, unknown or other
  misc_feature (322)..(323): n is a, c, g, or t
  modified_base (325)..(326): a, c, t, g, unknown or other
  misc_feature (325)..(326): n is a, c, g, or t
  modified_base (328)..(369): a, c, t, g, unknown or other
  misc_feature (328)..(369): n is a, c, g, or t
tcagatagagtactcacgaccggtgctcgatttagtctgacgtcaaaagggaaagggggtcgtggagtgggtcggccaacataaaccaagatgggaagttgaactaggtactatgtggactctgtgaagggccgattcaccatctccagtagacaacgccaagaacttcactgtctcctnagcctccacaagggcccagtcggtcttccccgtggcgccctgctccgaggcgcacctcgagagcacagccggcctgggctgcctggtacaaggctcttcacgtagtcgtgtctgagcgggctggctaaggccgcatagnngnngnngnnnnnnnnnnnnnnnnnnnnnnnnnnnnnnnnnnnnnnnnnn

SEQ ID NO: 117733 - DNA, 311 bp, Homo sapiens
  misc_feature: GYAE6OF02IR58V.29.30.C08.1.454.CMB.1.raw
  modified_base (306)..(311): a, c, t, g, unknown or other
  misc_feature (306)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggccgccctgctccaggagccacctcgagagcacagccggccctgggctgcctggtcagactacttccacgtagcgtgctgagcgggctggcaaggcgcatagnnnnnn

SEQ ID NO: 117734 - DNA, 321 bp, Homo sapiens
  misc_feature: GYAE6OF02IS876.29.30.C08.1.454.CMB.1.raw
  modified_base (312)..(321): a, c, t, g, unknown or other
  misc_feature (312)..(321): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggacgcacctccgagagcacacgcggcccgtgggcctggcctggtcaaggaccttacttccacgtagcgtgctggagcgggctggcaggcgcatagnnnnnnnnnn

SEQ ID NO: 117735 - DNA, 308 bp, Homo sapiens
  misc_feature: GYAE6OF02HPSQ4.29.30.C08.1.454.CMB.1.raw
  modified_base (303)..(308): a, c, t, g, unknown or other
  misc_feature (303)..(308): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggctacttcacgtagcgtgctgagcgggctggcaaggcgcatagnnnnnn

SEQ ID NO: 117736 - DNA, 311 bp, Homo sapiens
  misc_feature: GYAE6OF02FX1K8.29.30.C08.1.454.CMB.1.raw
  modified_base (305)..(311): a, c, t, g, unknown or other
  misc_feature (305)..(311): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagcggccctgggctgcctggtcaaggactactccacgtagcgtgctgagcgggctggcaaggcgcatagnnnnnnn

SEQ ID NO: 117737 - DNA, 318 bp, Homo sapiens
  misc_feature: GYAE6OF02I49TH.29.30.C08.1.454.CMB.1.raw
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
  modified_base (305)..(318): a, c, t, g, unknown or other
  misc_feature (305)..(318): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccacaagggcccatcggtcttcccctggccgccctgctccaggancacctcgagagcacagccggccctgggctgctggtcaaggactacttccagtagcgtnctgaggcgggctggcaacggcacatagnnnnnnnnnnnnnn

SEQ ID NO: 117738 - DNA, 530 bp, Homo sapiens
  misc_feature: GYAE6OF02I3QYH.29.30.C08.1.454.CMB.1.raw
  modified_base (172)..(172): a, c, t, g, unknown or other
  misc_feature (172)..(172): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (385)..(386): a, c, t, g, unknown or other
  misc_feature (385)..(386): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (403)..(403): a, c, t, g, unknown or other
  misc_feature (403)..(403): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (440)..(441): a, c, t, g, unknown or other
  misc_feature (440)..(441): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (467)..(468): a, c, t, g, unknown or other
  misc_feature (467)..(468): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
tcagatagagtactcacgaccggtgctcgatttagtctgacgtcaaagggaaaggggacgtggacgtgggtggccaacataaaccaaggatggaagtcgaacagtactagtgtcggactctgtcgacggccgattcacatctcagagacaacgccaagactcactgtctccncagcctccaccgacgggccatcggtcctccccgtggcgccctgctaccgaggacgcctacctccgaagcgcacgacgtccggccctgggactaacggccttaggtacgtaaggtacttaccgttaccaacggttaagccgttcgacgtcggaacggccgggtacgtcgggtacgaacggcgacgtaagtaacggcangagtcgcctnagcgcnngngncntacgtcgcncncgacgacgacgacgagngcgcgngtnctnacgngagnngnagngacgngngntnactnananannananagtgntagtagtgtgtgngngagngagnanacgcgtcgngcgcgcgacgcgtcgcgcg

SEQ ID NO: 117739 - DNA, 317 bp, Homo sapiens
  misc_feature: GYAE6OF02HEKK3.29.30.C08.1.454.CMB.1.raw
  modified_base (308)..(317): a, c, t, g, unknown or other
  misc_feature (308)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccgaagggcccatcggtcttccccctggccgccctgctccaggacgccacctccgagagcacagcggccctggctgcctggtcaaggactacttccacgtagcgtgctgagcgggctggcaaggcgcatgnnnnnnnnnn

SEQ ID NO: 117740 - DNA, 313 bp, Homo sapiens
  misc_feature: GYAE6OF02G3W11.29.30.C08.1.454.CMB.1.raw
  modified_base (305)..(313): a, c, t, g, unknown or other
  misc_feature (305)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagagcacagcggccctgggctgcctggtcaaggctacttccacgtagcgtgctgagcgggctggcaaggcgcatagnnnnnnnnn

SEQ ID NO: 117741 - DNA, 411 bp, Homo sapiens
  misc_feature: GYAE6OF02HAVWU.29.30.C08.1.454.CMB.1.raw
  modified_base (315)..(315): a, c, t, g, unknown or other
  misc_feature (315)..(315): n is a, c, g, or t
  modified_base (333)..(334): a, c, t, g, unknown or other
  misc_feature (333)..(334): n is a, c, g, or t
  modified_base (336)..(338): a, c, t, g, unknown or other
  misc_feature (336)..(338): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (359)..(411): a, c, t, g, unknown or other
  misc_feature (359)..(411): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggccgccctgcctccaggcgccacctccgagacgccacagccggccctgggcctgcccgtggtaccaaggaccttaccgttcccaacggttagcgttgcttggaggccgggntggcaaggccgcagtagnngnnnagcngntangntcnatnatgnnnnnnnnnnnnnnnnnnnnnnnnnnnnnnnnnnnnnnnnnnnnnnnnnnnnn

SEQ ID NO: 117742 - DNA, 316 bp, Homo sapiens
  misc_feature: GYAE6OF02GTQ6O.29.30.C08.1.454.CMB.1.raw
  modified_base (304)..(316): a, c, t, g, unknown or other
  misc_feature (304)..(316): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctcgagagcacagcggccctgggctgcctggtcaaggactacttccacgtagcgtgctgagcgggctggcaaggcgcatagnnnnnnnnnnnnn

SEQ ID NO: 117743 - DNA, 310 bp, Homo sapiens
  misc_feature: GYAE6OF02FO21J.29.30.C08.1.454.CMB.1.raw
  modified_base (299)..(299): a, c, t, g, unknown or other
  misc_feature (299)..(299): n is a, c, g, or t
  modified_base (305)..(310): a, c, t, g, unknown or other
  misc_feature (305)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcncatagnnnnnn

SEQ ID NO: 117744 - DNA, 309 bp, Homo sapiens
  misc_feature: GYAE6OF02H0PWF.29.30.C08.1.454.CMB.1.raw
  modified_base (298)..(298): a, c, t, g, unknown or other
  misc_feature (298)..(298): n is a, c, g, or t
  modified_base (304)..(309): a, c, t, g, unknown or other
  misc_feature (304)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcgtcttcccctggcgccctgctccaggagcacctcgagagcacagcggccctgggctgcctggtcaaggactacttccaacgtagcgtgcctgagcgggctggcaaggcncatagnnnnnn

SEQ ID NO: 117745 - DNA, 310 bp, Homo sapiens
  misc_feature: GYAE6OF02GHK51.29.30.C08.1.454.CMB.1.raw
  modified_base (222)..(222): a, c, t, g, unknown or other
  misc_feature (222)..(222): n is a, c, g, or t
  modified_base (305)..(310): a, c, t, g, unknown or other
  misc_feature (305)..(310): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggccgccctgcctccagganccacctccgagagcacagccggcctgggctgcctggtcaaggctactccacgtagcgtgctgagcgggctggcaagcgcatgnnnnnn

SEQ ID NO: 117746 - DNA, 361 bp, Homo sapiens
  misc_feature: GYAE6OF02HK4UB.29.30.C08.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (315)..(361): a, c, t, g, unknown or other
  misc_feature (315)..(361): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctcagagacaacgccaagaactcactgtctcctcagcctccaccaagggccccatccggtcttcccccnggcgccctgctccagggactcacctccgagagctacagtccggccctggggctgccnggtacaaggactactccagtancgtnctgacggcggntggcaaggcgacgatagcnnnnnnnnnnnnnnnnnnnnnnnnnnnnnnnnnnnnnnnnnnnnnnn

SEQ ID NO: 117747 - DNA, 313 bp, Homo sapiens
  misc_feature: GYAE6OF02GFNXB.29.30.C08.1.454.CMB.1.raw
  modified_base (308)..(313): a, c, t, g, unknown or other
  misc_feature (308)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtccccctcagcctccaccaagggcccatcggtcttccccctggcgccctgctccaggagccacctccgagagcacagcggccctgggctgcctggtcaaggactacttccacgtagcgtgctgagcgggctggcaaggcgcatagnnnnnn

SEQ ID NO: 117748 - DNA, 395 bp, Homo sapiens
  misc_feature: GYAE6OF02HWEBL.29.30.C08.1.454.CMB.1.raw
  modified_base (233)..(233): a, c, t, g, unknown or other
  misc_feature (233)..(233): n is a, c, g, or t
  modified_base (369)..(395): a, c, t, g, unknown or other
  misc_feature (369)..(395): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaaagaactcactgtctccctcagcctcccaccaacgggcccatccggtccttccccccgtggccgcccctgcctccagggacnccacctccgagacgccacgagccgggccctggggctcggccgtggtcgaaggtccttaaccgttcccaacggttaggccggttgccgttaggaagggccggggcctaggggccaaaaggggccgacagttaacggnnnnnnnnnnnnnnnnnnnnnnnnnnn

SEQ ID NO: 117749 - DNA, 333 bp, Homo sapiens
  misc_feature: GYAE6OF02F7YKU.29.30.C08.1.454.CMB.1.raw
  modified_base (281)..(281): a, c, t, g, unknown or other
  misc_feature (281)..(281): n is a, c, g, or t
  modified_base (308)..(311): a, c, t, g, unknown or other
  misc_feature (308)..(311): n is a, c, g, or t
  modified_base (313)..(333): a, c, t, g, unknown or other
  misc_feature (313)..(333): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagccctccaccaagggcccatcggtcttccccctggccgccctgctccaggagcacctccgagagcacagcggccctgggctgcctggtcaaggctacttccacgtagcgtanctgaggcgggctggcaaggcgcatagnnnngnnnnnnnnnnnnnnnnnnnnn

SEQ ID NO: 117750 - DNA, 318 bp, Homo sapiens
  misc_feature: GYAE6OF02FUOAK.29.30.C08.1.454.CMB.1.raw
  modified_base (309)..(318): a, c, t, g, unknown or other
  misc_feature (309)..(318): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagccggccctgggctgcctggtcaaggactacttccacgtagcgtgctgagcgggctgggcaaggcgcagtagnnnnnnnnnn

SEQ ID NO: 117751 - DNA, 314 bp, Homo sapiens
  misc_feature: GYAE6OF02G3F54.29.30.C08.1.454.CMB.1.raw
  modified_base (309)..(314): a, c, t, g, unknown or other
  misc_feature (309)..(314): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggacgcacctcgagagcacagcggtccctgggcctgcctggtacaaggctacttccacgtagccgtgctgagcgggctggcaaggcgcatagnnnnnn

SEQ ID NO: 117752 - DNA, 315 bp, Homo sapiens
  misc_feature: GYAE6OF02H2AXM.29.30.C08.1.454.CMB.1.raw
  modified_base (301)..(301): a, c, t, g, unknown or other
  misc_feature (301)..(301): n is a, c, g, or t
  modified_base (306)..(315): a, c, t, g, unknown or other
  misc_feature (306)..(315): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggcgccctgctccaggagcacctccgagagcacagccggccctgggctgcctggtcaaggatacttccacgtagcgtgctgagcgggctggcaaggcgnatagnnnnnnnnnn

SEQ ID NO: 117753 - DNA, 302 bp, Homo sapiens
  misc_feature: GYAE6OF02IK906.29.30.C08.1.454.CMB.1.raw
  modified_base (218)..(218): a, c, t, g, unknown or other
  misc_feature (218)..(218): n is a, c, g, or t
  modified_base (294)..(294): a, c, t, g, unknown or other
  misc_feature (294)..(294): n is a, c, g, or t
  modified_base (300)..(302): a, c, t, g, unknown or other
  misc_feature (300)..(302): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaccaagggcccatcggtcttcccctggcgccctgctccaggancacctcgagagcacagcggccctgggctgcctgcaaggctacttccacgtagcgtgctgagcgggctggcaaggcncatagnnn

SEQ ID NO: 117754 - DNA, 307 bp, Homo sapiens
  misc_feature: GYAE6OF02GRG6M.29.30.C08.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (282)..(282): a, c, t, g, unknown or other
  misc_feature (282)..(282): n is a, c, g, or t
  modified_base (297)..(307): a, c, t, g, unknown or other
  misc_feature (297)..(307): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagcctccaaccaaggcccatcggtccttcccctggccnccctgctccaggancacctccgagagcacagcggcctggctgctggtcaagctacttccagtgcgtgctgagcggntgcaaggcgcatagnnnnnnnnnnn

SEQ ID NO: 117755 - DNA, 337 bp, Homo sapiens
  misc_feature: GYAE6OF02IC6KN.29.30.C08.1.454.CMB.1.raw
  modified_base (300)..(300): a, c, t, g, unknown or other
  misc_feature (300)..(300): n is a, c, g, or t
  modified_base (309)..(337): a, c, t, g, unknown or other
  misc_feature (309)..(337): n is a, c, g, or t
tcagatagagtactcacgaccggtgctcgatttagtctgacgtcaaagggaaaggggctggagtgggtggccaacataaaccaagatggaagtgaacagtaactatgtggactctgtgaagggccgattcaccatctcagagacaacgccaaagaactcactgtctcctcagcctccaccaagggcccatcggtcttcccctggcgccctgctcaggagccacctccgagagccacagcggccctgggctgcctggtcaaggctactcacgtagcgtgctgagcgggctggacaaggccnctagtagcnnnnnnnnnnnnnnnnnnnnnnnnnnnnn

SEQ ID NO: 117756 - DNA, 313 bp, Homo sapiens
  misc_feature: GYAE6OF02GBNKA.29.30.C08.1.454.CMB.1.raw
  modified_base (304)..(313): a, c, t, g, unknown or other
  misc_feature (304)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnn

SEQ ID NO: 117757 - DNA, 465 bp, Homo sapiens
  misc_feature: GYAE6OF02HBCNT.29.30.C08.1.454.CMB.1.raw
  modified_base (212)..(212): a, c, t, g, unknown or other
  misc_feature (212)..(212): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (422)..(427): a, c, t, g, unknown or other
  misc_feature (422)..(427): n is a, c, g, or t
  modified_base (429)..(465): a, c, t, g, unknown or other
  misc_feature (429)..(465): n is a, c, g, or t
tcagatagagtactcacgaccggtgctcgatttagtctgacgtcaaagggaaaggggctggagtgggtggccaacataaaccaagatggaaggtgaacagtactatgtggactctgtgaaggccgattcacatctccagagacaacgccaagaactcactgtctcctcagccctccaccaagggcccagtccggttccttcccccgtggccnccccttgcctcccgagggacgccacccgtccggagacgaccactaggcccgggtcccctgggggtccttcggacccgtttggggtaccgaaaacgggtacctttaacccgtttccccgaaacgggttaacgggtcccggttagtcgttcgggaagggcccgggggtcttgggggaaccctaaacgggggccgccaagttgngtnaagctnnnnnntnnnnnnnnnnnnnnnnnnnnnnnnnnnnnnnnnnnnn

SEQ ID NO: 117758 - DNA, 320 bp, Homo sapiens
  misc_feature: GYAE6OF02F72EN.29.30.C08.1.454.CMB.1.raw
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
  modified_base (313)..(320): a, c, t, g, unknown or other
  misc_feature (313)..(320): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctcagagacaacgccaagaactcactgtctcctcagcctccaaccaagggccccatccggtccttcccccgtggccgccctgctccgaggancacctccgagagcacaggccggcctgggctgcctggtacaaggtactacttcacgtagcgtgctgaggcggctggacaggcncgatgnnnnnnnn

SEQ ID NO: 117759 - DNA, 325 bp, Homo sapiens
  misc_feature: GYAE6OF02IYIST.29.30.C08.1.454.CMB.1.raw
  modified_base (314)..(325): a, c, t, g, unknown or other
  misc_feature (314)..(325): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtccttcccctggcgccctgcctccaggagccacctccgagagccacaggccggcccgtggctgccgtggtcaaggcctacttccagtagcgtgctgagcgggctgggacaagggccacatagnnnnnnnnnnnn

SEQ ID NO: 117760 - DNA, 329 bp, Homo sapiens
  misc_feature: GYAE6OF02F3W9Y.29.30.C08.1.454.CMB.1.raw
  modified_base (219)..(219): a, c, t, g, unknown or other
  misc_feature (219)..(219): n is a, c, g, or t
  modified_base (287)..(287): a, c, t, g, unknown or other
  misc_feature (287)..(287): n is a, c, g, or t
  modified_base (305)..(306): a, c, t, g, unknown or other
  misc_feature (305)..(306): n is a, c, g, or t
  modified_base (308)..(329): a, c, t, g, unknown or other
  misc_feature (308)..(329): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggancacctccgagagcacagccggccctgggctgcctggtcaaggctactcacgtagcgtgctgagcgggntgggcaaggcgcagtagnngnnnnnnnnnnnnnnnnnnnnnn

SEQ ID NO: 117761 - DNA, 568 bp, Homo sapiens
  misc_feature: GYAE6OF02F199M.29.30.C08.1.454.CMB.1.raw
  modified_base (176)..(176): a, c, t, g, unknown or other
  misc_feature (176)..(176): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (457)..(458): a, c, t, g, unknown or other
  misc_feature (457)..(458): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagatagagtactcacgaccggtgctcgatttagtctgacgtcaaagggaagggcgtggagtgggtggccaacagtaaaccaagatggaagtgaacagtactactgtggtactctgtgaaagggtccgattcaccatctccagagacaacgccaagaactcactgtctctcgacncctccaccaacggcccacgtccggtacttccccgtggccgtccctacggtcctaccgaaggacgcctacctccggaagcgacgtaccacggccggtccttgggccttacgacccgttaggtacgtaacggtaccttacgtcccaaggttacggcgttcgtacgcggtaacggcgggtccgtaggaccgtaaggtacggccgtaagtaaggtctanacgtgagtggcnactcntacaggtnacgccagagnccgatcggatcgcngacaganacgnacacannacgcnacanagnagacgacagacacgacgcgacgcgngangtgtacgcgngagacgcgacgngcgtacnctcacgcgtacgagtgacgtcgtcgtacgacgacgacgacg

SEQ ID NO: 117762 - DNA, 385 bp, Homo sapiens
  misc_feature: GYAE6OF02JBNA2.29.30.C08.1.454.CMB.1.raw
  modified_base (351)..(385): a, c, t, g, unknown or other
  misc_feature (351)..(385): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcacgccctccaccgaacgggcccatccggtccttccccctggccgccctgcctccgagggacgccacctccgaaggcgccacgacggccggcccgtggggctcggccgtggtacaagggacttaccgttcccacggtagccggtagcgtgacggcgggcgtgggcaagggccgcaagtagcannnnnnnnnnnnnnnnnnnnnnnnnnnnnnnnnnn

SEQ ID NO: 117763 - DNA, 317 bp, Homo sapiens
  misc_feature: GYAE6OF02GU1MF.29.30.C08.1.454.CMB.1.raw
  modified_base (309)..(309): a, c, t, g, unknown or other
  misc_feature (309)..(309): n is a, c, g, or t
  modified_base (311)..(317): a, c, t, g, unknown or other
  misc_feature (311)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggccgccctgctccaggagcacctccgagacgcacgacgcggccctgggctcgcctggtcaaggctacttccacgtagcgtgctgagcgggctggcaaggcgcatagncnnnnnnn

SEQ ID NO: 117764 - DNA, 376 bp, Homo sapiens
  misc_feature: GYAE6OF02FJPTW.29.30.C08.1.454.CMB.1.raw
  modified_base (237)..(237): a, c, t, g, unknown or other
  misc_feature (237)..(237): n is a, c, g, or t
  modified_base (319)..(376): a, c, t, g, unknown or other
  misc_feature (319)..(376): n is a, c, g, or t
tcagatagagtactcacgaccggtgctcgatttagtctgacgtcaaagggaaggggctggagtgggtggccaacataaaccaagatggaagtgaacagtactatgtggactctgtgaagggccgattcaccatctccagagacaacgccaagaactcactgtctcctcagcctccaccaagggcccatcggtcttccccctggccgccctgctccaggacgcacctccgagagcacngcgccctgggctgcctggtcaaggtacttacttccacgtagcgtgctgaggccggggctcgggacaagggtccgacaatagnnnnnnnnnnnnnnnnnnnnnnnnnnnnnnnnnnnnnnnnnnnnnnnnnnnnnnnnnn

SEQ ID NO: 117765 - DNA, 309 bp, Homo sapiens
  misc_feature: GYAE6OF02FV47S.29.30.C08.1.454.CMB.1.raw
  modified_base (303)..(309): a, c, t, g, unknown or other
  misc_feature (303)..(309): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttcccctggccgccctgctccaggagcacctccgagagcacagcggcctgggctgcctggtcaggactacttccagtagcgtgctgaggcgggctggcaggcgcatgnnnnnnn

SEQ ID NO: 117766 - DNA, 313 bp, Homo sapiens
  misc_feature: GYAE6OF02I2Z15.29.30.C08.1.454.CMB.1.raw
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagatcacagcgccctgggctgcctggtcaaggactacttccacggtagcgtgctggagcgggctggcaaggcgcatagnnnnnnnn

SEQ ID NO: 117767 - DNA, 306 bp, Homo sapiens
  misc_feature: GYAE6OF02FRBIC.29.30.C08.1.454.CMB.1.raw
  modified_base (303)..(306): a, c, t, g, unknown or other
  misc_feature (303)..(306): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccagtagcgtgctgagcgggctggcaaggcgcatagnnnn

SEQ ID NO: 117768 - DNA, 484 bp, Homo sapiens
  misc_feature: GYAE6OF02GHUBJ.29.30.C08.1.454.CMB.1.raw
  modified_base (229)..(229): a, c, t, g, unknown or other
  misc_feature (229)..(229): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (373)..(376): a, c, t, g, unknown or other
  misc_feature (373)..(376): n is a, c, g, or t
  modified_base (378)..(378): a, c, t, g, unknown or other
  misc_feature (378)..(378): n is a, c, g, or t
  modified_base (380)..(381): a, c, t, g, unknown or other
  misc_feature (380)..(381): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
  modified_base (426)..(427): a, c, t, g, unknown or other
  misc_feature (426)..(427): n is a, c, g, or t
  modified_base (430)..(432): a, c, t, g, unknown or other
  misc_feature (430)..(432): n is a, c, g, or t
  modified_base (434)..(435): a, c, t, g, unknown or other
  misc_feature (434)..(435): n is a, c, g, or t
  modified_base (439)..(440): a, c, t, g, unknown or other
  misc_feature (439)..(440): n is a, c, g, or t
  modified_base (446)..(446): a, c, t, g, unknown or other
  misc_feature (446)..(446): n is a, c, g, or t
  modified_base (448)..(450): a, c, t, g, unknown or other
  misc_feature (448)..(450): n is a, c, g, or t
  modified_base (452)..(453): a, c, t, g, unknown or other
  misc_feature (452)..(453): n is a, c, g, or t
  modified_base (456)..(457): a, c, t, g, unknown or other
  misc_feature (456)..(457): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (475)..(476): a, c, t, g, unknown or other
  misc_feature (475)..(476): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
tcagatagagtactcacgaccggtgctcgatttagtctgacgtcaaagggaaaggggctgggagtgggtggccaaccataaaccaagatggaagttgaccagtactatgttggactcgtgtgaaggccgattcaccagtctccacgagacaacgccagaactcactgtctcctcagcctccaccaacgggccccatccggtccttccccgtggccgccctgctccaggnccactccgagacgcacacgccggaccgtggctgccgtggtcgaagcctcttccgacggtcgacggtcgcgtaggacggtccggggtctcggaccgtaacgggtcggttaccaaggtttaggctcgctgagcancnggtnacgtnnnncncnncacgcgacncncacgacgctcgcncgngcgngcnctcntgncngnncannncnnagcnngcgcgncnnnannctnngngnatgtcncncncncnncncgcncg

SEQ ID NO: 117769 - DNA, 320 bp, Homo sapiens
  misc_feature: GYAE6OF02GR6G6.29.30.C08.1.454.CMB.1.raw
  modified_base (313)..(320): a, c, t, g, unknown or other
  misc_feature (313)..(320): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcgtccttcccctggccgccctgctccgaggacgcacctccgagagcacaggccggcccgtgggctcgcctggtcaaggacttacttccacgtagcgtgctgagcgggctggcaaggcgcatagnnnnnnnn

SEQ ID NO: 117770 - DNA, 313 bp, Homo sapiens
  misc_feature: GYAE6OF02ITSEO.29.30.C08.1.454.CMB.1.raw
  modified_base (306)..(313): a, c, t, g, unknown or other
  misc_feature (306)..(313): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctcagagacaacgccaagaactcactgtctcctcagcctccaccaagggcccatcggtcttcccctggccgccctgctccaggagcacctccgagagcacagccggccctgggctgcctggtcaaggactacttccacgtagcgtgctgagcgggctggcaaggcgcatagnnnnnnnn

SEQ ID NO: 117771 - DNA, 403 bp, Homo sapiens
  misc_feature: GYAE6OF02FUMRQ.29.30.C08.1.454.CMB.1.raw
  modified_base (229)..(229): a, c, t, g, unknown or other
  misc_feature (229)..(229): n is a, c, g, or t
  modified_base (363)..(403): a, c, t, g, unknown or other
  misc_feature (363)..(403): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtcctcctcagccctccaccaacgggccccagtccggtccttccccctggccgcccctgctccagganccacctccgagacgcacacgccggcccgtgggcctcgcccgttggtaccgaaggaccttaacgttccccaacgtaggaccggtgaccgttggacggccggggactggggaccaaggggccgtccaagtaggcannnnnnnnnnnnnnnnnnnnnnnnnnnnnnnnnnnnnnnnn

SEQ ID NO: 117772 - DNA, 335 bp, Homo sapiens
  misc_feature: GYAE6OF02GTSSF.29.30.C08.1.454.CMB.1.raw
  modified_base (290)..(290): a, c, t, g, unknown or other
  misc_feature (290)..(290): n is a, c, g, or t
  modified_base (314)..(315): a, c, t, g, unknown or other
  misc_feature (314)..(315): n is a, c, g, or t
  modified_base (317)..(335): a, c, t, g, unknown or other
  misc_feature (317)..(335): n is a, c, g, or t
tcagatagagtactcacgaccggtgctcgatttagtctgacgtcaaagggaaagggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgcctccaggagccacctccgagagccacagccggccctgggctgccgtggtcaaggactacttccacgtagcgtgctggngcgggtctggcaaggcgcagtagnnannnnnnnnnnnnnnnnnnn

SEQ ID NO: 117773 - DNA, 620 bp, Homo sapiens
  misc_feature: GYAE6OF02INZJ0.29.30.C08.1.454.CMB.1.raw
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
tcagatagagtactcacgaccggtgctcgatttagtctgacgtcaaaagggtaaagggggtcgtggagtgggtggccaacaagtaaaccaagatggaagtgaacagtactatcgtggactctgtgacgggcgattcacatctccagagacaacgccaagaactcactgtctcctcacgcctccacaacggccatccggtccttcccctggccgcctgcctcaggacgccacctcgacgacgacacgacggccggtccccgttgggtcctcggtcctagggtaaccgaaacggtacctttaccgttacccgtaaccggtaacggtcccggtaagccgtacgggacgggccggggtctaccgggactaaacgggcgtacaggttacgnctcgnacgngnacgngtccacncgatcgcncgagcgtcncgtagctaacncncacgtactctacgacacgacgcgtacgactacgcgagtacgtacgtacgtcacgtacgtcgtagtactacgtactactatctcgttactactacgtcgtacgacgtacgtacgacgtacgacgtacgtacgtacgtacgacgtagtcgtacgtacgtacgtactactacgtcgtactactcg

SEQ ID NO: 117774 - DNA, 415 bp, Homo sapiens
  misc_feature: GYAE6OF02J1VCX.29.30.C08.1.454.CMB.1.raw
  modified_base (360)..(361): a, c, t, g, unknown or other
  misc_feature (360)..(361): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (371)..(415): a, c, t, g, unknown or other
  misc_feature (371)..(415): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctcagagacaacgccaagaactcactgtcctcctcagcctccaccaacgggcccatccggtccttcccccgtggccgccctgcctccgaggacgccacctccgagacgcaccagccggtccctgggcctcggccgtggacaacggcctacgttcccacggttagtccggtagtcctggtaaggcccggggtcgtcgggaccaacgggtccggacctagtaacggnngntcgngtcnnnnnnnnnnnnnnnnnnnnnnnnnnnnnnnnnnnnnnnnnnnnn

SEQ ID NO: 117775 - DNA, 327 bp, Homo sapiens
  misc_feature: GYAE6OF02H0O69.29.30.C08.1.454.CMB.1.raw
  modified_base (313)..(313): a, c, t, g, unknown or other
  misc_feature (313)..(313): n is a, c, g, or t
  modified_base (319)..(327): a, c, t, g, unknown or other
  misc_feature (319)..(327): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggccgccctgctccaggacgcacctcgagagcacagccggccctgggctgcctggtacaaggacttaccttccacgtagcgtgactgaggcgggctcggcgaagggtccncatagnnnnnnnnn

SEQ ID NO: 117776 - DNA, 318 bp, Homo sapiens
  misc_feature: GYAE6OF02FTYML.29.30.C08.1.454.CMB.1.raw
  modified_base (299)..(299): a, c, t, g, unknown or other
  misc_feature (299)..(299): n is a, c, g, or t
  modified_base (305)..(318): a, c, t, g, unknown or other
  misc_feature (305)..(318): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggcctgggctgcctggtcaaggactacttccacgtagcgtgctgagcgggctggcaagggcncatagnnnnnnnnnnnnnn

SEQ ID NO: 117777 - DNA, 327 bp, Homo sapiens
  misc_feature: GYAE6OF02JLCL6.29.30.C08.1.454.CMB.1.raw
  modified_base (224)..(224): a, c, t, g, unknown or other
  misc_feature (224)..(224): n is a, c, g, or t
  modified_base (314)..(327): a, c, t, g, unknown or other
  misc_feature (314)..(327): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaacgggcccatcggtcttcccctggccgccctgcctccagggacncaccctccgagagcacagccggccctgggcctgcctggtccaaggctacttccacgtgcgtgctgacgcgggctggcaaggcgcataggnnnnnnnnnnnnnn

SEQ ID NO: 117778 - DNA, 331 bp, Homo sapiens
  misc_feature: GYAE6OF02GS2NN.29.30.C08.1.454.CMB.1.raw
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (313)..(314): a, c, t, g, unknown or other
  misc_feature (313)..(314): n is a, c, g, or t
  modified_base (316)..(331): a, c, t, g, unknown or other
  misc_feature (316)..(331): n is a, c, g, or t
tcagatagagtactcacgaccggtgctcgatttagtctgacgtcaaagggaaagggggtcgtggaagtgggtggccaacataaaccaagatggaagtgaacagtactatgtggactctgtgaagggccgattcaccatctccagagacaacgccaagaactcactgtctcctcagcctccaccgaagggcccatccggtcttcccctggcgccctgctccaggagcacctccgagagcacagcggccctgggcctgcctggtcaaggactactccagtagcgtgctgagcgggctggcaagggcncatagngnngnnnnnnnnnnnnnnnn

SEQ ID NO: 117779 - DNA, 326 bp, Homo sapiens
  misc_feature: GYAE6OF02GL9VC.29.30.C08.1.454.CMB.1.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (290)..(290): a, c, t, g, unknown or other
  misc_feature (290)..(290): n is a, c, g, or t
  modified_base (306)..(326): a, c, t, g, unknown or other
  misc_feature (306)..(326): n is a, c, g, or t
tcagatagagtactcacgaccggtgctcgatttagtctgacgtcaaagggaagggggctgggagtgggtggccaacataaaccaagatggaagtgaacagtactatgtggactctgtgaagggccgattcaccatctccagagacaacgccaagaactcactgtctcctcagcctccaccaagggccctatcggtcttcccctggcgccctgctccaggancacctccgagngcacagcggcctgggctgcctggtcaaggactacttccacgtagcgtgctgagcgggntggcaaggcgcagtgnnnnnnnnnnnnnnnnnnnnn

SEQ ID NO: 117780 - DNA, 316 bp, Homo sapiens
  misc_feature: GYAE6OF02GJR7X.29.30.C08.1.454.CMB.1.raw
  modified_base (303)..(316): a, c, t, g, unknown or other
  misc_feature (303)..(316): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcggctggcaaggcgcatgnnnnnnnnnnnnnn

SEQ ID NO: 117781 - DNA, 325 bp, Homo sapiens
  misc_feature: GYAE6OF02JD7J8.29.30.C08.1.454.CMB.1.raw
  modified_base (307)..(325): a, c, t, g, unknown or other
  misc_feature (307)..(325): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccacccaagggcccatcgtcttccccgtgccgccctgctccaggacgcacctcgagcgcacagccggccctgggctcgcctgacgaacggactcgttccacgtagcgtgctgagcggctggcaggcgcgatgnnnnnnnnnnnnnnnnnnn

SEQ ID NO: 117782 - DNA, 384 bp, Homo sapiens
  misc_feature: GYAE6OF02JWLCE.29.30.C08.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (347)..(349): a, c, t, g, unknown or other
  misc_feature (347)..(349): n is a, c, g, or t
  modified_base (353)..(353): a, c, t, g, unknown or other
  misc_feature (353)..(353): n is a, c, g, or t
  modified_base (356)..(384): a, c, t, g, unknown or other
  misc_feature (356)..(384): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacacgccagaactcactgtctcctcagcctccaccaaggcccatcgtccttccccnggccnccctgctccaggacgccacctccgagacgccacgacgccggtccccgngggcctcgccgtggtccaaggccgttacttccgacgtacgcgtcgaccgttggacggtccgggacttcgggaccgaagggcccgnacgtagntcgnnnagcncgnnnnnnnnnnnnnnnnnnnnnnnnnnnnn

SEQ ID NO: 117783 - DNA, 347 bp, Homo sapiens
  misc_feature: GYAE6OF02JZ86Y.29.30.C08.1.454.CMB.1.raw
  modified_base (330)..(347): a, c, t, g, unknown or other
  misc_feature (330)..(347): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccagggcccatcggtccttcccctggccgcccctgcctccaggacgccacctccggagagccacaggccggccctgggcctgccgtggtacaaggacctacgttcccacggttagcgtcgctgacggcgggctggactagggcgacgataggnnnnnnnnnnnnnnnnnn

SEQ ID NO: 117784 - DNA, 325 bp, Homo sapiens
  misc_feature: GYAE6OF02G8L6S.29.30.C08.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (300)..(306): a, c, t, g, unknown or other
  misc_feature (300)..(306): n is a, c, g, or t
  modified_base (308)..(325): a, c, t, g, unknown or other
  misc_feature (308)..(325): n is a, c, g, or t
tcagatagagtactcacgaccggtgctcgatttagtctgacgtcaaagggaaaggggcgtggagtgggtggccaacataaaccaagatggaagtgaacagtactatgtggactctgtgaagggccgattcaccatctcagagacaacgccaagaactcactgtctcctcagcctcaccaaggccatcggtcttccccngcgcctgctcagngcacctccgagagcacngccggaccctgggctgcctggtcaaggactacttccagtagcgtnctagagcgggntgcaaggcgacntagnnnnnnntnnnnnnnnnnnnnnnnnn

SEQ ID NO: 117785 - DNA, 326 bp, Homo sapiens
  misc_feature: GYAE6OF02GB64A.29.30.C08.1.454.CMB.1.raw
  modified_base (314)..(326): a, c, t, g, unknown or other
  misc_feature (314)..(326): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtccttccccctggccgccctgctccaggagccacctccgagagccacgacgccggccctgggctgccctggtcaaggactactccacgtagcgtgctgaggcggctggcaaggcgcagtagnnnnnnnnnnnnn

SEQ ID NO: 117786 - DNA, 312 bp, Homo sapiens
  misc_feature: GYAE6OF02I1HGA.29.30.C08.1.454.CMB.1.raw
  modified_base (306)..(312): a, c, t, g, unknown or other
  misc_feature (306)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatccggtcttcccctggcgccctgctccaggacgcacctccgagagcacagcggccctgggctgccgtggtcaaggctacttccacgtagcgtgctgacgcggctggcaaggcgcatgnnnnnnn

SEQ ID NO: 117787 - DNA, 382 bp, Homo sapiens
  misc_feature: GYAE6OF02FY77E.29.30.C08.1.454.CMB.1.raw
  modified_base (346)..(349): a, c, t, g, unknown or other
  misc_feature (346)..(349): n is a, c, g, or t
  modified_base (351)..(382): a, c, t, g, unknown or other
  misc_feature (351)..(382): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccaagggcccatcggtccttcccccgtggccgccctgcctcccgaggacgcctaccctccgagacgccaacgacggccggcccgtggggcctcggcccgtggtaccaaggtacctaccttccgacgttacgcgtgctgaggcgggctggcgaacgggcgacagtaggnnnngnnnnnnnnnnnnnnnnnnnnnnnnnnnnnnnn

SEQ ID NO: 117788 - DNA, 312 bp, Homo sapiens
  misc_feature: GYAE6OF02GKW5I.29.30.C08.1.454.CMB.1.raw
  modified_base (305)..(312): a, c, t, g, unknown or other
  misc_feature (305)..(312): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagccggcctgggctgcctggtcaaggctacttccacgtagcgtgctgagcgggctggcaaggcgcagtagnnnnnnnn

SEQ ID NO: 117789 - DNA, 427 bp, Homo sapiens
  misc_feature: GYAE6OF02HU341.29.30.C08.1.454.CMB.1.raw
  modified_base (228)..(228): a, c, t, g, unknown or other
  misc_feature (228)..(228): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (344)..(345): a, c, t, g, unknown or other
  misc_feature (344)..(345): n is a, c, g, or t
  modified_base (347)..(348): a, c, t, g, unknown or other
  misc_feature (347)..(348): n is a, c, g, or t
  modified_base (350)..(350): a, c, t, g, unknown or other
  misc_feature (350)..(350): n is a, c, g, or t
  modified_base (352)..(353): a, c, t, g, unknown or other
  misc_feature (352)..(353): n is a, c, g, or t
  modified_base (355)..(355): a, c, t, g, unknown or other
  misc_feature (355)..(355): n is a, c, g, or t
  modified_base (358)..(359): a, c, t, g, unknown or other
  misc_feature (358)..(359): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (371)..(427): a, c, t, g, unknown or other
  misc_feature (371)..(427): n is a, c, g, or t
tcagatagagtactcacgaccggtgctcgatttagtctgacgtcaaagggaaagggggctggagtgggtggccaacataaaccaagatggaagtgaacagtactatgtggactctgtgaagggccgattcaccatcctcagagacaacgccaagaactcactgtctcctcagcctccaccaagggcccatcggtccttccccctggccgccctgacctcccgaggacnccacctccgagacgcacagccggcccctggggctggcctggtcaaggaccttacttcccgagttagccgttgcctggagccggggntgggacaaggggccnccaagtacggntagnnanncnannangcnngnacgnacgntnnnnnnnnnnnnnnnnnnnnnnnnnnnnnnnnnnnnnnnnnnnnnnnnnnnnnnnnn

SEQ ID NO: 117790 - DNA, 435 bp, Homo sapiens
  misc_feature: GYAE6OF02GCQR9.29.30.C08.1.454.CMB.1.raw
  modified_base (176)..(176): a, c, t, g, unknown or other
  misc_feature (176)..(176): n is a, c, g, or t
  modified_base (372)..(376): a, c, t, g, unknown or other
  misc_feature (372)..(376): n is a, c, g, or t
  modified_base (378)..(435): a, c, t, g, unknown or other
  misc_feature (378)..(435): n is a, c, g, or t
tcagatagagtactcacgaccggtgctcgatttagtctgacgtcaaaagggaaagggggctggagtgggtggccaacataaaaccaagatggaagtgaacagtactatgtggactctgtgaagggccgtattcaccatctccagagacaacgccaagaactcactgtctcctcacncctccaccaagggccaatccggtccttccccctggcccgccctgcctccgaggacgccaccctccgagacgccacgaggcccggccccgtgggcctcgcccgtggtaccaaacggtaccttaccttacccgacggtacgcgtgtccgtggaccgggcggggctggggacgaacgggccgacgaatacggcagcatnnnnntnnnnnnnnnnnnnnnnnnnnnnnnnnnnnnnnnnnnnnnnnnnnnnnnnnnnnnnnnn

SEQ ID NO: 117791 - DNA, 397 bp, Homo sapiens
  misc_feature: GYAE6OF02GXYCM.29.30.C08.1.454.CMB.1.raw
  modified_base (333)..(338): a, c, t, g, unknown or other
  misc_feature (333)..(338): n is a, c, g, or t
  modified_base (340)..(341): a, c, t, g, unknown or other
  misc_feature (340)..(341): n is a, c, g, or t
  modified_base (343)..(343): a, c, t, g, unknown or other
  misc_feature (343)..(343): n is a, c, g, or t
  modified_base (347)..(397): a, c, t, g, unknown or other
  misc_feature (347)..(397): n is a, c, g, or t
tcagatagagtactcacgaccggtgctcgatttagtctgacgtcaaagggaaagggggctggagtgggtggccaacataaaccaagatggaagtgaacagtactatgtggactctgtggaagggccgattcaccatctccagagacaacgccaagaactcactgtctcctcagcctccaccaagggcccatcggtccttccccctgggccgccctgctccaggagcacctccgagacgcacagccggccctggggcctggccctgggtaccaaggtactacgttccacggtagcgtagctgacgcggggctggggaccaagggcgccaatcgnnnnnnannangcannnnnnnnnnnnnnnnnnnnnnnnnnnnnnnnnnnnnnnnnnnnnnnnnnn

SEQ ID NO: 117792 - DNA, 424 bp, Homo sapiens
  misc_feature: GYAE6OF02HR6VB.29.30.C08.1.454.CMB.1.raw
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (360)..(361): a, c, t, g, unknown or other
  misc_feature (360)..(361): n is a, c, g, or t
  modified_base (365)..(424): a, c, t, g, unknown or other
  misc_feature (365)..(424): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccgaagggccccatccggtccttcccccgtggccgccctgcctccgagggagccacccgtccggagacgtccacacggccggcccgtgggctcggcctggtcaaggactaccttccaacggtagccgtagctaggacggcgggcgtagggccgaaagggccgtaccagtaacggntgnatcnnctgnnnnnnnnnnnnnnnnnnnnnnnnnnnnnnnnnnnnnnnnnnnnnnnnnnnnnnnnnnnn

SEQ ID NO: 117793 - DNA, 448 bp, Homo sapiens
  misc_feature: GYAE6OF02HYLGM.29.30.C08.1.454.CMB.1.raw
  modified_base (172)..(172): a, c, t, g, unknown or other
  misc_feature (172)..(172): n is a, c, g, or t
  modified_base (391)..(391): a, c, t, g, unknown or other
  misc_feature (391)..(391): n is a, c, g, or t
  modified_base (393)..(394): a, c, t, g, unknown or other
  misc_feature (393)..(394): n is a, c, g, or t
  modified_base (396)..(396): a, c, t, g, unknown or other
  misc_feature (396)..(396): n is a, c, g, or t
  modified_base (401)..(448): a, c, t, g, unknown or other
  misc_feature (401)..(448): n is a, c, g, or t
tcagatagagtactcacgaccggtgctcgatttagtctgacgtcaaaagggaaaggggctggagtgggtggccaacataaaaccaagatggaagtgaacagtactatgtggactctgtgaagggccgattcaccatctccagagacaacgccaagaactcactgtcctcctnacgccctccaccaacgggcccattccggtcccttccccctgggccgccccttgcctcccgaggacgccaccgtcccggagacgccaacgacggcccgggcccctggggtcctgcccgttgggtaaccaaaggggtaccttaaccgtttcccaacggttaggccggttcgccgtggaacggtccggggtctagggaccgaagggcccgcaaggttaaggntnntnctgcnnnnnnnnnnnnnnnnnnnnnnnnnnnnnnnnnnnnnnnnnnnnnnnn

SEQ ID NO: 117794 - DNA, 410 bp, Homo sapiens
  misc_feature: GYAE6OF02HB4Y6.29.30.C08.1.454.CMB.1.raw
  modified_base (253)..(253): a, c, t, g, unknown or other
  misc_feature (253)..(253): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (374)..(410): a, c, t, g, unknown or other
  misc_feature (374)..(410): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagccctccaccaagggccccagtccggtcccttcccccgtggccgtccctgctcccgaggacgccacccgtccgagtcgccacncgaccggtcccgtgggcttcggccttggtacgaacggaccttaccttccgacgtacggcctgccgtggcggaccggggtctgggacccgtaagggcccgacgtagttaggcactgnacncnnnnnnnnnnnnnnnnnnnnnnnnnnnnnnnnnnnnn

SEQ ID NO: 117795 - DNA, 420 bp, Homo sapiens
  misc_feature: GYAE6OF02IYTY7.29.30.C08.1.454.CMB.1.raw
  modified_base (231)..(231): a, c, t, g, unknown or other
  misc_feature (231)..(231): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (349)..(351): a, c, t, g, unknown or other
  misc_feature (349)..(351): n is a, c, g, or t
  modified_base (353)..(420): a, c, t, g, unknown or other
  misc_feature (353)..(420): n is a, c, g, or t
tcagatagagtactcacgaccggtgctcgatttagtctgacgtcaaaggggaaaggggctggagtgggtggccaacataaaccaagatggaagtgaacagtactatgtggactctgtgaagggccgattcaccatctccagagacaacgccaagaactcactgtctcctcagccctccaccgaagggccccatcggtccttcccccgtggccgccccttgcctccgaggcnccacctccgagagcacaggccggccctgggcctcgccgtgggtaccgaaggtccttaaccttcccaggtagccgtgctggacggcgggctggactaaggccgtacaagtagncngagnnncnnnnnnnnnnnnnnnnnnnnnnnnnnnnnnnnnnnnnnnnnnnnnnnnnnnnnnnnnnnnnnnnnnnn

SEQ ID NO: 117796 - DNA, 560 bp, Homo sapiens
  misc_feature: GYAE6OF02GKSSZ.29.30.C08.1.454.CMB.1.raw
  modified_base (144)..(144): a, c, t, g, unknown or other
  misc_feature (144)..(144): n is a, c, g, or t
  modified_base (221)..(221): a, c, t, g, unknown or other
  misc_feature (221)..(221): n is a, c, g, or t
  modified_base (302)..(302): a, c, t, g, unknown or other
  misc_feature (302)..(302): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (340)..(341): a, c, t, g, unknown or other
  misc_feature (340)..(341): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (457)..(457): a, c, t, g, unknown or other
  misc_feature (457)..(457): n is a, c, g, or t
tcagatagagtactcacgaccggtgctcgattttagtctgacgtcaaagggaaagggggctggaggtgggtggccgaacataaaccaagatggaagtgaacagtactatgtggactctgtgaagggccgattcaccatctcganagacaacgccaagaactcactgtctcctcagcctccacacgggcccagtcgtcttcccctgccgcctgactccaggngcacctccgagacgcgactagcggccttgggcctagcctgtacgtaaggacttactccagtacgcgtgctgaagtccgggntaggccgtaaagggcgtacctagttaaggcngngtacnncgatacggactcagcttagatcagcagtnaactgtaanagtcngacgtnactagtacgtntcganacgtacgtacgagacgcaggactacgaagttagactattcggtacacgtanacgacgtacgagtcgtacgtacgtacgtagtagtcgacgcgacgacgtacgtacgtcgtacgtacgtacgacacgacggtacgtacgtacgtactacgacgtc

SEQ ID NO: 117797 - DNA, 673 bp, Homo sapiens
  misc_feature: GYAE6OF02HQJTQ.29.30.C08.1.454.CMB.1.raw
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
  modified_base (476)..(476): a, c, t, g, unknown or other
  misc_feature (476)..(476): n is a, c, g, or t
  modified_base (506)..(506): a, c, t, g, unknown or other
  misc_feature (506)..(506): n is a, c, g, or t
  modified_base (531)..(531): a, c, t, g, unknown or other
  misc_feature (531)..(531): n is a, c, g, or t
  modified_base (552)..(552): a, c, t, g, unknown or other
  misc_feature (552)..(552): n is a, c, g, or t
  modified_base (575)..(575): a, c, t, g, unknown or other
  misc_feature (575)..(575): n is a, c, g, or t
  modified_base (597)..(597): a, c, t, g, unknown or other
  misc_feature (597)..(597): n is a, c, g, or t
  modified_base (607)..(607): a, c, t, g, unknown or other
  misc_feature (607)..(607): n is a, c, g, or t
  modified_base (626)..(626): a, c, t, g, unknown or other
  misc_feature (626)..(626): n is a, c, g, or t
  modified_base (643)..(643): a, c, t, g, unknown or other
  misc_feature (643)..(643): n is a, c, g, or t
tcagatagagtactcacgaccggtgctcgatttagtctgacgtcaaagggaaaggggctggagtgggtggccaacataaaccaagatggaagtgaacagtactatgtggactctgtagaagggccgattcaccatctccagagacaacgccaagaactcactgtctcctcagtcctccaccaagggcccagtcggtccttccccctggccgtccctgccgtccgtaggacgccaccgtccgagacgctacacggtccggcccgtggggtcctcgtcccgtacgggttaccgaaaacggtaccgttaacctttccgaacggttaacggccgtaggccgttagggaaggtcggggcttacgggacgaaacggggtcccacggtaagtacggctgtacagtcgagcgtatatacggtgacnggtaacctgtancgtgatttaccgtaagngtcagtgacgtcgaagtgacttacggtanaactcgtaacggtctggtaacttaacggtnaacgtttaggccttacggtaacccngtttcaacgttgccgttaagngtacgttaccggaatttcgaacnccgttagggtaccttaaaccgnttaaccgggnttccgggcttaagaacggnttaacgcttcggaaccnggtaaccttggaccgtcggttacaaccggg

SEQ ID NO: 117798 - DNA, 410 bp, Homo sapiens
  misc_feature: GYAE6OF02HEJD9.29.30.C08.1.454.CMB.1.raw
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (357)..(410): a, c, t, g, unknown or other
  misc_feature (357)..(410): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcacgcctccaccgaagggccccagtccggtccttcccccgggtcccgcccctgcctccagggacgccacccgtccggagacggccacgagccgggcccctggggctggcccgtggtaccaaggacctaccttccagtacgcggtncgtgaggccgggctgggacgaacgggccgacacgttagcangcnnnnnnnnnnnnnnnnnnnnnnnnnnnnnnnnnnnnnnnnnnnnnnnnnnnnnn

SEQ ID NO: 117799 - DNA, 376 bp, Homo sapiens
  misc_feature: GYAE6OF02JCZ3C.29.30.C08.1.454.CMB.1.raw
  modified_base (337)..(376): a, c, t, g, unknown or other
  misc_feature (337)..(376): n is a, c, g, or t
tcagatagagtactcacgaccggtgctcgatttagtctgacgtcaaagggaaaggggctggagtgggtggccaacataaaccaagatggaagtgaacagtactatgtggactctgtgaaggccgattcaccatctccagagacaacgccaagaactcactgtctcctcagccctccaccgaagggcccatccggtccttcccccgtgggccgcccctgcctaccgaggacgccacctccggagacgcacacgccggccctgggcctggccctggtaccaaggaccttactccgacgtagccgtgcttggacggcggctagggcaacggcacatacgnnnnnnnnnnnnnnnnnnnnnnnnnnnnnnnnnnnnnnnn

SEQ ID NO: 117800 - DNA, 354 bp, Homo sapiens
  misc_feature: GYAE6OF02GFW5A.29.30.C08.1.454.CMB.1.raw
  modified_base (144)..(144): a, c, t, g, unknown or other
  misc_feature (144)..(144): n is a, c, g, or t
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (311)..(311): a, c, t, g, unknown or other
  misc_feature (311)..(311): n is a, c, g, or t
  modified_base (319)..(354): a, c, t, g, unknown or other
  misc_feature (319)..(354): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagaganaacgccaagaactcactgtctcctcagcctacaccaagggcccatcggtcttccccctggccnccctgctccaggngccacctccggagngcacagccggccctgggctggcctggtacaaggacctacttccgacgtagcgtagctgaggcgggctggccaaggcncagtacgnnnnnnnnnnnnnnnnnnnnnnnnnnnnnnnnnnnn

SEQ ID NO: 117801 - DNA, 317 bp, Homo sapiens
  misc_feature: GYAE6OF02FMRNW.29.30.C08.1.454.CMB.1.raw
  modified_base (218)..(218): a, c, t, g, unknown or other
  misc_feature (218)..(218): n is a, c, g, or t
  modified_base (290)..(290): a, c, t, g, unknown or other
  misc_feature (290)..(290): n is a, c, g, or t
  modified_base (307)..(317): a, c, t, g, unknown or other
  misc_feature (307)..(317): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatcggtcttccccctggcgccctgctccaggngcacctccgagagcacagccggccctgggctgcctggtcaaggactacttccacgtagcgtgctgagcgggntggcaaggcgcgatagnnnnnnnnnnn

SEQ ID NO: 117802 - DNA, 321 bp, Homo sapiens
  misc_feature: GYAE6OF02F74ZD.29.30.C08.1.454.CMB.1.raw
  modified_base (305)..(321): a, c, t, g, unknown or other
  misc_feature (305)..(321): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcatagnnnnnnnnnnnnnnnnn

SEQ ID NO: 117803 - DNA, 370 bp, Homo sapiens
  misc_feature: GYAE6OF02GUS7R.29.30.C08.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (307)..(308): a, c, t, g, unknown or other
  misc_feature (307)..(308): n is a, c, g, or t
  modified_base (311)..(314): a, c, t, g, unknown or other
  misc_feature (311)..(314): n is a, c, g, or t
  modified_base (316)..(370): a, c, t, g, unknown or other
  misc_feature (316)..(370): n is a, c, g, or t
tcagatagagtactcacgaccggtgctcgatttagtctgacgtcaaagggaaaggggctggagtgggtggccaacataaaaccaagatggaagtgaacagtactatgtggactctgtgaaggccgattcaccatctcagagacaacgccaagaactcactgtctcctcagcctccaccaaggcccatcggtctcccctggcnccctgctcaggancacctccgangcacagtcgcctgggctgcctggtacaaaggctaccttccaggtagcgtgctggagcgggntggctaaggcgacagtagnanntcnnnnannnnnnnnnnnnnnnnnnnnnnnnnnnnnnnnnnnnnnnnnnnnnnnnnnnnnnn

SEQ ID NO: 117804 - DNA, 393 bp, Homo sapiens
  misc_feature: GYAE6OF02F2K7H.29.30.C08.1.454.CMB.1.raw
  modified_base (229)..(229): a, c, t, g, unknown or other
  misc_feature (229)..(229): n is a, c, g, or t
  modified_base (321)..(322): a, c, t, g, unknown or other
  misc_feature (321)..(322): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (332)..(393): a, c, t, g, unknown or other
  misc_feature (332)..(393): n is a, c, g, or t
tcagatagagtactcacgaccggtgctcgatttagtctgacgtcaaaagggaaagggggctggagtgggtggccaacataaaaccaagatggaagtgaacagtactatgtggactctgtgaagggccgattcaccatctccagagacaacgccaagaactcactgtctcctcagccctaccaccaacgggcccatcggtccttccccctggccgccctgcctccaggcnccacctccgagagccacaggccgccgtgggactcgcctggtacaagactactccagtagcgtgctgaggcggacgtgacgaggcgcagtagnngctngntcgnnnnnnnnnnnnnnnnnnnnnnnnnnnnnnnnnnnnnnnnnnnnnnnnnnnnnnnnnnnnnn

SEQ ID NO: 117805 - DNA, 450 bp, Homo sapiens
  misc_feature: GYAE6OF02JRHGI.29.30.C08.1.454.CMB.1.raw
  modified_base (174)..(174): a, c, t, g, unknown or other
  misc_feature (174)..(174): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
  modified_base (359)..(360): a, c, t, g, unknown or other
  misc_feature (359)..(360): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (394)..(394): a, c, t, g, unknown or other
  misc_feature (394)..(394): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (411)..(450): a, c, t, g, unknown or other
  misc_feature (411)..(450): n is a, c, g, or t
tcagatagagtactcacgaccggtgctcgatttagtctgacgtcaaagggaaaggggcgtggagtgggtggccaacataaaccaagatggaagtgaacagtactatgtggactctgtagaagggccgattcaccatctccagagacaaccgccaagaactcactgtctcctcancctccaccgtaagggcccagtcggtccttacccccgnggacccncccttgctacccgaggcncgacctccgagacgacctacgaggtccggccctgggctcggccgttggcaaggtctaccgttcncgttagcgtnaccgtnaggccgggntcggcaagggtccnctaagtagngtnactcagannccgttacngcanctancgttaaacgcttgacccngcaattgangtnacctnnnnnnnnnnnnnnnnnnnnnnnnnnnnnnnnnnnnnnnn

SEQ ID NO: 117806 - DNA, 622 bp, Homo sapiens
  misc_feature: GYAE6OF02JHMT5.29.30.C08.1.454.CMB.1.raw
  modified_base (232)..(232): a, c, t, g, unknown or other
  misc_feature (232)..(232): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (405)..(406): a, c, t, g, unknown or other
  misc_feature (405)..(406): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (472)..(472): a, c, t, g, unknown or other
  misc_feature (472)..(472): n is a, c, g, or t
  modified_base (495)..(495): a, c, t, g, unknown or other
  misc_feature (495)..(495): n is a, c, g, or t
  modified_base (618)..(618): a, c, t, g, unknown or other
  misc_feature (618)..(618): n is a, c, g, or t
tcagatagagtactcacgaccggtgctcgatttagtctgacgtcaaagggaaagggctggagtgggtggccaacataaaccaagatggaagtgaacagtactatgtggactctgtgaagggccgattcaccatctccagacgacaacgccaagaactcactgtctcctcgactcctccacgacgggccctatccggttccttcccccgtggccgcccttgcctccgaggacnccaccgtccgaagcgcacacggccggcccgttgggcctcggtccgtaggtaccgaacggtaccttacgttccgaaacggtgaccggtgtacctggacggtccgggcgttacggccgtaaagggccgtacgaagtttaacggcngtanctcgtacntancgtcggtnagtaccnngacagngtanacgtactactctcgtcgtacgtcgacacgtgtacgtacgtacgtacgacgtagtanacgcgactacgttactacgtacnctcgtctacgtacgtcgtagtacgtacgacgtaccgtactacgtacgacgacggtacgtcgacgtaggtacgacgtcgtaacgacgtcgtaacgtaacgacgtactatcctactacgtacgtntacg

SEQ ID NO: 117807 - DNA, 534 bp, Homo sapiens
  misc_feature: GYAE6OF02JLVM0.29.30.C08.1.454.CMB.1.raw
  modified_base (171)..(171): a, c, t, g, unknown or other
  misc_feature (171)..(171): n is a, c, g, or t
  modified_base (206)..(206): a, c, t, g, unknown or other
  misc_feature (206)..(206): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (379)..(383): a, c, t, g, unknown or other
  misc_feature (379)..(383): n is a, c, g, or t
  modified_base (385)..(386): a, c, t, g, unknown or other
  misc_feature (385)..(386): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (454)..(454): a, c, t, g, unknown or other
  misc_feature (454)..(454): n is a, c, g, or t
  modified_base (479)..(479): a, c, t, g, unknown or other
  misc_feature (479)..(479): n is a, c, g, or t
tcagatagagtactcacgaccggtgctcgatttagtctgacgtcaaagggaaaggggcgtgggagtgggtggccaacataaaccaagatggaagtgaacagtactatgtggactctgtgaacgggccattcaccatctccagaggacaacgccaagaactcactgtctccncagcctccaccaacggcccatcggtccttccccgnggcgccctgctccaggagtccaccgtcgaagcgccacgacgccggccgtagggcctcggaccctggactaaaggaccttccttccgacgtagtcgtcgactggacggtaccggggcttgggaccctaagggccgcaaagttcganagctgngactgctatcgcaatgntnacnnnnncnngacnagctctnacgncgagntgagcagngnancngacgtatnatacncgacancgacgngtnagagtntagcgtgtcgacgcgtacgtaacgngtcgtacgcgacgtacgtacgttcgtcgttacgtacgttcgtacgttaccgtacg

SEQ ID NO: 117808 - DNA, 367 bp, Homo sapiens
  misc_feature: GYAE6OF02I27RW.29.30.C08.1.454.CMB.1.raw
  modified_base (339)..(367): a, c, t, g, unknown or other
  misc_feature (339)..(367): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatcctcagagacaacgccaagaactcactgtctcctcagcctccaaccaacgggcccatccggttccttcccccgtggccgtcccctggcctccgaagggcgacctacctccggagacgcacaggccggccctgggctcgcgtcggtacaaggactcttaccgacgtagcgtgctggaggcgggcgtggacgaacggcgcgaatggnnnnnnnnnnnnnnnnnnnnnnnnnnnnn

SEQ ID NO: 117809 - DNA, 227 bp, Homo sapiens
  misc_feature: GYAE6OF02IH296.29.30.C08.1.454.CMB.1.raw
  modified_base (212)..(227): a, c, t, g, unknown or other
  misc_feature (212)..(227): n is a, c, g, or t
tcagatagagtactcacgaccggtgctcgatttagtctgacgtcaaagggaaagggaccacggtcatcgtgtcctcagcctccaccaagggcccatcggtcttccccctggcaccctcctccaagagcacctctgggggcacagcggccctgggctgcctggtcaaggctacttccagacgacgctctgagcgggctggcaaggcgcatagnnnnnnnnnnnnnnnn

SEQ ID NO: 117810 - DNA, 592 bp, Homo sapiens
  misc_feature: GYAE6OF02F02PS.29.30.C08.1.454.CMB.1.raw
  modified_base (224)..(224): a, c, t, g, unknown or other
  misc_feature (224)..(224): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
  modified_base (462)..(462): a, c, t, g, unknown or other
  misc_feature (462)..(462): n is a, c, g, or t
tcagatagagtactcacgaccggtgctcgatttagtctgacgtcaaagggaaaggggctggagtgggtggccaacataaacccaagatggaagtgaacagtactatgtggactctgtgaaggccgattcaccatctccagagaaaacgccaagaactcactgtctcctcagcctccaccaaggcccattccggtccttcccctggacgtccctgctccaggacncgaccctccgagagccaacacggccggaccgtgggctcgccgtggtacaacggaccttaccgttaccgaaccgttagcgttgacgtagacgccggggtatcggacgtaagggccgacgtaagtacggnactcgatanacgttgtaagcacgagcgtangatnacgncntcgagcngngacgtcacgacgngacgtagacgacgtaacacgcgagacgtagacgagacgtactacgtanagagtcgcgtactacgtcgtacgactagaacgtagtataagtaagtagagtaacgtaaggagttaactaaccgtaactactacttaccgtacgtaacgttacgtacacgtaccgtaacgttacacgtccg

SEQ ID NO: 117811 - DNA, 392 bp, Homo sapiens
  misc_feature: GYAE6OF02IAO6Z.29.30.C08.1.454.CMB.1.raw
  modified_base (353)..(392): a, c, t, g, unknown or other
  misc_feature (353)..(392): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaaggcccatccggtccttcccccgtggccgccctgcctccgaggcgccacccgtccgagacgcacgacggccggcccgtgggctcggccgtggtacgaacggtacttaccgttccgacgtagcggtgcgtggacgggtccgggcgtgggaccgaagggcccgagtaagtagcgnnnnnnnnnnnnnnnnnnnnnnnnnnnnnnnnnnnnnnnn

SEQ ID NO: 117812 - DNA, 319 bp, Homo sapiens
  misc_feature: GYAE6OF02GHCXN.29.30.C08.1.454.CMB.1.raw
  modified_base (301)..(301): a, c, t, g, unknown or other
  misc_feature (301)..(301): n is a, c, g, or t
  modified_base (305)..(319): a, c, t, g, unknown or other
  misc_feature (305)..(319): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatctccagagacaacgccaagaactcactgtctcctcagcctccaccaagggccatcggtcttcccctggcgccctgctccaggagcacctccgagacgcacagccggccgtggcctgccgtggtcacggactacttccacgttagcgtgctgcggcggctggcaggcnatgnnnnnnnnnnnnnnn

SEQ ID NO: 117813 - DNA, 395 bp, Homo sapiens
  misc_feature: GYAE6OF02I0YSA.29.30.C08.1.454.CMB.1.raw
  modified_base (332)..(332): a, c, t, g, unknown or other
  misc_feature (332)..(332): n is a, c, g, or t
  modified_base (337)..(395): a, c, t, g, unknown or other
  misc_feature (337)..(395): n is a, c, g, or t
tcagatagagtactcacgaccggtgctcgatttagtctgacgtcaaagggaaaggggctggagtgggtggccaacataaaccaagatggaagtgaacagtactatgtggactctgtgaagggccgattcaccatcctcagagacaacgccaaagaactcaactgtctcctcagccctccaccaagggccccatccggtccttccccctggccgcccctgcctccaggcgccacctccgagacgcacagccggccccgtggggctgcctggtcaaggactaccttcacgtagcgtgctggagcgggctcgggacaacgggcgcagtaggcagngctannnnnnnnnnnnnnnnnnnnnnnnnnnnnnnnnnnnnnnnnnnnnnnnnnnnnnnnnnn

SEQ ID NO: 117814 - DNA, 890 bp, Homo sapiens
  misc_feature: GYAE6OF01C5THM.19.59.F04.1.454.CMB.1.raw
  modified_base (156)..(156): a, c, t, g, unknown or other
  misc_feature (156)..(156): n is a, c, g, or t
  modified_base (194)..(194): a, c, t, g, unknown or other
  misc_feature (194)..(194): n is a, c, g, or t
tcagtactctcgtgcacgaccggtgctcgatttagtacacacacttagggaagttgggggcttcagctgtgtacgccgcagaaggcaggactcgggacaatcgttcatcaagtgacctgctcccctctcctcctcacccttctcattcactgcacngggtcctgggcccagtctgtgttgacgcagccgccctnagtgtctgcggcccaggacagaaggtcaccatctcctgcctcgtaggaaagccagtcctacccaaacgtagtttaggggaagtaaatttttggtcggttacccttcggggttaaccccaaggtccaaacggtccctacccccgaacgggggaaaacccaaaccggacccccccctaaaaaaccttccccttaaccgtaacttttttttaggaacctaaaattaaacttaaaacgggacccgtaaccccttaccgaaggggtaactttcccttacggaacccggtaactttaccttccgttacgggtcccttaaccgtaaaccgttcgttcgggtaccgaaacccgggtttccaaccggtaccccgaaccccggtttcgggggacccaaccttaccggaaaccccgggtaccttaccccgaaagggtaaccgtacggggggacccggaacggggtaccccggttaaatttacgtttaaccgtcggtaaccgggtaaaccgaacgttagggggaacttaacggaccgaacggtcgtacgggtaacggttaccgttaggttaggtaaatttaaacgggtccggacggggggttaaacggggaaaccccgtaaaagggcccggttacggtaaccccgggttacgttaaccgggtaccgaacggacccccccggttaaaagggcccgttacccccccgggg

SEQ ID NO: 117815 - DNA, 530 bp, Homo sapiens
  misc_feature: GYAE6OF01EXLA5.19.59.F04.1.454.CMB.1.raw
  modified_base (228)..(228): a, c, t, g, unknown or other
  misc_feature (228)..(228): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctcnggaagcagctccaacattgggaagaatttgtgtcctggtaccagcagctcccagacacgccccaactcctcattttgacaataataagcgaccctcaggattcctgaccgattctctggctccaagtctggcacgtcacgccacccgtgggacatccgacccggactccgagacgtcggggacgaggccgtattagtactgacggaacagtgggatagcagcctgagtacgtgtgataagtcggacggacgggaacaggctacggaccgtaccgtaggacacggcccgtaaggcctacccgg

SEQ ID NO: 117816 - DNA, 592 bp, Homo sapiens
  misc_feature: GYAE6OF01A88NL.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaagcagctccaacattgggaagtaatttgtgtcctggtaccagcagctccagaacacgaccccaaactcctctacttttgaactaaataataacgccgaacctcagggtacttccgtacgaccgtattctctcggctcaacgtctgcacgtcacgccaccgtggcacgtcgaccggtactccacgacgtaggggaccgacggaccgtatttacgtacgtcggaccggaacgtagtacgggaatacgacgtacggaccgtagaacgtacgtagtagtaagttaacgtcgggacgggacgggaaccaacggtccgtacggtaccgttaccgtacggtaccacgacccgtaaggtcgtaccccgg

SEQ ID NO: 117817 - DNA, 610 bp, Homo sapiens
  misc_feature: GYAE6OF01DGDD5.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctaccaaacagttagggaagtaattttagtgtcctggtaccagcagcctcccaggaaccacgacccccaaactcctcatttttgacaaataataagcaccctcaggtacttccgtgaccgattctctggtctccaagtctggcacgtcgacgcccacccgtgggccactccgaacccggactccgaacggtacgtcggggacgaggtcccgatttacgttacgtaggaccggaacagtgggtataacgtcgacggtcctggtacgtactaggtcgtaataacgttcgggcgggtaaacgggaacccaaggtccggtaccggaccgttacccgtaagggtaccaccggacccccgaagggtcccctaccccggg

SEQ ID NO: 117818 - DNA, 986 bp, Homo sapiens
  misc_feature: GYAE6OF01ADO6C.19.59.F04.1.454.CMB.1.raw
  modified_base (837)..(837): a, c, t, g, unknown or other
  misc_feature (837)..(837): n is a, c, g, or t
tcagtactctcgtgcacgaccggtgctcgatttagtacacacacttagggattgggggcttcagctgtgagcgcagaaggcaggactcggacaatcttcatcatcgacctcgcctcccctctcctcctcctacccttctctacttccacgtcgaccgacgtacgggtcccgtcgggccctagttcgttggttcgttacggaccgccgaccgccccgtccctcgtacggttcgtccgccggacccggacccgaacggaaccgaacggtaacgtcctacctactcctccgtcgtccgtacggtacgggaacgtccgtaccggtacctaaccgtaaacggttaagggttaacggggttaaacgttttacgttttcggtaccgttacccggtaacggtaccgacggtaccgtacccggtaccccgtaaccccggaaaccggtaaacccctaaccccgtaacccctttaacctttacccgtttaacgttttaaacggtttaacgaaaaccgtttaaaaccgttaaaccggtaaccccggtaccccggttaccggttaacgggttaaccggtttacccgttaccggtaaccggttaaccgttaccgttccgtaccggttaccgtacccgtacggttaccggtccgtaccggtacccggtaccgtacccggaacccggttacccggtacgggtccgaacccgttacccgggtaccccggaaccggtaccgtaacggggtaaccgggacggggtaacggtacccgtacgtttaacgttaaccggtagtaccgggacggaacgtaggtacggtctaacggtcgaccgttaacggtcggttaaacgngttacggaacgggttaaacgggtccggtaacccgggggtacgggtaaccgtaacccggttaccgacgggttacccggtaccccggtaacgttccggggtaaccccccgggttaaaccccggtccggtccccggtccgtttaccccccgg

SEQ ID NO: 117819 - DNA, 597 bp, Homo sapiens
  misc_feature: GYAE6OF01DWM5I.19.59.F04.1.454.CMB.1.raw
  modified_base (236)..(236): a, c, t, g, unknown or other
  misc_feature (236)..(236): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcaccccttctcattcactgcacagggtcctgggcccagtctgtgttgacgcagccgccctcagtgtctgccggccccaggacagaaggtcaccatctcctgctctggaancagctaccaacattagggaagtaattttgtgttcctggtaccagcagcctccaggaaccacgacccccaaactcctactattttcgactaataataacgccgtaacccctcgacgggtacttccgtacgaccgtattccgtcgtcggtcctccaagtcgtgcacgtcacgccaccgtggcacgtccgaaccgctaccgagacgtggggacgaggccgtagttactacgtcgacggtaacagtaggactagctacgtcctagacgtacgtgtagaagtacggtcgggacgggaacggaaccaacggcgtaccggtacccgtaccgttacggaccaaccggacccgaaggtcccgtaccccgg

SEQ ID NO: 117820 - DNA, 837 bp, Homo sapiens
  misc_feature: GYAE6OF01DM01G.19.59.F04.1.454.CMB.1.raw
  modified_base (189)..(189): a, c, t, g, unknown or other
  misc_feature (189)..(189): n is a, c, g, or t
tcagtactctcgtgcacgaccggtgctcgatttagtacacacacttagggattgggggcttcagctgtgagcgcagaaggcaggactcgggacaatcttcatcatgacctgcctcccctctcctcctcacccttctcattcactgcacagggtcctgggcccagtctgtgttgacgcacgcccgccctnagtgtctgccggcccaggacagaacgtcaccatctcctgctcgtaggaagcagcctaccaacagttagggaagtaattttgtgtcctaggtaccagcagctaccaggaccacgacccccaaactcctactatttttagaactaataaactaacgaccgtaaccctacgaaggtacttacccgtacgaaccgtactttcgtacgttcggtacctacccgaagttcccgtacgggacctaacccggttcgacccggtaccccgtaaccccggtcggggtacctaccgttacccgaacccgggaccttacccgaacgggtaccggtacgggggaaccgtaacggtacccggttaaacgtttaacgtttaaccggtacggaaccgggtaaacgtacgggttaaaggggtaacttacgggttaacggtacccggtttaacggtaaacggtttaacccgttaggttaacggttaaaccgttaaacgggttacccggggaaccgggggttaaaccggggaaaccccggttaaagggtaacccggtttacccgggtaaaccccgggttacccggttaaaccggggtaacccttaaacccggggaacccccggttaaacggggtccccgttaccccgggttaaccccccccccgggg

SEQ ID NO: 117821 - DNA, 622 bp, Homo sapiens
  misc_feature: GYAE6OF01A7QR7.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctcgcggcccaggacagaaggtcaccatctctgctctggaagcagctaccaactagttgggaagtaattttgtgtccgtggtaccagctagcctacccgaggaaccacgaccccaaactcctctattttcgactaataataacgcgacctcaggtactccgtagaccgtattcctcgtggtctacctaagtcgtgcacgtcacgccctaccgtgggccagtccaacccggtactacccgagaccgtacggggacgacgggtaccgtaagtttacttacgtacggacggtaacctaggtagggaacgttacgacgaacgtccgtagtaacggtactaggtcgaagttaacgtccgggacggacgggaacgacgtcggtaccgtaccggtaccgtacggaccgtacggtacccgaagggtcccctaacccggg

SEQ ID NO: 117822 - DNA, 659 bp, Homo sapiens
  misc_feature: GYAE6OF01BWKE2.19.59.F04.1.454.CMB.1.raw
  modified_base (188)..(188): a, c, t, g, unknown or other
  misc_feature (188)..(188): n is a, c, g, or t
  modified_base (342)..(342): a, c, t, g, unknown or other
  misc_feature (342)..(342): n is a, c, g, or t
tcagtactctcgtgcacgaccggtgctcgatttagtacacacacttagggattgggggcttcagctgtgagagcagaaggcaggactcgggacaatcttcatcatgaccttgcctcccctctcctcctcacccttctcattcactgcacaggtcctgggcccagtctgtgttgacgcagcccgccctnagtgtctggccggccccaggacagaaggtccaccatctcctgctctggaagcagcctccaactagttagggaaagttaattttgtcgttccgtaggtaccagcagcctaccgaggaacaccgaccccaaactcctactattttgaacaattaanacgccgacctgacggtacttccgagtaccgtattccgtacgtcggtcctaccgtaacgttccgtacggtacctaccggtacccgaccgtacccccgtaacccggttcggggacctaaccgtaccccgacccggtaccctaccgaacggtaccgggtacggggaccgacggtaccgtaatttacgtacgtcgaccggaatggtagggatacggacgacgtcgtgaacgttactgtagtaagtacgcgggacggacgggaccaaggtccgtagtacccggtacgtacggtaccaacggtcccgacggtcctaccccggg

SEQ ID NO: 117823 - DNA, 759 bp, Homo sapiens
  misc_feature: GYAE6OF01EPGF6.19.59.F04.1.454.CMB.1.raw
  modified_base (271)..(271): a, c, t, g, unknown or other
  misc_feature (271)..(271): n is a, c, g, or t
  modified_base (604)..(604): a, c, t, g, unknown or other
  misc_feature (604)..(604): n is a, c, g, or t
tcagtactctcgtgcacgaccggtgctcgatttagtacacacacttagggattgggggcttcagctgtgagcgcagaaggcaggactcgggacaatcttcatcatgacctgcctcccctctcctcctcctacccttctctacttcacttcgcacgacgggtcctcgggccctagttcgtgtcgttcgaccgcacgcccgtcctctaggtcgtcgtcggccggacccaggacaggaacgtccaacctctccttcctggcctcgtacggaacncgacgtaccctaccgtaacgtagttaagggtaacgttaacgttttggtccgttaccgtacggtaccacgtaccgacgtcccttaccggaacgaaccgtacccgacccctaacttccttacgtttaacgttttacgaacttaaactaaacgttaccgaccctaccgtacgtaacgggttaccttacccggacgtaccttagttccctcgtacggtacctaccgtagtccgacgtactacggtcctaccgcccgtaccggtcggaccacgtacccggtacgtacccgtcgaacgggtacggtacggggacgaacgtacgtaacgtttacgtacgnggtaacgacgtagtacggtacgacgtccgacgttaccgtacggtacttacggtagtagttaacgttacgggaccgggtacgggtaacggaccgtacggtccgacggtaccgtaccggtacgtacgaccgtacccggtaacgccccggttaaccgg

SEQ ID NO: 117824 - DNA, 753 bp, Homo sapiens
  misc_feature: GYAE6OF01BE6S3.19.59.F04.1.454.CMB.1.raw
  modified_base (241)..(241): a, c, t, g, unknown or other
  misc_feature (241)..(241): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacaggtcctgggcccagtctgtgttgacgcagccgccctcgagttgtcctgccggccccaggaccagaaggtcaccagtcctcctgctctgggaancagcctaccaactagttagggaagtaacttttggtcgtcctggtaccagcacgcctcccgaggaaccaccgacccccaaactcctactactttttagacctaaataactaacgaccgaacctacgacggtacttacctacgtaaccgtacttcctacgtcggtacctccgtaacgtccgtaggaccgtacgtccgtacgacccgttacccggcgggacctacgttaccgaaccccggtacctaccggtaacggtaccggtaacggggaccgtacgggacccgttaatttacgttaccgtcgggtaaccgtaacgacggttagggtaacgtacgacccggtaccggtaccgtttacgggtaacgttacgtaacgttacggtaacgttacggttaaccggggaccgggtaaccgggtaaccggaacccgggttcgtacccgggttaacccggttaccggtaaccggtacccggtaaaccggtaacccccggaggttaccccggttacccccggg

SEQ ID NO: 117825 - DNA, 918 bp, Homo sapiens
  misc_feature: GYAE6OF01BC7KY.19.59.F04.1.454.CMB.1.raw
  modified_base (638)..(638): a, c, t, g, unknown or other
  misc_feature (638)..(638): n is a, c, g, or t
  modified_base (683)..(683): a, c, t, g, unknown or other
  misc_feature (683)..(683): n is a, c, g, or t
tcagtactctcgtgcacgaccggtgctcgatttagtacacacacttagggattgggggcttcagctgtgagcgcagaaggcaggactcgggacaatcttcatcatgacctgcctcccctctcctcctcctacccttctctacttcactgccacgtacgggttcccgtcgggccctagttcgtggttgttacgaccgcgacggtcccgcccgtctaggtcgtccgtacggcccggaccccgaaggacaacggaacggtccaacctcttccgtccgtcgtccgttcggtacgggaacgcgaccgtacctaacccgtaaacgtttagggttaacgggtaaaagttttacgttttccggtaacgttccgttacggaccgtagccgtacgccccgtaacccgaacggaacccgtaccccgaaccccgtttaaaccgtccttacgttttacgttttaacgaaaccttaaaataacccgttaacggtccccttaaacccgtagggtaacggttacccttaccggtacgtaaaccgtttcttccgttacaccgggttaccctacgtacggtacctccggacgtacctccggaacctccggtaccgcgtaactcccggtacccgtaccgtaccgtacggaaccgggngggtaaccgggacgtaaccgggttcgttaaatttaccggtacggngggtaaacctaggtacgggacgttaccgaacgtacccgtacggttacgttaaggtaccggttaacggttacgggacgtttaacgggtaccggggtaacgggaaaccggggtaaccgttaaccgggaccgggtttaccccgggaaccgtttaacccgggggttaacccgtaaccccgggtaccggttaaaccccgggaacccggggttccccggtcggtttaaccccccccccggg

SEQ ID NO: 117826 - DNA, 746 bp, Homo sapiens
  misc_feature: GYAE6OF01E5AUU.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgcctcccctctcctcctcaccccttctcattcactgcacgagggtcctcgggcccagtctgtgttgacgcacgccgcctcagtgtctcggccggcccaggacaggaacggtccaccatcctcctgcctacgtcggaagcgacgactaccaactagttagggtaagtaattttgtcgtccgtcggtaccagcacgcctcccgaagaaccaccgaccccaaacctcctacttacgtttttacgaactaaataaacgtaacgtacccgtaccctacggaacggtacttccgtacggtaccgttacgttcctacgttcggacctaccgtagtaccgtcggaccgtaccgtccgaccgcccgtacccggtcgggaccctacgtaccgaaccccgggtaccctaccgacggtaccgggtacggggaccgggtaacggtaccggttaacttacggttacgtacggtacggtaaccgtaggtacgggtaacgtacggacgtacgtacgttaggtaacgttacggtacgtggtaaacgttaacgggaccggggaaccgggaccgggaaaccggtaacgtcgggtacccggtacccggtacgtacggtacgacccggaaccccggtacggtcccgttacccccggg

SEQ ID NO: 117827 - DNA, 865 bp, Homo sapiens
  misc_feature: GYAE6OF01CZQD8.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactcgcacgaggggtcctcgggcccagttctgtgttgacgcacgcccgccctgacgtgtccgtcggccggtaccccaggactaggaacggtccaccacttcctcctagcttaccgtaggaacgcacggacctaccgaacgtaggttacgggtaaagttacgttttggtaccgttaccgtacggtaaccgagccgacgtaccgtaccgaacggaaccacccgtaccccctaacgttcccgttactttaacgtttttacgaaactaaaacgtaacgtaaccgtacccgtacccttacgggacggttaccttcccggtaacgtacccgtactttacccgtcgtacggtaccttaccggtacgttacgtccgggaacctaccggtccgacccgggtccctaccgggttacggaccgtacctacccggtacccggtaccgtaacccggaacggtacgggtaaccggggaccggtacggtacccgttaagtttaccggttaccgacgggtaaaccgggagttaacgggtcggggtaaacctcgggtacctaaccgggtaccgttaacgggtaagttacgtaggttaaccgtaacgggttccggtaaccggggaaccgggggtaacccgggaacctaaccgggggttccgtaacccgggttaacccgggttacccgtaacgggtacccgtaaccccgggaacccgttaaccggggtccccttacccccgggg

SEQ ID NO: 117828 - DNA, 918 bp, Homo sapiens
  misc_feature: GYAE6OF01BRQ5U.19.59.F04.1.454.CMB.1.raw
  modified_base (201)..(201): a, c, t, g, unknown or other
  misc_feature (201)..(201): n is a, c, g, or t
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
tcagtactctcgtgcacgaccggtgctcgatttagtacacacacttagggattgggggcttcagctgtgagcgcagaaggcaggactcgggacaatcttcatcatgacctgcctcccctctcctccctcacccttctctattccactgcacgtacgggtcctcgggccctagtctggttagtcgacgcgacgcccgccctnaggtctcgcgccggaccccaggacgtaggaacggtcaacctntcctcgtgtcctcgaggaagccgacgtacctaccaagtaggttacgggaaagtttaacgtttttgacggttccgtacgggtaaccgacgtccgaaccggccttaacccgaacgggaaaccnccccaaaccccctaaaccttcccgttaacttttaacgttttaaccgaaaacttaaaacgttaaaacgtaacccggtacccggtaaaccccgtacggtaacgggtttaaccttcccgtaacggtaacccgttacttccgtacggtacggtccctaaacccggtagttaccgtcccgtacgtacccggtaccgtaacccggtccccgttaaccgggcgtaaccgttaccgtaacccccgggtaaccccggttaacgaaccccgggttaacgggaacccgggtttaacgggggaacccgttaacgggtaccccgtttaaagtttaaccggtaaccgggttaaccgaaccggttaaaccggtagggtaccgggtaaactacggtaacccggacggttaacgtacggttaacgtaacggttcggtaacgttaaccggttacgggtaccccggggaaacggggttaaccggaacccgacggtttcccgggtaaaccgttccggtaaaccgtacgggacccgtaccgggtaaacccgttccgggccccggtttaacccccg

SEQ ID NO: 117829 - DNA, 699 bp, Homo sapiens
  misc_feature: GYAE6OF02G3RIL.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgccggcccaggacagaagtcaccatctcctgctctggaagcagctaccaacattggaataatttgtgtccgtggtaccagcagctccaggaacacgaccccaaactcctactattttcgaactaataataacgccgtaaccctacgagggtacttccgtacgtaaccgtacttacctcgttacggtcctaccgtaagtcctcggacctacggtaccacgtaccctacccgtcgggtacctaacgtcccgacccgggtaccctaccgaacggtaccgtacgggggaccgtaacgggcccgtaagtttaacgttaccgtacggaccggtaaacgtaggtacgggtaactacggacgacggtcccgttaggtacgttacgtggttacgaacgttaacgggtccggggtacggggtaacggggaacccgtaaaggtcccgttaaccggtaacccggttaccggtaacggtcccgaaccgggtacccggtaacggtcccgttacccccggg

SEQ ID NO: 117830 - DNA, 671 bp, Homo sapiens
  misc_feature: GYAE6OF02G4G4L.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgccggcccaggacagaaggtcaccatctcctgctctaggaagcagcctaccaactagttagggaagtaagttttgtcgtccttggtaccagcagcctaccaggaaccaccgaccccctaaacgtcctctacttttacgaactaaataacgtaagaccgtaccctcgaacgggtacttaccgtacgaaccgtattccgtctcggcctaccgtaacgtcgtaggaccaaccgtcaacgccctaaccccgtggtaccacgttacccgaaccggtacctaccgaacgaccgggtggggaaccgacgggtaccgtaagttacttaccgtcgaaccggaatacggtagggtaactacgaccgacggtccgtagtacgtacgtagtacgtaacgtacgtacgggccgggtaacgggaaccgtacggcgtaccggtaaccgttccggtacggtaccgtaccggtacccgtaggtcccgtaccccgg

SEQ ID NO: 117831 - DNA, 546 bp, Homo sapiens
  misc_feature: GYAE6OF02JF6NH.19.59.F04.1.454.CMB.1.raw
  modified_base (443)..(443): a, c, t, g, unknown or other
  misc_feature (443)..(443): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacacgcccccaaactcctctattttcgactaataataagcgaccctcgacgggattcctgaccgattctctggctcaacgtctggcacgtcacgccacccgtgggcactccaccgggactccgagtacgtcggggacgacggccgatttacgttacngcggaacagtgggatcgcagcctgagtacgtgtagatagtcggacggtacgggaaccaaggcgtacgaccgtacgtacggcacggcccgacggtctaccccgg

SEQ ID NO: 117832 - DNA, 576 bp, Homo sapiens
  misc_feature: GYAE6OF02FK0L0.19.59.F04.1.454.CMB.1.raw
  modified_base (376)..(376): a, c, t, g, unknown or other
  misc_feature (376)..(376): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagcccgccctcagtgtctgcggccccaggacagaaggtcaccatctcctgctcgtggaagcagcctaccaacattgggaagaattttgtgtcctggtaccagcagctcccaggacacgcccccaaactcctcatttttgaacaataataagccgaccctcgagggacttcctgaccgattctctggctccaagtctggcncgtcacgccaccctgacactcgaccgactccacgacgtcggggacgaggccgtattacttacgtcgacggaacgtagtagggatagacgacgccgtagagttacgtgtagacttacgtcgggtacgggaacgggaccaacggtccgtcggaacccggtaccgttacgggtccaacggtacccgaaggtcccgtaccccgg

SEQ ID NO: 117833 - DNA, 733 bp, Homo sapiens
  misc_feature: GYAE6OF02GFF04.19.59.F04.1.454.CMB.1.raw
  modified_base (240)..(240): a, c, t, g, unknown or other
  misc_feature (240)..(240): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgccggcccaggacagaacggtccaccatcctcctgctcgtaggaacncgagtcctaccaactagttacgggaagttaagttttggtcgttccgtacggtaccagcacgtcctacccgaaggaaccaccgaccccctaaacttccctacttagttttacgaactaataacgtaacgaccgtaccctacgacgggttaccttacccgtacggaaccgttactttcctcggttacggtcccttaccgtaacgttcgcggtaccgtacgtccgaaccgtccctacccggtgaccctacgtaccgacccggtactaccgacggtaccggtacggggacgacggtaccgtatttacgtacgtacggacgtaacgacggttggaacgtaggaccgacggtaccgtagtaaccggtagtacgtacgtaacgttacggtaccggggacgggaacgggtaaccgaacggtccgggttaaccggtacccggttaccggtaacggtaccggtaaccccgggaccccggtaccggtcccggttaccccccggg

SEQ ID NO: 117834 - DNA, 594 bp, Homo sapiens
  misc_feature: GYAE6OF02GPH2B.19.59.F04.1.454.CMB.1.raw
  modified_base (236)..(236): a, c, t, g, unknown or other
  misc_feature (236)..(236): n is a, c, g, or t
  modified_base (381)..(381): a, c, t, g, unknown or other
  misc_feature (381)..(381): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatcctcctgcctctggaancagcctccaacagttgggaagtaattttgtgtcctggtaccagcagctcccaggaacacgacccccaaactcctactattttcgaactaataataacgcgaccctcagggtattcctgaccgtattctctcggctaccgaagtcnggctacgtcacgccaccctcgggcctagtccgacccggactccgacggacgtcggggacgaggccgtattacgttacgtcggacgtaactagtgggatacgcgacgtccttagacggttactggttagagttacgtcgggtacgggaacgggtaacaacggtcgtacggtacccgtacgttacggtccgacggtcccgaacggtcctacccgg

SEQ ID NO: 117835 - DNA, 703 bp, Homo sapiens
  misc_feature: GYAE6OF02F8J4J.19.59.F04.1.454.CMB.1.raw
  modified_base (236)..(236): a, c, t, g, unknown or other
  misc_feature (236)..(236): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgccggccccaggacagaaggtcaccatctcctgctctaggaancagcctaccaactagttagggaagtaattttgtcgttccgtaggtacccagcacgcctcccgaggaacacgacccccaaactcctactattttcgaactaataataacgaccgtaccctcgtacgggactttccgagaaccgtacttcctcgtacggtcctaccgtaagtcctacggcctacggttaccacgtccctaacccgtcgggacctactcccgacccggaccttaccgaacggtaccgtcgggggaacggtacgggaccgtaacgtttaacttaccgaggtaccggtaaacgtaggtagggtaagtacggacgtaccgtccgttaggtaacgttacgttaggtagtaacgttacggtacggggaccggggtaacgggtaacccgtaaggtcccgtaccggtaccccggttacggtaccgggttaccgacccggtaccccggtacggcccgttacccccggg

SEQ ID NO: 117836 - DNA, 811 bp, Homo sapiens
  misc_feature: GYAE6OF02H2DQF.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgctcccctctcctcctcaccttctcattcactgcacagggtctctctccagcttgtgctgactcaatcgcctctcgcctctcgcctcccgtgggactccgtcggtcaacgctcatctgcctactcgtgacgcgtacggtcgggacaacgacggtacaaaccgtaccgacctaacgtcgactagttcggactactacgaacgacgaacggaccaacggaccggaaacgggtaaaccgggtaaacccgggggtcccccgtttaacggggttaacgttacgggttaacgtaaacggggtttaaacggttaaacgaagggtttacggaaggttccgggacgaacggacccggaaccggaaaccgggggaaacggggggtaaccgggttacgttacccggtaggtttaaccgtttttcgggttttaccggacgggttacgacggtccgggtttacggcgggggtacctagggtaccgtaccggtacccttaacccgtacctaaaccgttccttacccgaccgtaccggtccccgttaccggtacggttaccggtaaggtaaccggtacgttacggacgtacgtaccgtaacgtttacgtacgtacggtccgaagggttacccggttggggtaaccttcgggtttggtttaacggttcggggttttaacggggttcccgggaaacgggttccgggtaaactaccggg

SEQ ID NO: 117837 - DNA, 840 bp, Homo sapiens
  misc_feature: GYAE6OF02HUBWV.19.59.F04.1.454.CMB.1.raw
  modified_base (242)..(242): a, c, t, g, unknown or other
  misc_feature (242)..(242): n is a, c, g, or t
tcagtactctcgtgcacgaccggtgctcgatttagtacacacacttagggattgggggcttcagctgtgagcgcagaaggcaggactccggacaatcttcatcatgacctgctcccctctcctcctcacccttctcattcactgcacagggtcctgggcccagtctgtgttgacgcacgcccgccctcgagttgtctcgccggccccaggacagaacggtcaccatctcctgcctctaggancacgctccaacagttgggaaataattttgtcgtcctcggtaccagccagtcctcccgaggaaccaccgaccccctaaactcccttacttaacgtttttacgaactaaattaaacgtaacgtaccgtaaccccttacgaacgggtactttaccgtacggtaacccgttaacgtttccgtcggttacgggtaccctacccgtaaaggtttccgtacgggacctaacccgttaccgaccgtccccgtaacccggtccggggtcctaaccgttacccgaaccccggtaccgtaccgaacggtaccggtacgggggtaaaccggacgggttacccgttaagtttaacgtttaaccgtacgggtaaccggtaaaccgtaacggttaggggtaaacttacgggaaccgtacggtacccggttaacgggttaacgggttacgttacgggttaacggtaaagtttaacggggtacccgggggtaaaccgggggtaaacgggaaacccgttaacgggtaaccggttaacccgggtaacccggttacccggtaacgggtacccgtaaacccgggtacccccggttaacgggtcccgttaaccccccggg

SEQ ID NO: 117838 - DNA, 715 bp, Homo sapiens
  misc_feature: GYAE6OF02FIEB3.19.59.F04.1.454.CMB.1.raw
  modified_base (193)..(193): a, c, t, g, unknown or other
  misc_feature (193)..(193): n is a, c, g, or t
  modified_base (240)..(240): a, c, t, g, unknown or other
  misc_feature (240)..(240): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtcngcggccccgaggacagaacggtcaccatcctccgtgcctctggaacncagcctaccaacagttagggaataagttttgtcgttcctggtacccagcacgcctcccgaacggaacaccaccccaaactcctactactttttacgaacgtaaataactaacgaccgtacccctcgacgggtacttccgtacgtaaccgtacttctacgtcggtacctaccgtaaacgtcgtacgggtacctaccgttaccaaccgtccccgaaccccgttcggggacctacgtcccgaacccgggtacctaccgaacgtaccgggtacgggggaaccggacgggttaccgtaacgtttaacgttaccgtacggtaccggtaaccaacggttacggggtaatacggtacgtaacggtaccgttagggtaccttacgtgtacgtaattacggtcgggacgggaacggtaaccgaacggtccgtacggtaccgttacgtaacggtaccgtaccggacccggacggtcccgtacccgg

SEQ ID NO: 117839 - DNA, 695 bp, Homo sapiens
  misc_feature: GYAE6OF02GNOH6.19.59.F04.1.454.CMB.1.raw
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctaggagcagctaccaacagttgggaagtaattttggtgtccgtggtaccagcacgctcccgaaggaacacgaccccaaactcctactattttagaactaataataacgccgtaccctcgagggtacttccgtacggaccgtattcctacgtcggcctaccgtaagtcgtacggacctaccgtccaccggtccccgacccgtcggggaccctaacgtcccgaacccgggtaccctacccgacggtaaccgggtacggggaccgggaaccgggtacccggtaatttaacgttaacccggtacggaccggtaaaccggtagttacggggaacgtaccggacgaacgggtccgttaggtaagttacgttgtagaagttacggtccgggacgggtaacgggaacctaagggtccgtaccggtacccgtaccgttacggacccgtaacggacccgtacggccgtaaccccggg

SEQ ID NO: 117840 - DNA, 840 bp, Homo sapiens
  misc_feature: GYAE6OF02H1UD6.19.59.F04.1.454.CMB.1.raw
  modified_base (134)..(134): a, c, t, g, unknown or other
  misc_feature (134)..(134): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
tcagtactctcgtgcacgaccggtgctcgatttagtacacacacttagggattgggggcttcagctgtgagcgcagaaggcaggactcgggacaatcttcatcatgacctgcctccctctcctcctcacccttntctattcacgtgccacgtacgggtcctcgggcccagttctgtggttcgacgcacggggccctccctcaggtcgtctggccggcccgaggacagaacgtcaccattccncctgtactcgtaggacncgacgtcctaccaactaggttaggtaagttaagttttcggttcgtccgtacggtaaccacggtcgtacgtaccgtacccgagaaccgacccgaacccccgtaactccttacttattttaccgaactaaactaaactaacgtacccgtaacccgtacgtaacgggtacttaccgtacgtaccgttaacgttcgttccggttacggtaccttaccgtaacgtccgtacgtaccgtacgtaccgacccgtacccgtcccggtacgggaccaccggttaacccgacccggttaccgtcccgtaaacgggccgggtacgggggtaccgtaacgggtacccgttaacgttaacgtttacgaaccggtaccggaaacgttcggggtaagtaccggtaaggtacccggtacggtacccgttacgggtaacgtttacgttacgttaacggtacggttaaccgggttacggggacggggttaaacccggaaccggttaacgggttcccgttaacccggggtccgttaacccgggtaccggttaaccggaacccggtaaccccggtccgggtaccccggtttcccccccggg

SEQ ID NO: 117841 - DNA, 698 bp, Homo sapiens
  misc_feature: GYAE6OF02I9NZE.19.59.F04.1.454.CMB.1.raw
  modified_base (404)..(404): a, c, t, g, unknown or other
  misc_feature (404)..(404): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttctcattcactgcacagggtcctgggcccagtctgtgttgacgcagcccgccctcagtgtctggccggccccaggacagaaagtcaaccatctcctgctctggaagcagcaccaactagttagggaaataattttgtcgttcctagggtaccagctagcctacccaggaaccacgacccccaaaactcctacgtactttttagaacaaataacaaagtccgacccttacgaaggtacttccgtagaccgtattctcgtgcctaccaagtcgnggactacgtcacgacccgtacccgtgggacctacgtccgaacccggtacctaccgagtaccggtacggggaaccgaacgggtacccgtaatttaacgtttaccgaggtaccggaaacgtaaggttacgggaactaacgaccaacggtcccgttaagggaacgttacgtagtaacgtaacgttaacggaccgggtacgggaaccgggaaccgtaaacggaccgttaacggtaacccgttacccggtaagggttacccgaaccggaccccggtaaacggtccgttaaccccccggg

SEQ ID NO: 117842 - DNA, 818 bp, Homo sapiens
  misc_feature: GYAE6OF02JQO73.19.59.F04.1.454.CMB.1.raw
  modified_base (134)..(134): a, c, t, g, unknown or other
  misc_feature (134)..(134): n is a, c, g, or t
tcagtactctcgtgcacgaccggtgctcgatttagtacacacacttagggattgggggcttcagctgtgagcgcagaaggcaggactcgggacaatcttcatcatgacctgctcccctctcctcctcacccttntcacttcgactgcaccgaggtcctggcccagtctgtgttgacgcagcccgtcctcgagtcgtctggcccggcccaaggacaggtaacggtccaacctattcccgtccgtcgtccgtaccgttagggaacgaccgtaacggtccctaacccgtaaaacgtacggtttaggggtaaaagtttaacgtttttcggtacgtttcccgtacgggttaacccacggtaccgacgtaccccgttaacccggaacgggtaaacccacccggtaaccccctaaaacccgttcctaccgtttaacgttttacgaacctaaattaacgtaaccgaccccgtaccgtaacgagggttaccttacgtacgtaacccgttaattccgtcgtacgtacgtaccgtaacgtcgtcggaccctacggtaccaccgtaccccgtaccggtaacgtccgaccttaccggacccgtactccgtaacggaccggttgggaacgtcggtacgtacttaacgtaccgtacggtacgaaccgtaggtagaacgttccgaacgttaccggactttacgggtaccgttaaagtccgggtaataacgggtaccgttcgggggaaccggtaccgggtaacaccggttacccggtaccgggttaaccctaggtaccggttacccacgggacccgttacggccccgttacccgg

SEQ ID NO: 117843 - DNA, 945 bp, Homo sapiens
  misc_feature: GYAE6OF02JYRCG.19.59.F04.1.454.CMB.1.raw
  modified_base (298)..(298): a, c, t, g, unknown or other
  misc_feature (298)..(298): n is a, c, g, or t
tcagtactctcgtgcacgaccggtgctcgatttagtacacacacttagggattgggggcttcagctgtgagcgcagaaggcaggactcgggacaatcttcatcatgacctgctccctctcctcctacaccttctctacttcactgaccacagggtcctagggccctaggtctcggttagttcgaccgcgtacggcccgtacccgtacgtaggttcgtcgtacggcccgggaccccagggaccgtaaacggacggtaccaccttaacttccgtcgtacgttccgtaggtagggaaccgntaccggaccttaaccgaactacggttaaagggtaatttaacgttttgtaccggtttcggtacggtaaccgacgtacggtactaccctaaccgacggtaaccggacccctaacccctaacctaccgtaacttttacgtttaaggaaccttaaaagtaacgtaaccggtccgttaaccgtacgggtaacgggttaacctttacccgacggggttaacctttaccggtttaccgtacggtttaacccggacctttaaccggtaacggtttacccgaacgggtttaacccggaacgtacccggtaaccgtacccgggtacccggtaccgggtacgtaaccgtacccggtaaacccggtacctaaccgggaccggtaacgggtaccgggtaacgtacccgggtaaccgttaagtaaccgttaacgacgggtaaccgtaacggtaacgggttagggtaaacctaccggtacgtaaccggttccggttaacgtacgggttaaacggtcggttaacggttaaaccggttacgggtaccgggggttaacgggaaaccgggtaaccgttaccgggaacggtaccgttaaacccgggttaccgtacggggtaacccctaaccgggaccggttaaccgggtaccccgttaacccccggg

SEQ ID NO: 117844 - DNA, 543 bp, Homo sapiens
  misc_feature: GYAE6OF01BF9MD.36.32.C10.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctccagatactactggagaaatagtgatgacgcagtctccagccacctgtctgtgtctccgaggggaaanagccacctctcttgtagggccagtcacagtattagcacttaatttaggctggttccagcagaacctggccaggctccgaggctcctcatctacaggtcncactccaccagggccacgtggtctcccagccaggttcaggtggctaggtgggtctgggacaggtagttcacggtctcaccatcacgcacgtccgtggcggtctagtaagtatttgactaagtgttattactgtctgtctaattataagtactggtccttcggtaggtacgtcggcgaacgggtccgagggtaggaacgtacgaacgtacgtacgtaggcgtcgacacactcgtcgttacg

SEQ ID NO: 117845 - DNA, 561 bp, Homo sapiens
  misc_feature: GYAE6OF01CCJR9.36.32.C10.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (417)..(417): a, c, t, g, unknown or other
  misc_feature (417)..(417): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccaggggaaangccaccctntcttgtagggccagtcacngtattagcactaatttaggctggttccagcagaaacctggccaggctcccaggcctcctcatctacagtgcatcccaccgaggggcccacgtggtcgtccccagccctaggttcaggtggctaggtgggtctgggactaggacgttcacgctcacctatcagcagcctggcggtctagtaagtntttgctaatgttattacgtgttctgactatttaataattaacgtcggccttcggtacgggtaccgttcgggaccgtaacgggaccgtaaggggtacggtaaactacgaaaacgtacgtagtggactcgaccactattcgtgtcc

SEQ ID NO: 117846 - DNA, 516 bp, Homo sapiens
  misc_feature: GYAE6OF01C2JYT.36.32.C10.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (417)..(417): a, c, t, g, unknown or other
  misc_feature (417)..(417): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccgaggggaaangccaccctntcttgtagggccagtcacagtattagcacttaatttaggctggttccagcagaacctggccaggctccaggctcctcatctacagtgcatccaccagggccactggtcgtcccagccaggttcagtggcaggtgggtctgggacaggattcacgctcaccatcagcagctgcgtctgaagtatttgctaatgtattactgtntgctattatataactcgcctcgtggacgttcggacgaagggaccgagggtaggaaactacgaaacgtacgtagtaggctacgacaccatccgtgttacc

SEQ ID NO: 117847 - DNA, 661 bp, Homo sapiens
  misc_feature: GYAE6OF01BCUC8.36.32.C10.1.454.CMB.1.raw
  modified_base (206)..(206): a, c, t, g, unknown or other
  misc_feature (206)..(206): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccgaggggaaangccaccctctcttgtagggccagtcacagtattagcactaattaggctggttccagcagaacctggccaggctcccgaggctcctcatctacagtgcatcccaccgagggccacgtcggtcgtcccagccgtaggttcaggtcggctaggtcgggtcgtgggacaggtacgttcacggtcctccaacctatcgacgccgacgtcccgtggcggttcgtaggtaagttagttttcgacttaagttgtttaactttacgttcgttcttacgtcttaaatttaacttaaacgttaacgttccggtcccgtttaccgggttcgggtaccggttaccgggtaacccggtaaaccggggtaccggtaacgggggtaacggtaaaacgttaacccggaaaacggtaaccgttacgggtacgggtaccgttcgaccgtaaccttacgtcgtttcggttacccg

SEQ ID NO: 117848 - DNA, 550 bp, Homo sapiens
  misc_feature: GYAE6OF01BZOBT.36.32.C10.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (370)..(370): a, c, t, g, unknown or other
  misc_feature (370)..(370): n is a, c, g, or t
  modified_base (431)..(431): a, c, t, g, unknown or other
  misc_feature (431)..(431): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccgaggggaaangccaccctntcttgtagggccagtcacagtattagcactaatttaggctggttccagcagaaacctggccaggcctcccaggcctcctcatctacagtgcactcccaccgacgggccacgtggtcgtcccagccaggttcagtggcaggtgggtctgggacagngttcacgctcaccatcagcagccgtgcggtctagaagtatttgactaatgttacttctgtntgtactattaataactacgtgccttcggtggtaccggttcggaccgtaagggaccgtaaggggtacgaaacgtacgaaacgtacgtaggtacggcttacggactacctatcgtgttacc

SEQ ID NO: 117849 - DNA, 511 bp, Homo sapiens
  misc_feature: GYAE6OF01AS2AB.36.32.C10.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (398)..(398): a, c, t, g, unknown or other
  misc_feature (398)..(398): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccaggggaaangccaccctntcttgtagggccagtcacagtattagcactaatttaggctggttccagcagaaacctggccaggctcccaggctcctcatctacagtgcatccacagggccactggtctcccagccaggttcagtggcaggtgggtctgggacagacgttcacgctcaccatcagcagcctgcggtctgaagtnttttgctaatgtattactgtctgctattaataataactggccttcgtggtacgttcggccgaagggaccgagggtggaaactacgaaacgtactgtgctcgcaccatcgtgtc

SEQ ID NO: 117850 - DNA, 749 bp, Homo sapiens
  misc_feature: GYAE6OF01B6O6U.36.32.C10.1.454.CMB.1.raw
  modified_base (217)..(217): a, c, t, g, unknown or other
  misc_feature (217)..(217): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccgaggggaaagacgcccacctntcgttggtacgggccagtcacagtattagcaacttaagtttaggcttggttccaagtcaagtaaacctggacccaggcctcccgaggcctcctcatcctacgagtgccatcccacgagggcctacgtggtcgcccagcctaggttcaggtggcgtaggttgggtcgtagggacagggtacgttccgacgtccttaccgaacctagtaccgtaacgaccgaccggtaaacccgtcgggtacccggttacgttaacggtaaacgtttagttttacggtacgtttaacggtttttaacgtttaacgtttacggttaaccgtacggtaacgttaacggttaacgttaaacgttacggtaaccggtaaccggggtacccggtttacccggggttaaccggttttaccgggacccgggtaaccgggggtacccgtaaacgggtaccgttaacggggtaacggtaacgttaaccgtaaaaccggtaacgttacggtacggtaccgtacggtacccgaacccgttacgttccgttaccgg

SEQ ID NO: 117851 - DNA, 663 bp, Homo sapiens
  misc_feature: GYAE6OF01BZLGL.36.32.C10.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (296)..(296): a, c, t, g, unknown or other
  misc_feature (296)..(296): n is a, c, g, or t
  modified_base (404)..(404): a, c, t, g, unknown or other
  misc_feature (404)..(404): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccacctgtctgtgtctccgaggggaancgccacctntcttgacggccagtcacagtatagcactattaggcttggtccagcagaacctggccaggcctccgaggcctcctcatctacgngtcgcactcccacgaggccacgtggtcgtcccagcctaggttccaggtcggacgtagggttcgggtcgtaggggactagggtcgttaccgacggtcctaccaaccgtntcgacgccgacgtcccgtgggtaccgtcgtaggtaacgtttagttttacgacgttaacgttaggttaactttacgtcgttactacggtaacttaagtttaacgttaacgttaaccggttccggtaccccggttacggttacggggttacccgttacccgggaccggtaaacggggtaccggtaaggggttacgaaacgttaccggaaacggttacgtcggtacggtaccgtcgacctacctcgttaccgttcgttaccc

SEQ ID NO: 117852 - DNA, 812 bp, Homo sapiens
  misc_feature: GYAE6OF01AO39K.36.32.C10.1.454.CMB.1.raw
  modified_base (653)..(653): a, c, t, g, unknown or other
  misc_feature (653)..(653): n is a, c, g, or t
tcagtacgctgtctcacgaccggtgctcgatttagtatagacatcaacacacaaagggggaggaactgctcagttaggacccagacggaaccagtggaagccccagcgcagcttctcttcctcctgctactctggcctcccagatactacgtggaagaaatagtgatgacgcacgtctccacgcccaccctgtctgtcgtcctaccgaaggggaaacgcgacccaccccttcgtcgttacggtacgggcccaggtccaaccgtagttaatttacgacctaaccgttaagttttacggtccgttggttacccgagacctaaacgtaaccccgtggacccgacggtccctacccccgtacggtcccttcccgtacctaccttaccgtaactacggttcgaccctaacccgtacccccgtaacccggacgggtaccccgttacggttaccgggttcccgtacccccgtaaccggtcccgttaacggggtttccgtaagggttcggggtacgtacggggttcggggtaccggtacggggtaaccgtaggggtaccgtttacccggaactcccgttacccgacctaacgtcgacggcgtacggtccgtcgggtccgtagtacgtaagtttattagactaacgttattacgttacgttntaccgtacgtaattaactttaacgtaacgttaccgttcccggtcccggttacggttacgggtacccggttacgggaccggtacgggacggtaacgggtaacgtaacgtaaccgaacggtcgtggtacgacgtcctacctactacgtttgtcgttacccg

SEQ ID NO: 117853 - DNA, 512 bp, Homo sapiens
  misc_feature: GYAE6OF02GEE7U.36.32.C10.1.454.CMB.1.raw
  modified_base (205)..(205): a, c, t, g, unknown or other
  misc_feature (205)..(205): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccaggggaaanagccaccctctcttgtagggccagtcacagtattagcactaatttaggctggttccagcagaaacctggccaggctcccaggctcctcatctacagtgcatccaccagggccactggtcgtcccagccaggttcagtggcagtgggtctgggacagagttcacgctcaccatcagcagcctgcggtctgaagtatttgctaatgttattactgtctgctattataataactggccttccgtgacgttcggaccgagggaccgagggtaggaaagtacgaaacgaacgtgtggctgccacactctgtc

SEQ ID NO: 117854 - DNA, 504 bp, Homo sapiens
  misc_feature: GYAE6OF02I8UZ2.36.32.C10.1.454.CMB.1.raw
  modified_base (205)..(205): a, c, t, g, unknown or other
  misc_feature (205)..(205): n is a, c, g, or t
  modified_base (373)..(373): a, c, t, g, unknown or other
  misc_feature (373)..(373): n is a, c, g, or t
  modified_base (418)..(418): a, c, t, g, unknown or other
  misc_feature (418)..(418): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccaggggaaanagccacctctcttgtagggccagtcacagtattagcactaatttaggctggttccagcagaacctgccaggctccaggctctcatctacagtgcatccaccgagggccactggtctccccagccaggttccagtggcagtgggtctgggacagagttcacgctcaccntcagcagcctgcggtctgaagtatttgctaatgtattactgtctnctattataatactgtcctcgtggtacgttcgacgaggaccgaggtaggaaagtacaaacgtaactgtgtctgccacatcgtgttcc

SEQ ID NO: 117855 - DNA, 579 bp, Homo sapiens
  misc_feature: GYAE6OF02IBHG0.36.32.C10.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccaggggaaangccaccctctcttgtagggccagtcacagtattagcataatttaggctggttccagcagaaacctggccaggctcccaggctcctnatctacagtgcatccaccagggccacgtgggtcgtccccaggcctaggttccagttggcaggtcgggtctgggacagtagttcacgctcgaccatcagcacgcctcgcggtctaggaagtattttgactaagttcgttaattaccgtgtctgtactattaataataaacgttcggtcccttcggttcggtacgttccggaccgaacgggtaccgtagggtacggaaacgtacgaaacggtaacgttacggtcggtactcggacctaccgtaacgttccgtagttaccg

SEQ ID NO: 117856 - DNA, 563 bp, Homo sapiens
  misc_feature: GYAE6OF02IEPLN.36.32.C10.1.454.CMB.1.raw
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacctctcctgcagggccagtcagagtagttaacaataacttagcctggtaccaangacacctggccaggctccaggctcctcatctatggtncatccaccagggccacgtggtactcccagccaggttcagtggcaggtgggctgggacagtagttcacgtctcaccatcagcaacctgacagtctgaagtattttgactagttttattactgtacagtcaagttataatgaacgtaggtcccgttaccgggttactttcgggcccggtagggggtacctaaggcggttacgggagtaacgtaacgaaaccgtaacgtggtacggtactcggacctaccgtacgttcttaccgg

SEQ ID NO: 117857 - DNA, 522 bp, Homo sapiens
  misc_feature: GYAE6OF02HQYQ8.36.32.C10.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctcaggggaaanagccacctntcttgtagggccagtcacagtattagcactaatttaggctggttccagcagaaacctggccaggctcccaggctcctcatctacagtgcatccacagggccactggtctcccagccaggttcagtggcagtgggtctgggacagagttcacgctacaccatcagcagcctgcggtctgaagtatttgactaattgttattactgtctgactattaataataactggtcctccgtggtacgttcggacgaacgggaccgtagggtaggaaatacgaaacgtaacgtagtggcgtgactaccatcgtgttc

SEQ ID NO: 117858 - DNA, 535 bp, Homo sapiens
  misc_feature: GYAE6OF02F3GSG.36.32.C10.1.454.CMB.1.raw
  modified_base (205)..(205): a, c, t, g, unknown or other
  misc_feature (205)..(205): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccaggggaaanagccaccctctcttgtagggccagtcacagtattagcactaatttggctggttccagcaagaaacctggccaggctcccaggctcctcatctacagtgcatccaccagggccacgtggtctcccagcctaggttcaggtggcaggtgggtctggggacagtagttcacgctacacatcagcagcctgcggtctgaagtagttttgctaagttagttattactgtctgtctaattaataataacgtggtccttccgtggtacggttcgccgaagggacgagggtagaaacgtacgaaacgtaacgtgtaggcgtcgaccaccactctgtcc

SEQ ID NO: 117859 - DNA, 512 bp, Homo sapiens
  misc_feature: GYAE6OF02FIL90.36.32.C10.1.454.CMB.1.raw
  modified_base (215)..(215): a, c, t, g, unknown or other
  misc_feature (215)..(215): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccaggggaaagagccaccctntcttgtagggccagtcacagtattagcactaatttaggctggttccagcagaaacctggccaggctcccaggctcctcatctacagtgcatccaccagggccactggtgtccccagccaggttcagtggcagtgggtctgggacagagttcacgctcaccatcagcagcctgcggtctgaagtattttgctagtttatttacttgtcagctagttataatgacaggtccgtccgggaactttggccgtaggggccagcgtaggagatacaaacgaactgtcggctgcacctatctcg

SEQ ID NO: 117860 - DNA, 611 bp, Homo sapiens
  misc_feature: GYAE6OF02I6IGX.36.32.C10.1.454.CMB.1.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
  modified_base (382)..(382): a, c, t, g, unknown or other
  misc_feature (382)..(382): n is a, c, g, or t
tcagtacgctgtctcacgaccggtgctcgatttagtatagacatcaacacacaaaggggggaggaactgctcagttaggacccagacggaaccatggaagccccagcgcagcttctcttcctcctgctactctggctcccagatactactggagaaatagtgatgacgcagtctccagccaccctgtctgtgtctccgaggggaaancgccacctctcttgtacgggccagtcacagtatagcactaattagctggtccagcagaactggcaggctccagctcncatcacagtcgcactccaccgagggtaccacgtgtcgtccagccaggttacagtcgcaggtcggtcgtagggacagtacgttcacgtctacaacctanacgacgcacgtcgtcgcggtactaggtaagttacgtttacgacttaagttagttacttacgtgttaccgtagtaacttaattaataacgtaacgtccgtccgttaccggtacggtaccggttaccgggacggaacgggtaccggtaagggtaacggtaaacgtaaccgaaacggtaacggttacggtacggtaccgtacggtaccgtaaccgtacgttaccgttacgtc

SEQ ID NO: 117861 - DNA, 758 bp, Homo sapiens
  misc_feature: GYAE6OF02H3M84.36.32.C10.1.454.CMB.1.raw
  modified_base (162)..(162): a, c, t, g, unknown or other
  misc_feature (162)..(162): n is a, c, g, or t
  modified_base (223)..(223): a, c, t, g, unknown or other
  misc_feature (223)..(223): n is a, c, g, or t
  modified_base (724)..(724): a, c, t, g, unknown or other
  misc_feature (724)..(724): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggaagaaatagtnatgacgcagtcctccagcccaccctgtctgtcgtctccgaaggggaaagcgcccacccttntcgttggtacggccagtcacgtagtattagctaacttaagtttaggcttggttaccagtacaacgtaaaccgtcggacccgaggtccctcccgacggccttaccgtctaacctaccttacgtacggttcacctaccttacccaacccggacgggacccctacggttccgggttaccgtacccccaggtacccgttacggtttaccgacggttcggaccgtaggggtttacggggtacccggtacgggggaaaccgtagggttaccgttacccgaccgttacccgacctaaccgtcgtacgtacgaccgtaccgtccgtcgggtccggttacgttaggtaaagttcgttttacgacgttaagtttagttacgtttacgttcgttagtacgtactttaagtttaacttaacgtaacggttaccgttcccgttaccgggttacggtaccggttaccggacgtacgggacggtaacggtagaacgtaaccgaacgtaagttcggnggtaccgtcggtacctactacgttcgtagttccg

SEQ ID NO: 117862 - DNA, 868 bp, Homo sapiens
  misc_feature: GYAE6OF02JDDYW.36.32.C10.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (332)..(332): a, c, t, g, unknown or other
  misc_feature (332)..(332): n is a, c, g, or t
tcagtacgctgtctcacgaccggtgctcgatttagtatagacatcaacacacaaaggggaggaacgtgctcagttaggacccagacggaaccatggaagcccagcgcagcttctcttcctcctgctactctggctcccagatactactggagaaatagtcatgaacgcagtctccagccaccctgtctgtcgtctccgaagggggaaanagcccaccctntcttggtacgggccagtccacagtattagcaacttaagtttacggcgtcggttaccgagtctacggaaaccttcggaccgaggtcctcccgaggcgtcctctactctactgngtccgaatccaccgaggggcccaacgttcggtccggtccccgacggtccgtacgggttacacggtcggacgtacgggttggggttactcggggggtaactaggggtaaccgttttccgaaccggtccggttaccaacccgttaacgtccgtaacggacccgagaccccgggtttcggtaccggggttccgtacgggtaaacgtacgtttttcgtaaccgttaaggtttaccgttaagttttaccgttaggttaccgtttacgggtacctttaacggtttaaactttaaacggtttaaaccgtttaaccgggttacccggtttacccggttaaccgggggtttaccggtttaacccggggttaacccgggttaaaacccgggggtaaccggggtttaaaccgggggttcggggttaaaaaaccggttaaccgggttaaaaacccggttaacccgggtttaaccgggttaacgggttacccgttaaccggggtcccttaaacccgggtaaccgtttaccggtttacggtttaacccgg

SEQ ID NO: 117863 - DNA, 1042 bp, Homo sapiens
  misc_feature: GYAE6OF02GS6KK.36.32.C10.1.454.CMB.1.raw
  modified_base (205)..(205): a, c, t, g, unknown or other
  misc_feature (205)..(205): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtcctcgaggggaangcccacctctcttggtaggccaggtcacgagtattagctaacttaagtttagggacttcgggtttaccaggtccaacggtaaacccgtggacccgacgggtccctacccccgaagggtccctttaccccgtacctaacctttacccttaaccgtacggttaccggaccctaaccgttacccccgaaccgggtaaccgggggtccccctaaccgggttaccgggggttaccggttaccccccggaacggttacccggtaacggggggtttaccctaacgggggttcggggtaccgggtaacgggggttttacggggggggtttaccccggttaaggggggggaaacccttaacgggggttaaacccgggtttttaccccggggaaaccccgggtttccccttaaccccgtaaaccccggtacgtttaacccggaaccgggtaccccggtaaccggggttccccgtccggggttaacccggggtttacgtaacgggttaaaacggtttttacggttttttaaccggaaccgttttaaacgtttacgggttttaaacccttttacgggtttacggtttacccggtttaacgggtaacccttttaaaggtttttaaactttaaaaccgtttaaccgggtttaccccgggttaccccgttttacccggggggtttaaccggggtttaacccgggtttaacccggggaaacccgggtaaaccggggggttacccggggtaagggggttaaccgggtaaaacttaacccgggtaaaaacggtacggtttacggtaccggtacgttaccggaccgtaaccgttacggttacctttcggtttaccc

SEQ ID NO: 117864 - DNA, 821 bp, Homo sapiens
  misc_feature: GYAE6OF02FYTWT.36.32.C10.1.454.CMB.1.raw
  modified_base (209)..(209): a, c, t, g, unknown or other
  misc_feature (209)..(209): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatgtgatgacgcagtctccagcccaccctgtctgtgtcctccgaagggggaaanacgcccacccttctctttggtacgggcccagtcactagtattagcacttaatttaggcttggttccagcaacgaaacctggaccaggtccctacccgaggcctcccgtcactctacgagtcgcactccaccgacgggaccctacgtcggtccgtccccgagtcccgtaggtttacaggttcggaccgtagggttcggggttaccgtaggggaaccaaggtacgttcaaccggtcctaccaacctagtcgaacgtccgaacgtcccgttgggtaccgggttacgtaagggttaaacggttagtttttaacggaccgttaaagtttacgggtttaaacttttaaccggtttggttaccctttacgggtaaccttttaaagtttaaacttaaaacggtttaaaccgggttaccggttaccccgggtttaacccgggtttagggtttaaaccccggggtttccgggaaaccccggggtaaccgggggttaacccgggttaacgggggttaaacggttaaaaacccggtaaccggtaaaaaccccgggttaaggttaccggtaccggttacgtaccgggtaccgttaacccgtcgtttacccgttcggttttacccg

SEQ ID NO: 117865 - DNA, 1004 bp, Homo sapiens
  misc_feature: GYAE6OF02JBLIK.36.32.C10.1.454.CMB.1.raw
  modified_base (153)..(153): a, c, t, g, unknown or other
  misc_feature (153)..(153): n is a, c, g, or t
  modified_base (161)..(161): a, c, t, g, unknown or other
  misc_feature (161)..(161): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactgganaaatagtnatgacgcagtctccagcccaccctgtctgtcgtctaccgaaggggaaacacgccctacccttctcgttaggtacgggccctagtccaactagttaagttacgacctaacgttaaattttacgggccgtttacggttaccagaccgaacgtaaaaccccgtcgggacccgacgggaccccttaccccgagggtccccttacccttacacttaccctaaccgtacggttacgaccctaaccgtttaccccgaaccccggtaacgggggtaccccctaacggtcgggttaccgtacccccggtaacggtacccggtttaaacggggtttcccgtaaggggttcggggtaacccgttacggggttcgggggtttaccgttacggggggaaaccgtaaggggttaacccgttttaccggaaccggttacccgtaccccgtaaaccgtaccgttaacccgtaccggtacccgtaaaccgggccccggttaggggtcccgggtttaacctaaggggttaaaacgttttaaccgtttttaacggaacgtttaaaacggtttacgttttaaaccgttttaaccggtcgtttaccgttaagggtactttaaaacgttttaaacgttaaaaccgtttaccgtaccggtttacccccggtttaccgggtttaaccggggttaccgggttttaacccggggaacccgggtttaaaaccggggaccggggttaacgggggtaaccggttaaaaacggttaacccggaaaaccgggtttaaaccggttcgggttaaccgggtacgtttaccggaacccgttaacccgtttaccgttacggttttccccgtttaaccgg

SEQ ID NO: 117866 - DNA, 830 bp, Homo sapiens
  misc_feature: GYAE6OF02FUNN0.36.32.C10.1.454.CMB.1.raw
  modified_base (206)..(206): a, c, t, g, unknown or other
  misc_feature (206)..(206): n is a, c, g, or t
tcagtacgctgtctcacgaccggtgctcgatttagtatagacatcaacacacaaagggggaggaactgctcagttaggacccagacggaaccatggaagccccagcgcagcttctcttcctcctgctactctggctcccagatactactggagaaatagtgatgacgcagtctccagccaccctgtctgtgtctccgaggggaaangccaccctctcttgtaggccagtcacggtattagcactaagttaggcttcggttccagcaagaaacctggaccacgggcctccccgaggccttccctacgacttacgtacctaggtcgacctactcccgaccgtacggggccctacgttcgggtccggtaccccacggtcccgtaacgggtttccgaggttacggggcgtaacggggttgggggtccgtttacgggggaacctagggtaacgggttttacccgaaccggttacccgttaaccgaaccccgtagttaacccgtaacggcccgaaccggtccccggttacggtacccggggttccgttaaacgggtaaacggtttacgtttttaacgggacccgtttaaagtttaacggtttaacttttaccgttacggtttccgttaggtaaccgttaacgttttaaacttaaacgttaaaccggttccggtttaccccgggttcccgggtttaacgggttacccggtttaacggggtacccgttaaaggggaaccccggtaagggggttacggtaaacgtaaccggtaaaacggtacgttacggttacggtacgtacgacccgtaaccttacgtacgtttcgtccgtttaaccg

SEQ ID NO: 117867 - DNA, 750 bp, Homo sapiens
  misc_feature: GYAE6OF02H2MRX.36.32.C10.1.454.CMB.1.raw
  modified_base (178)..(178): a, c, t, g, unknown or other
  misc_feature (178)..(178): n is a, c, g, or t
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (445)..(445): a, c, t, g, unknown or other
  misc_feature (445)..(445): n is a, c, g, or t
tcagtacgctgtctcacgaccggtgctcgatttagtatagacatcaacacacaaaggggggaggaactgctcagttaggacccagacggaaccatggaacgccccagcgcagcttctcttcctcctgctgctctggctcccagatacctacgtggagaaatgtgactgacgcagttcnccngcctacctgtctgtntctccgaaggggaanaccgtccacccttctcgttaggtacgggccagtcactagtattgctacttaattggcttcggtcagacaagtaaccgtcggcacggcctccggagtccctctacgacttcgtacgtagtcgtcctactccccgaaaccgcgggtacccacggtttcgggtcctacccgacgtacgtaggtttccagggttccgacggtcgggtttggtcggtaggtaacgcggttacgttaccncgtacctaccgtaacacgttcgaacggccgtaacggtcccggtacgggtaccggttcgttaacggtacggttttacgttttaacgggaccttttaagggtttacgttaaaccttttcggtccggttcttacggtacttttaaaacgtttacgtttaaaccgttaaccggttcggttaccccgttcggggtttaacgggtaccccggtttaccgggaccggtaaggggtacccgtaacgggtaaggaaaccgttacgaaacgtttcggacgtgggtcccgtacaccggtacctaggttccttacgg

SEQ ID NO: 117868 - DNA, 586 bp, Homo sapiens
  misc_feature: GYAE6OF01ATJQ4.48.45.E01.1.454.CMB.1.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (418)..(418): a, c, t, g, unknown or other
  misc_feature (418)..(418): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatccgtgggctcagtctgccctgactcagcctcgctcagtgtccggtctcctggacagtcagtcaccatctctgcactggaaccngcagtgatgtgngctaatacctatgtctctcgtaccaacaacacgcaggaccaaacgacccccaaactcaatgtatttatgtaatgtacaactaacgccgccctcgacgggtccctgcctcgcttctctgtcctcaagtctgcaacaccggtcctccctgacctactctcgtcgggcctccgaggctagaagntaggacgtctagtatttatttcgtgtctgcttactattactgaccacgtaccctaaacgttatttaacttcggttaccgttacggaaacgttcggaaccggtaaacccgtaacgggttacccaaccccggtttaccggttaaccggtacccgaacggtaaacccccgg

SEQ ID NO: 117869 - DNA, 551 bp, Homo sapiens
  misc_feature: GYAE6OF01AXBK6.48.45.E01.1.454.CMB.1.raw
  modified_base (302)..(302): a, c, t, g, unknown or other
  misc_feature (302)..(302): n is a, c, g, or t
  modified_base (407)..(407): a, c, t, g, unknown or other
  misc_feature (407)..(407): n is a, c, g, or t
  modified_base (445)..(445): a, c, t, g, unknown or other
  misc_feature (445)..(445): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctgtaccaacaacacgcaggcaaacgccccaaactcatgatttangatgtcactaagcgcctcgacggggtccctgctcgcttctctgctccagtctggacacgacggtcctccgtgaccatctcgtcgggcctccgaggctagaacgtntggaggtctagtatttacgttctgtctgcttacattancgacacgtacctaaattattagttcgttacgttacggaacttcggaaccgtaaccgtaaacggttccctaacccggttaccctagggtcccaacggtaacccccgg

SEQ ID NO: 117870 - DNA, 550 bp, Homo sapiens
  misc_feature: GYAE6OF01D9YXK.48.45.E01.1.454.CMB.1.raw
  modified_base (239)..(239): a, c, t, g, unknown or other
  misc_feature (239)..(239): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (405)..(405): a, c, t, g, unknown or other
  misc_feature (405)..(405): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcacatctcctgcactggaaccagcagtgatgttggngctaatacctatgtctcctggtaccaacaacacgcaggcaaacgcccccaaatcatgatttangatgtcactaagcggcctcgacggggtcctgcctcgcttcnctggctcagtctggcaacgcggcctcctgacccatctcgtcgggctccgaggctaggaagtntggaggtccttagtatttactttctgcttgcttacattatgaccagaccctaagttattattcggttacctttacgggaaacttggaaacgaaccccgtaagggttccctaacccggttaccttaacgggtccaacggtaacccg

SEQ ID NO: 117871 - DNA, 543 bp, Homo sapiens
  misc_feature: GYAE6OF01AKU0Q.48.45.E01.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagtgatgttggtgctaatacctatgtctcctgtaccaacacacgcaggacaaacgccccaaactcatcgtatttangtatgtacactaacgcggcctcgacgggtcctgctcgcttctcgtcgctcagtctgacacgcgcctcctagaccntctcgtggctcgagctagagngtgacgtctagtatttacgttcgtgtctgcttactatacgtcgactaactacctaattattacgtcgttccgttacggtaactcggaaccgtaccgtaacggtcccgtacccgttaccgtaacggtccgaaccggtaccccg

SEQ ID NO: 117872 - DNA, 690 bp, Homo sapiens
  misc_feature: GYAE6OF01C80BB.48.45.E01.1.454.CMB.1.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctggctcagtctgccctgactcagcctcgctcagtgtccgggtctcctggacagtcagtcaccatctcctgcactgaaccngcagtgatgttgngctaatacctatgtctcctggtaccaacaacacgcaggcaaacgccccaaatcatgactttagtgatgtcaactaacgccggccctcgacggggtccctgcgtccgtcttctcgtcggcctaccgagtctacggaccaaccgaccggtccctcccgtacgaccctaacgttccgtacgtcgggtcctaccgtaggtcctaggaacgtacgtaggacggtcttacggtaacttttacgttacgtcgttcgtttacggttttaccttacgttttttaccttaacggtttttttcccgttttttacggttccgttttaaccgggtaaccggttacccgggggtaaccgttaaccggttccgttaacgtttcccggttacccggttaacgggttaccctaccggtaaccccccgtaaacggtccccctaaaacccccgtgtttacccggttaaccc

SEQ ID NO: 117873 - DNA, 674 bp, Homo sapiens
  misc_feature: GYAE6OF01C4ZQ2.48.45.E01.1.454.CMB.1.raw
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
tcagagtatacatacacgaccggtgctcgatttagtgagtcagtaagggaaaggggggggtctcaggaggcagcactctcgggacgtctcccaccatggcctgggctctgctcctcctcagccctcctcactcagggcacaggatcctgggctcagtctgccctgactcagcctcgctcagtcgtccgggtctccgtggacagtcagtcaccatctcctgcacgtggaaccagcagtgatgttgngctaatactatgtctctgtaccaacacacgnacgacaaacgacccccaaatcatgtatttagngtatcgtacaacgtaacgccggtaccctcgacgggtccctgctcgtcttcgtcgtcgcctccagtcngaccacaccggtccctccgtcgacctacttccgtacgtccggttcctaccgtaggtaccgttaggaaacgtagtacgggtagtccgttagttacttttacgtttcgtcgtacttcggtcctttacgtttaccttttaccgtttaacgtttttcccgttttttacgtacccggttttaccgggtaaaccggttccggggtaacccgttacgggttcccttacccggttcggttaccgggtacccgtaccggtaaaccccgaaccccggtcccctaaaacccccgtgttacccggtacccc

SEQ ID NO: 117874 - DNA, 663 bp, Homo sapiens
  misc_feature: GYAE6OF01D6YIC.48.45.E01.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
  modified_base (314)..(314): a, c, t, g, unknown or other
  misc_feature (314)..(314): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacagtcagtccaccatctcctgcacgtggaaccngcagtgattgttggnactaatacctatcgtctctggtaccaacacacgcacggacaaacgccccaaacgtcaactgtactttangatcgtacacgtaacgccgccctacgacgggtccctgcgtcgtcttcgtctcggtcctacctaacgtctacggaccaaccgtaccgggtccctaccgtacgtacctacgtcgtccgttcgggccttacccggagggtacctaagggtaacgtacgtacgggtacggtcttacgggttaacttttacgtttcgttacgtcgttacgtaccttacgtaatacgtcgactaacggtacccttaaagtttacttaacggttcgtttaccggttacgggtaacttacggaacccgtaaccgtaaccgggtaccctaacccggttaccgttaacggtccgaccggtaaaccccgg

SEQ ID NO: 117875 - DNA, 669 bp, Homo sapiens
  misc_feature: GYAE6OF01C0Q4I.48.45.E01.1.454.CMB.1.raw
  modified_base (240)..(240): a, c, t, g, unknown or other
  misc_feature (240)..(240): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttgnctaatacctatgtctcctgtaaccaacaacacgcacggacaaacgacccccaaatcatacgtaatttatgatgtacaactacgccggtccctcgacggggtcctgcctcgtcttcctctcggcctaccgagttctacggacctaaccgaccggtccctacccgtacgaaccctagttcccgtcggttcgggtccctaccggaacgggtcctagggaaacgtacgtacggtacggtcttagttaacttttactttcgtacgtcttacgtctactattacgtacgacctaaacgtacccttaattaacgttttacgttacgtttaccggttaaccggtaaacgttacggtaaacccggtaacccgtaaacgggttaccccgttaacccggttaccgttaaacgggtccctaaacccgggtaaaccccccgg

SEQ ID NO: 117876 - DNA, 620 bp, Homo sapiens
  misc_feature: GYAE6OF01C1B4S.48.45.E01.1.454.CMB.1.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
tcagagtatacatacacgaccggtgctcgatttagtgagtcagtaagggaaaggggggggtctcaggaggcagcactcctcgggacgtctccaccactggcctggctctgctcctcctcagcctcctcactcaggcacaggactccgtgggctcagtctgccctgactcagccctcgctctagtcgtccgggtactcctggaccagtcagtcaccatctcctgcatgaaccngcagtnatgtgtgctaatacctatgtactctcggtaccaacaacncgcaggacaaacgccccaaatcatcgtatttacngatcgtacactaagccgccctgacgggtcctgctcgcttcgtcgtggcctactagtcctcggacctaaccgaccgtcctcccgtagacctacgtccgtcgtcgggtcctaccgaaggtctagtaacgagttcggaacgttccttagtaattttcgtttcgtcgtcctttcggtaccttactaattcgtagtaccgtaacgttacctaaacgttagtttaccgtaacggtttacgtaaccggtaacgtacggtaacgtaacccgtaggttaccctacccgttaacaccggttcgaacccgtaaaccccgg

SEQ ID NO: 117877 - DNA, 620 bp, Homo sapiens
  misc_feature: GYAE6OF01CR1RV.48.45.E01.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcagtcaccatctcctgcactggaaccngcagtgatgttggngctaatactatgtctcctaggtaaccaacaacacgcaggacaaacgcccccaaatcatcgtatttangtatgtacacgtaagccggccctgacgggtccctgctcgtcttctcgtcgcctcacgtctcggacaacgcgtcctcccgtgacctatccgtcgtcgggtcctcgaacggtctaggaagtacgtggacggtaccttagtaacttttacgtttccgtagtccttacggtaccttactattacgtcgaccctaacgtaccccttaaattacgttttagttccggtttaccgttacggtaacttacgggaaaccgtaacccgttaacggtcccgtaaaccccggttcgtaacggtccctaaccggtaaacccccg

SEQ ID NO: 117878 - DNA, 556 bp, Homo sapiens
  misc_feature: GYAE6OF01AXVEW.48.45.E01.1.454.CMB.1.raw
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctctgcactggaccagcagtgatgttggtgctaatacctatcgtctcctgtaccaacacacgcaggacaaacgcccccaaatcatgatttangatgtcactaagcgtccctgacggggtccctgcctcgcttctcngctcaagtctggcaacgccgcctccgnacctntctcngggcctcgagctagaagntgagctagtatttactttngtactgacttacattancgaccacgtaccctaaattacgtttacgttcgttacgttacgggaacttacggtaaaccgacccgttaaaccggttccctaacccggttacccgttaggtacccgaacggtaacccccg

SEQ ID NO: 117879 - DNA, 633 bp, Homo sapiens
  misc_feature: GYAE6OF01BL568.48.45.E01.1.454.CMB.1.raw
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctcgccctgactcagcctcgctcagtcgtccgggtctccgtggacaggtcagtccacctatcctcctgccacgtacggaaaccngctagtgattcggttaggngtacttaactaccttagttcgttccttaccgtacggtaaccaaacaaccgacgacgaacggaccaaaaccggaccccctaaaactccgattacgtatttagtgtactcgtacaacgtaacgccggtaccctacggaccggggtccctgccgtcgtccttcgtcgtcgcctaccgtagtccgtacgaccaaccgtcggtcccctaccgtacgacctacttccgtacgtcggcctacgacggtacctagaacgtagtgacgtctagttatttcgttcncgtctcgctntatcncgacacgtactacttattacgttcgtacgtacgactggaacctacgtacgtcccgtacgttacgtacggtcccacgtaaccccg

SEQ ID NO: 117880 - DNA, 588 bp, Homo sapiens
  misc_feature: GYAE6OF01A9Z46.48.45.E01.1.454.CMB.1.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccngcagtgatgtgnctaatacctatgtctctgtaccaanacacgcagcaacgccccaatcatgtatttangatgtacactaagccggccctcgacggggtccctgcctcgtcttctcgtggcctccgagtcgtggaccaaccgaccggtccctcccgtcgaccctactccgtcgtcgggcctccgaggtctaggaagtagtcggaggtcttagtactttagtttctgtctcgccttatattacgtcgaccacgtaccctaagtttacttacgttcggttaccgttaccgggtaaacttcgggaaccgtaaccgtaacggtaccctaacccggttaccgtacggtacccgaccggtaacccccg

SEQ ID NO: 117881 - DNA, 718 bp, Homo sapiens
  misc_feature: GYAE6OF01E4TQI.48.45.E01.1.454.CMB.1.raw
  modified_base (245)..(245): a, c, t, g, unknown or other
  misc_feature (245)..(245): n is a, c, g, or t
tcagagtatacatacacgaccggtgctcgatttagtgagtcagtaagggaaagggggggggtctcaggaggcagcactctcgggacgtctccaccatggcctgggctctgctcctcctcagcctcctcactcagggcacaggatccgtgggctcagtctcgccctgactcacgcctcgctcgaggtcggtccgggtctccgtggactagtcagtccacctatcctcctgaccacgtacggaaccngccagtgtagttggttggtcactaactacctatcgtcctcgtacggtaaccaacacgacgacgacggaaccaaaccgaccccaactctatagttacttagtgtactcgtacacgtaccggtccgtccgtacggtccgggtcctcgtccgtcgtcctcgtcgtccggtacctaccgtacgtccgtacggaccaaccggtacccgtccctccgtaccgacctacgttccgtaccggtccggtacctcggtacgggtactaacggaacggtcggtacggtccgtagtttaacgttactttccgttacgtcggtctaccgtacttacgtattacgtacgtaccgtaacgtaaccttaacgtttacgtaacgttccggttaccgttaacgggacgttaccgggtaaaccgtacccgtaaacccgggttacccgttaccgggtaaccggtacccggtaccgtaacccggtaaaccccgg

SEQ ID NO: 117882 - DNA, 614 bp, Homo sapiens
  misc_feature: GYAE6OF01CEGEJ.48.45.E01.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (318)..(318): a, c, t, g, unknown or other
  misc_feature (318)..(318): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacngtcagtcaccntctcctgcacgtggaaccngcagtgatggttggnactaatactatcgtcctccgtagtaccaacaacacgcaggacaaaccgccccaactcaatgtactttatgattnacacgtaacggccggtccctacggaccggggttcctggtccttcggtcttcctcgtcggtcctaccgtagtctacggacctaaccggaccgtccctcccgtcacctacttccgtccgtcgggtcctaccgaggtcctagaagtcgtgtacgtctagtactttcttcgtcgtctcgtactcgtattcgcgtacacgtacttaacgttgtacgttcggtcccttaaagggacgttcggtaaacccgaccgttaccggtacccttacccggtagtaccggtacccgaccggtaaccccg

SEQ ID NO: 117883 - DNA, 812 bp, Homo sapiens
  misc_feature: GYAE6OF01BXK7L.48.45.E01.1.454.CMB.1.raw
tcagagtatacatacacgaccggtgctcgatttagtgagtcagtaagggaaagggggggggtctcaggaggcagcactctcgggacgtctccaccatggcctgggctctgctcctcctcagcctcctcactcagggcacaggatcctgggctcagtctcgccctgactcacgcctcgctcagtcgtccggcctcgtggacagtcacgtcacctatctcctgcacgtacggaaccagctagtcgtagttggttggtacgtactaacttaccttagttcgtccttccgtacggtaaccaaacaaccgacgacgaacggtacccaaaaccggaaccccctaaacgtacctagttagttaacttttaacgtacgtaacgttacgttaaccgtaaccgttaaaccggtcccggtaccccgtacgggttacccggggttacccgttcggtacccgttccggttccttccgttccggtccggtaccctacgtacgttccgtaccggaacctaacccggtacccggtcccttacccggacgtaaccctcgttaccgttccggtcgggtaccttaccggtacggtacgtaacgtaacggtcgtacgggtacgttaccttaaggtttacgttttactttaccggtcggttaccttaccggtacgttaactaaccggtttcacgggtaccctaaccgtaacctttaactttagttaccggtttcccgttaacggttacgaacgttacccggaaggtaaaccccgtacgggttaccccttaaccgggttaccggaaccggttacccgaacccggtaaacccccg

SEQ ID NO: 117884 - DNA, 753 bp, Homo sapiens
  misc_feature: GYAE6OF01C6DYO.48.45.E01.1.454.CMB.1.raw
tcagagtatacatacacgaccggtgctcgatttagtgagtcagtaagggaaagggggctggggtctcaggaggcagcactctcgggacgtctccaccatggcctgggctctgctcctcctcagcctcctcactcagggcacaggactccgtgggctcagtctcgccctgactcacgcctcgctcaggttcgtccgggtctcctggacagtcagcaaccattcctcctgctaactacggaaccagcaagtgtacgtggttcggtacactaaactaccttagtacgttcctccgtaggtaacccaactaacaccgacgaacgggtaaccaaaaccgccccctaaaacgtccgtaatacggttaatttacgtagtaacgtcgtaaccaaaccgttaacgggcccggtaccctacgggtaacccgggggttccctcggtaccgttccggtccctttcggtaccgttcggacccttaaccgaacggttaccgttaggaacccgtaaccgtaccccgggtaccctccccgttaacgtaccctaacttcccgttaaccggcgggttaccctacccggacgtacggtaacgaaggtacggtcggtaaggtaccgttaagtttaactttttccgttacgttcggtaccgttggtaaccttacgtaacttagtcgaaccctaacgtaccttaacgtttattcgtcggtttaactcgtaactaacggctaaacggtactccggtaaccgtccgttggaaacccg

SEQ ID NO: 117885 - DNA, 651 bp, Homo sapiens
  misc_feature: GYAE6OF01A06EB.48.45.E01.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (488)..(488): a, c, t, g, unknown or other
  misc_feature (488)..(488): n is a, c, g, or t
  modified_base (514)..(514): a, c, t, g, unknown or other
  misc_feature (514)..(514): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggactccgtgggctcagtctgccctgactcagcctcgctcagtcgtccgggtctccgtggacngtcagtccacntctctgcactaggaaccngctagtgatggttgtgactaactaccttatcgtctaccgtcggtaaccaacacacgacgacgaccaaaccgaccccctaatcattacgtattatgatcgtacaacgtacggtccgcctcggtaccggggtccctaggtccctcgtccttacgtctcggtacctaccgtacggttcgtaccggacctaacggacccgtcccttacccgtacgaccttcgtcgtccgtcggcctacggagccgttagacgcgtggacgnttacgtatttacgttcgacgtccttntacgtacttattcgacgttacgacgtaccttaacgttagttaccgtttacggtccgtttacgggtaacaccgtaacggttaccgtaaaccggtccgtaaccggttacccggtagttacccggaacccgtaaccccgg

SEQ ID NO: 117886 - DNA, 683 bp, Homo sapiens
  misc_feature: GYAE6OF01A8MD8.48.45.E01.1.454.CMB.1.raw
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (542)..(542): a, c, t, g, unknown or other
  misc_feature (542)..(542): n is a, c, g, or t
  modified_base (653)..(653): a, c, t, g, unknown or other
  misc_feature (653)..(653): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacgaggactccgtgggctcagtctgccctgactcacgcctcgctcagtcggtccggtctccgtggacctagtcacgtcacctatcctcctgcacgtacggaacncgcgtagtgtacgttggtacggtntactactacctagtcgtctcgtacgtaaccaacacgtccgagaccgtaaccgaaacccgacccctaaacgtacctacgttacgttaactttacgtacggtactacgtaaccgtaaccgtaccggtacccggtcccgtaccggtaccgggtccctcggtacctccggttcctccgttcgtccgtacctacgtacgtccgtcggaccctaaccggtcccgtacctccgtacctaccgtctcgtccgtcggtccgacgtacgtacgagtacgtcgtaacgngttacttaggttacttacgttctacgttagtccacgttatacgttacacgtcgaacttccgtaaagtcttagtaccggtccgtaagtctaaggaccgtacgtacccgtacncccggttaagtcgtcgtaacccgtaacccg

SEQ ID NO: 117887 - DNA, 651 bp, Homo sapiens
  misc_feature: GYAE6OF01CGEHL.48.45.E01.1.454.CMB.1.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (558)..(558): a, c, t, g, unknown or other
  misc_feature (558)..(558): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatccgtggctcagtctcgccctgactcgacgcctcgctcagtcgtcccgggttctccgtggacagtccacgtcaccacttctccgngcacgtcgaaccngcagtgagtgttgnactatactatcgtactcgtacgaccaacaacncgacacggaccaaccgaccctaanctatagtatttagngatacgtacacgtacgccgtaccgtcggtaccggtcctcgaccgtccgtccttcgtctacgacgttacgacgtcgtaccgaacgtaccgtccgtccctacgtacgtaccctcgtaccgtcggtcgaccgtccgtaagcggttacgaaggacgttcggtacgagttacgttaacgtttcttacgtacgtctccgtactacttacgtaactcgacccgtaacgttacctaaagttnttaaacggtcgttaaaccggtagacccgttaaggaacccgtacgttaaccgtacccggtttacccggacgtcgtaaccgaacccggtaacccg

SEQ ID NO: 117888 - DNA, 485 bp, Homo sapiens
  misc_feature: GYAE6OF02IOQ6C.48.45.E01.1.454.CMB.1.raw
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaacgcccccaaactcatgatttatgatgtcactaagcggcctcgaggggtccctgctcgcttctctggctcaagtctggcaacncggcctccctgaccatctctgggctccgaggctgaagntgagctgattattcngctgctnatatgcagcctaatattatgtcttacggaatgagaccaggtcaccgtctaggtcagacccg

SEQ ID NO: 117889 - DNA, 515 bp, Homo sapiens
  misc_feature: GYAE6OF02G5R5E.48.45.E01.1.454.CMB.1.raw
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaanaacacgcaggcaaacgcccccaaatcatgatttangatgtcactaagcgcctgacgggtcctgctcgcttctcgtgctcagtctggcaacgcgcctcctgaccatctctggcctcgaggctagaagntggagctgtatttacttcngcttgctactatatgcacgcctaattatttactcgttaccttacggaactggaaccgtaccgtaacggttccaccgttaccgtacggtccacggtaccccg

SEQ ID NO: 117890 - DNA, 484 bp, Homo sapiens
  misc_feature: GYAE6OF02GDKDP.48.45.E01.1.454.CMB.1.raw
  modified_base (418)..(418): a, c, t, g, unknown or other
  misc_feature (418)..(418): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggcctcaggggtccctgctcgcttctctgctcaagtctggcacacgcctcctgaccatctctgggctccgaggctgaagatgagctgattattctgctgctnattatgcagccaatattatgtcttacggaactgaacgaccaaggtccaccgtctaggtcagacccg

SEQ ID NO: 117891 - DNA, 495 bp, Homo sapiens
  misc_feature: GYAE6OF02FT8PP.48.45.E01.1.454.CMB.1.raw
  modified_base (360)..(360): a, c, t, g, unknown or other
  misc_feature (360)..(360): n is a, c, g, or t
  modified_base (426)..(426): a, c, t, g, unknown or other
  misc_feature (426)..(426): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaatcatgatttatgatgtcactaagcggccctcaggggtccctgctcgcttctctgctcagtctggcaacncgcctcctgaccatctctcgggcctccgaggtctagaagatggaggctgatttattctgctgctanattatgcagccaattattatgttcttacggaacctgaacgaccaaggtccaccgtctaggtcagacccg

SEQ ID NO: 117892 - DNA, 570 bp, Homo sapiens
  misc_feature: GYAE6OF02FN532.48.45.E01.1.454.CMB.1.raw
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaacgcccccaaatcatgatttangatgtcactaagccggcctcgacggggtccctgctcgcttctcgtggctccaagtccnggcaaccncggccctccctagacccatcctcgtcgggcctccgaggctagaagtntaggaggtctgtaactttatttctgcttcgccttacaagttagtcgactaacgtaccctaaacgtttacttagttcgttaccgttacggtaactaggaacgtacccgtaacggtccctaacccggttccgtaacggttccaacggtacccccg

SEQ ID NO: 117893 - DNA, 612 bp, Homo sapiens
  misc_feature: GYAE6OF02JDCHS.48.45.E01.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (309)..(309): a, c, t, g, unknown or other
  misc_feature (309)..(309): n is a, c, g, or t
tcagagtatacatacacgaccggtgctcgatttagtgagtcagtaagggaaagggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctcctgcactggaaccngcagtgatgttggngctaatacctatgtctcctggtaccaacaacacgcaggacaaacgacccccaaactcatgatttangatgtcactaacgccggcctacgacggggtccctgcctcgcttctcgtcggctaccaagtctcggacaacgacggccctcctgaccctattccctcgtcgggtcctaccgacgggtcctaggaacgtagtcgggaacggtccttaggtaacttttacgtttcgtgtccttaggtcctacttaagttacgttcgaccaacgtaccctaatttacttacgtcgtttaccgttacggtaactcggaaccgtaaccgtaacggttaccgtacccgttaccggtaacggttacccaccgtaaccccgg

SEQ ID NO: 117894 - DNA, 511 bp, Homo sapiens
  misc_feature: GYAE6OF02FSRE9.48.45.E01.1.454.CMB.1.raw
  modified_base (241)..(241): a, c, t, g, unknown or other
  misc_feature (241)..(241): n is a, c, g, or t
  modified_base (364)..(364): a, c, t, g, unknown or other
  misc_feature (364)..(364): n is a, c, g, or t
tcagagtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggngctaatacctatgtctcctggtaccaacaacacgcaggcaaacgcccccaaactcatgatttatgatgtcactaagccggccctcgaggggtccctgctcgcttctctgctcagtctgcaacncgcctcctgacctatctctgggcctccgaggctagaagatggagctgtatttattctgctgctctatatgacacgcctaacttattatcgttcttaccggtaactgacgaccgtaggtcctaccggtcctaggtccacggaaccccg

SEQ ID NO: 117895 - DNA, 549 bp, Homo sapiens
  misc_feature: GYAE6OF02HXCU8.48.45.E01.1.454.CMB.1.raw
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
tcagagtatacatacacgaccggtgctcgatttagtgagtcagtaagggaaagggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttgngctaatacctatgtctcctggtaccaacaacacgcaggacaaacgccccaaactcatgatttangatgtcactagccgcctcgaggggtccctgctcgcttctcgtcggctcaacgtctggccaacgcccggccttcctacgacctactctcgtcggcctcgacggctagaatgtgacggtctgtattacttctaggcttggcttacgattagcgtacacgtacctaacttatttacgtcgttacgttacggaacttcgaacgtacccaaggtccctaaccgttccgtaggccaaccggtaaccccgg

SEQ ID NO: 117896 - DNA, 596 bp, Homo sapiens
  misc_feature: GYAE6OF02HVKLG.48.45.E01.1.454.CMB.1.raw
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (438)..(438): a, c, t, g, unknown or other
  misc_feature (438)..(438): n is a, c, g, or t
tcagagtatacatacacgaccggtgctcgatttagtgagtcagtaagggaaagggggggtctcaggaggcagcactctacgggacgtctccaccatggcctgggctctgctcctcctcagcctcctcactcagggcacaggatcctgggctcagtctgccctgactcagcctcgctcagtgtccggtctcctggacagtcagtcacatctctgcactggaaccagcagtgatgttggtgctaatcctatgtctccgtggtaccaacaacncgacaggcaaacgcccccaaatcatgatttangatgtacactaagccgcctcgacggggtcccngcctcgtcttctcgtcggctaccaagttcctcggacctaaaccgccggtcccttacccgtacgaccctacgttccgtcgtcgggcctaccgagggtctagaagnttggacgtcttagtaactttacgtttctacgtctacgtctacacttgtcggacagtacctaactttagttacgttacggttaccgttacgggtaactggtaaaccgtaccgtaacggttaccacccggtttaccgtacggttacccaacgaaccccgg

SEQ ID NO: 117897 - DNA, 534 bp, Homo sapiens
  misc_feature: GYAE6OF02I5PAZ.48.45.E01.1.454.CMB.1.raw
  modified_base (240)..(240): a, c, t, g, unknown or other
  misc_feature (240)..(240): n is a, c, g, or t
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
tcagagtatacatacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagtgatggttggngctaatacctatcgtctcctagtaccaacaacacgcaggacaaacgacccccaaactcgatagtatttangtatgtacaactaacgccgtcctcgacgggtcctgctcgcttcnctcgctcaagtcnggacacgacgcctccngacatctcgtggcctcgagtctagaagcgtgacgcttagtatttattcngtactntctntagtctgcaacgtactaattattagtcgtacgttacggaactagacgtaaccgtacggtacctacggtacccgtaggttccgacgtaacccg

SEQ ID NO: 117898 - DNA, 549 bp, Homo sapiens
  misc_feature: GYAE6OF02HVP7B.48.45.E01.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (391)..(391): a, c, t, g, unknown or other
  misc_feature (391)..(391): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
tcagagtatacatacacgaccggtgctcgatttagtgagtcagtaagggaaagggggggggtctcaggaggcagcactctcgggacgtctccaccatggcctgggctctgctcctcctcagcctcctcactcagggcacgggatcctgggctcagtctgccctgactcagcctcgctcagtgtccgggtctcctggacagtcagtcaccatctcctgcactggaaccngcagtgagtgttggngactaatacctatgtctcctggtaaccaacaacacgcacggacaaacgacccccaaactctatgtatttatgatgtcaactaagccggtccctcgacgggtcctgcctcgcttctcgtgctcgagtctcggacaaccgaccgcctccngacctatccgtcgtcgggctccgaggctagaacgtgtacggagtcttagtatttctttcngtctnctnatntcgcacacctaatcttatcgtccgttaacgaactggaacgtaccgtaggtacctacgtaccgtacggtaccacggacccgtaaccgg

SEQ ID NO: 117899 - DNA, 687 bp, Homo sapiens
  misc_feature: GYAE6OF02HXHZG.48.45.E01.1.454.CMB.1.raw
tcagagtatacatacacgaccggtgctcgatttagtgagtcagtaaggggaaagggggctggggtctcaggaggcagcactctcgggacgtctccaccatggcctgggctctgctcctcctcagcctcctcactcagggcacaggatccgtgggctcagtctgccctgactcagcctcgctcaggtcgtccgggtctccgtggacagtacagtccaccgatcctcctgactacgtcggaacccagcagtcgagttgttggtcgctaatacctattcgtctcctaggtaaccaacgaacaacgcgacggtaccaaaccgcccccaaaactcaagtagtaacttttatggtaatcgttaccaacgtaacggccgggtcccttacggaccgggggttccctcggtacctccggtacctttccgtacgtcggtacccttaccaaacggttcttacgggaacctaccgaacccgggtcctcccgtagaccctatcgtcgtcgggtccttacccggaggtcgtacgaagtagtcgggaacggtcttaggtaacttttacttacggttcggtccttaggtcctttcgtaattagtcgtaccacggtacccggtaatttagtacgttccgttacgtacggtaacccgtgtaacgaccgtaaaccgggttccctacggttaccgtcggtaaccccg

SEQ ID NO: 117900 - DNA, 704 bp, Homo sapiens
  misc_feature: GYAE6OF02H1KHZ.48.45.E01.1.454.CMB.1.raw
  modified_base (225)..(225): a, c, t, g, unknown or other
  misc_feature (225)..(225): n is a, c, g, or t
  modified_base (312)..(312): a, c, t, g, unknown or other
  misc_feature (312)..(312): n is a, c, g, or t
tcagagtatacatacacgaccggtgctcgatttagtgagtcagtaagggaaagggggggggtctcaggaggcagcactctcgggacgtctccaccatggcctgggctctgctcctcctcagcctcctcactcagggcacagatcctgggctcagtctgccctgactcagcctcgctcagtcgtccggtctctggacagtcagtccacatctctgccactggaacngcagtgatggtgtgctaatactatcgtctccgtagtaaccaacaacgacgcacggacaaacccgaccccaaactcaatgtactttanacgtatcgtactaacgtaacggcccggtacctacggtacggggtccctcggtccttaccgtccgtttcctccggtcggtaccttacccgtaacgttccgtacggaacccaaccggtacccggtcccttacccgtcgaacccgtaccgttccgtaccggtcgggtacccttaccggacgggtcttaacggaacggttacggtacgtacggtacttcgtaaatttcgtttaacgtccgtcttacggtacctagtacgttagtccgtaacgtaaccgtaccctaaatttactttacggttacgttaccggttaacgtaaccgtacggtaaccgtaaccggttaacggtaccccttaccggttacccggtacggttacccgacccgtaaaccccgg

SEQ ID NO: 117901 - DNA, 732 bp, Homo sapiens
  misc_feature: GYAE6OF02GZQFA.48.45.E01.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
tcagagtatacatacacgaccggtgctcgatttagtgagtcagtaagggaaaggggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacngtcagtcaccatctcctgccactcggaaccngcagtgatggttggtcactaatacctatcgtctctacggtaccaacaacacgcaacggacaaaccgaccccaaatccatagtactttatcgtatcgtactacgtaacggtccgacctacggacgggtccctcgtctccgtcttcgtcgtcggtcctaccgtacgtccgtacggaccaaccggtacccggtccctacccgtaccgacctacgttccgtacgtccgggtccttacccggacggtactacgggtaacgtacggtacgggtaacggttaccttaggtttaactttaccgttttcgtaaccggttcttaccggactttacgttaacgtacttacggtaaccgtaacgttaaccgttaactttacgttttaacggttccgtttaaccggttaaccggttaaaccgtacgggtaaacccggttaaccggttaaccgggttccccgtaaacccggttacccgggttacgggttacccggaacccggtaacccccggg

SEQ ID NO: 117902 - DNA, 744 bp, Homo sapiens
  misc_feature: GYAE6OF02IMM3L.48.45.E01.1.454.CMB.1.raw
tcagagtatacatacacgaccggtgctcgatttagtgagtcagtaagggaaaggggggggggtctcaggaggcagcactctcgggacgtctccaccatggcctgggctctgctcctcctcagcctcctcactcagggcacaggatcctgggctcacggtctcgccctgactcagcctcgctcagtcgtccgggtctccgtggacagtcagtccacctatcctcctgaccacgtacggaaccaggctacgtcgtaagttcggttggtacgtacgttaacttacctagttcgtcctaccgtacgtaacctaacgaacacgacgaacggaccaaccgaccccaaactcgaacttacgtactttatacgacttacgtactaacgtacggtccgtccgtacggtacggtcccgtcgtccgtacgtccttccgtcggtacgtaccttaccgtaacgttccgtacggtacccgtaaccgtccgtcctacccgtcgaacccttagtccgtcggtcggtaccgtccggacgtaccgtagtaacggtacgtaggtaccggtacttagtttaactttacgtttccgtacggttacgttacgtaccgttaacttacgttaaccgttcggaaacctaccgtaaccttaacgttacgtttacgttaccggttaacgttacccggtaaacgtaccggtaaccgaaccgggttacgtacccgtaccgttaaccggaacgttacccggacccgaaccccgg

SEQ ID NO: 117903 - DNA, 661 bp, Homo sapiens
  misc_feature: GYAE6OF02F4XBR.48.45.E01.1.454.CMB.1.raw
  modified_base (230)..(230): a, c, t, g, unknown or other
  misc_feature (230)..(230): n is a, c, g, or t
  modified_base (245)..(245): a, c, t, g, unknown or other
  misc_feature (245)..(245): n is a, c, g, or t
tcagagtatacatacacgaccggtgctcgatttagtgagtcagtaagggaaaggggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcacgtgaaccngcagtcgatggttgngactaatacctatcgtctccgtagtaccaacaacctcgacaggaccaacgacccccaaactcatgtacttatgtatactcaactaagccgtacctcgacgggtcctagtcctcgtcttccgtcgtcgtcctaccgtagtccgtcgacctaaccgaccggtccctaccgtacgaacctacgtttccgtacgttccggggaccttaccggacgtacgtaacggtaacgacgtacggacggggttaccttaggttaccgtttttagtttccgcggttaaccgttcgtaccgttactaagtttacgacgtacgtaaccgaacccttaagtttcgttacggtccgtttaccggtaacgtactacggtaccgtaaccgtacggtaccctaaccggtaccgtaggtacccacggtaaccccgg

SEQ ID NO: 117904 - DNA, 720 bp, Homo sapiens
  misc_feature: GYAE6OF02GL82Z.48.45.E01.1.454.CMB.1.raw
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
tcagagtatacatacacgaccggtgctcgatttagtgagtcagtaagggaaaggggggggggtctcaggaggcagcactctcgggacgtctccaccatggcctgggctctgctcctcctcagcctcctcactcagggcacaggatcctgggctcagtctcgccctgactcacgcctcgctcagtgtccgggtctccgtggactagtcagtccacctatctcctgcacgtggaaccngcagtgattgtggtnactataccgtatcgtcctccgtacgtaaccaacaaccacgacgaggaccaaaccgacccccaaactcgagtagtactttagtgtatcgtactaccgtaacggtccgacccgtacggtacgggttccctggtcgtaccgtctttcgtcgtcggtctacccgtaacggttccgtacggaccaccgtaccggtcccgtaccgttaccggacctacgtcccgttcggtccgggtcctaccggacgttcgtacgaagttacggtacggttacggtacgttacgtacgttttacgttcggtcgttacgttacgtaccgttaagttacgttacgtaccggctaggtacctacgggtaccttaacgggttccggtttcggggttccgggttaccgggggacgggttaacccgggtaccgtaacgggttacccggttccgggttaaccccgtttacgggaccgttaccggtaacccgg

SEQ ID NO: 117905 - DNA, 830 bp, Homo sapiens
  misc_feature: GYAE6OF02G84ZS.48.45.E01.1.454.CMB.1.raw
  modified_base (617)..(617): a, c, t, g, unknown or other
  misc_feature (617)..(617): n is a, c, g, or t
tcagagtatacatacacgaccggtgctcgatttagtgagtcagtaagggaaaggggggggggtctcaggaggcagcactctcgggacgtctccaccatggcctgggctctgctcctcctcagcctcctcactcagggcacaggatccgtgggctcagtctcgccctgactcacgcctcgctacagtcggtccgggtctccgtgactagtcagtccacctagtcctctgacctacgtacggaaccagacgtaggtagtacgttggttacggtactaacgtaactacttactcgttacctaccgtaacgtaaccaactaacgtacgacgaacggaaccaaacccgacccctaaacgtctaacgtacgtacttaagtacgaagtactacctaacgtaccggtcccgtaccgtacggtacgttaccgtttacgtacttccgttacctacgttccgtcgtaccgttaccgtagttaccgtacgaccgtaacccgtacccggtacccgtaccgtaacgtaaccttaaccgtccggttaccgggtaccggtacctaccgggtacggtccggtaacggacgggttaacggttacgtaccgttaagttaaccgtttagttacccgnggtttaccgtacgtaacgtttacgtaacgtttaccgacgggttaaccggttaacgggttaaccggtttaccgttttacgggttcggggttaccggttaacggggtaacccggtaaaccgggtaacggaacccgttaaccggttacgggtacccgttaacccgggttaccgggtaacccgggtttaacccaacccggttccggtaaaccccggg

SEQ ID NO: 117906 - DNA, 748 bp, Homo sapiens
  misc_feature: GYAE6OF02HHZRA.48.45.E01.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
tcagagtatacatacacgaccggtgctcgatttagtgagtcagtaagggaaagggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtcngtcaccatctccgtgcacgtggaaccagcagtgatgttggngactaatactatgtcctctggtaaccaacacacgacaggaccaaacgcccccaaatcgactagtatttacgtgattgtaccaacgtacgtccggacccgtacggacggggtccctgtccgtcgtcctttctcggtcggacccttactaaggtccttacgggacctaaaccgtccggtcccgtacccgtacgtaccctaacgttccgtaccggttcgggtaccctaccggtaacggtaccgttaagggtaaaccgttaggtacggtaaacggtccgttagtttaaacgttttaacgtttacgttacggtacgtttccggactttaccgtaattacggttaccgtaaccgtaacgtaaaccccttaagttaccgtttaacgttaccggtttaacggttaaccggttaaacggttacggtaaacccggaaacccggttaacgggtttaacccctaaccgggtttaccccgtaacggggtttaaccccaaccgggtaaaccccccgg

SEQ ID NO: 117907 - DNA, 709 bp, Homo sapiens
  misc_feature: GYAE6OF02HH7LF.48.45.E01.1.454.CMB.1.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (538)..(538): a, c, t, g, unknown or other
  misc_feature (538)..(538): n is a, c, g, or t
  modified_base (587)..(587): a, c, t, g, unknown or other
  misc_feature (587)..(587): n is a, c, g, or t
tcagagtatacatacacgaccggtgctcgatttagtgagtcagtaagggaaagggggggggtctcaggaggcagcactctcgggacgtctccaccgatggcctgggctctgctcctcctcagcctcctcactcagggcacaggatccgtgggctcagtctgccctgactcacgcctcgactgagtcggtccgggtctccgtggacagtcagtcacctntcctcctgccacgtcggaaccngcagtnagttcgttaggngactaacttacctagtcggttctaccgttacggtaacctaacgaacacgacgacggacaaaaccgccccaaatccgaatacggtactttactacgattacgtactaacgtacggcccgtacccgtacgggtacggggtcccctggtaccgtttccgtcctttcgtcggtacggtacctaccgaagttccggtacggacctaacgtccgggtaccctccgtacgaccctagttccgtcgtccggtactccgaggtcgtaagtaacggtaagtcgaacggtnttataacttttacggttctaaggtcctaggtacccttatacgtttaacncgggtaaccacgtaaccgtaagtttacttacgttccggttaacggttaaccggtacgtaacggtaccgtaaacccggagtttcccggaccgtttaccggtcggttaccaccggttaacccgg

SEQ ID NO: 117908 - DNA, 577 bp, Homo sapiens
  misc_feature: GYAE6OF02IK09L.48.45.E01.1.454.CMB.1.raw
  modified_base (243)..(243): a, c, t, g, unknown or other
  misc_feature (243)..(243): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (439)..(439): a, c, t, g, unknown or other
  misc_feature (439)..(439): n is a, c, g, or t
  modified_base (565)..(565): a, c, t, g, unknown or other
  misc_feature (565)..(565): n is a, c, g, or t
tcagagtatacatacacgaccggtgctcgatttagtgagtcagtaagggaaagggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcaccatctcctgcactggaaccagcagtgatgttggnctaatacctatgtctcctggtaccaacacacgcaggcaaacgcccccaaatcatgtattatgatgtcactagccggcctcgacgggtcctgctcgcttcnctcggctctagtcnggccacgcgcctccctgaccagtcctcgtcgggcctccgaggtctaggaactagtcggaggtcctagtacttttacttcgtntacgttgccttactaagtacgttagacctaacgtacccttaacgttagtttacgttggtcccgtttaacggaacttacgggaaccgtaaccgtaccgggttccacccggttacctacgggttaccnccggtaaccccg

SEQ ID NO: 117909 - DNA, 612 bp, Homo sapiens
  misc_feature: GYAE6OF01A4JTL.17.16.B05.1.454.CMB.1.raw
  modified_base (377)..(377): a, c, t, g, unknown or other
  misc_feature (377)..(377): n is a, c, g, or t
tcagcgtagactagcacgaccggtgctcgatttagagctcacgtattgagtttggggaggtctcagagaggaagcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattccccttcagtagttattggatggacttgggtccgccagactccgagggaagggctggagtgggtggccaacataaagcaagatggaactgccgagttttacgnggactcgtgtgaagggtcctttcaccatctccagacacaacgccaagaacttcacttgtaatctaacaactgaacacgcctagagagtcgacaagaccgacgggtccgtttaggtaactttaccgtggtacgcggaagtagtaggttaaagggaaaaaacgttagtgggtactttagggtaggtttttacgtcggggggtacccaagggggtacgtcccccgttggggtaccccg

SEQ ID NO: 117910 - DNA, 587 bp, Homo sapiens
  misc_feature: GYAE6OF01DBHFK.17.16.B05.1.454.CMB.1.raw
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
tcagcgtagactagcacgaccggtgctcgatttagagctcacgtagttgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggacttccccttcagtagtttattggatgacttgggtccnccagactccgagggaagggctgggagtgggtggccaacataaagcaagatggaactgcgtagtttacgngactctgtgaggtccgttcacatctcagagacaacgccaagatcactgtaactctacaactgaacagcctagagatcaacagacgacggtcgtagtattacgtgtcggacgagtaagtacggtaggaaaaaagttggtagggtacgttggttacggttttaaggtgggggtacccgtaggggaccgtcccgtgggtccgtaccccgg

SEQ ID NO: 117911 - DNA, 838 bp, Homo sapiens
  misc_feature: GYAE6OF01DL7CU.17.16.B05.1.454.CMB.1.raw
  modified_base (807)..(807): a, c, t, g, unknown or other
  misc_feature (807)..(807): n is a, c, g, or t
tcagcgtagactagcacgaccggtgctcgatttagagctcacgtagttgggtttggggaggtctcagagaggaggcttagccctggactccaaggcctttccacttggtgatcagcactgagcacaggtaggactcaccatgggaggttgggctgaacgttgggttttccttgttgcttgtttagaggttctcagtgtgagtcagtttggtgacgggtccggggagtccgtggtccagtccggtcgggggccctgacacctcgtcctgtcgcgacgtccgtccgtactttcccctatacggttagttagtggatgtacggtcggtccgacgacgtacgcgggaggggtaacgggtcgtgggaggttgggtacgacccgaaagtaaacgtaacgaacgaaggtacgttcgggaaccgtcggtaccggttttaaggtttacccggtggtaaccgttggttggtaaccggtaaccgggtttcctttaaccgacccgttaacgtttccgaaccggaaaggcccgtaaaacgtcccgaaaaccgttaaagttaacgttccttaacggtacttaccgttaaaccgtaaaccctaacgtaaacgttaacccgacggttccgtaaacggtacggtaacccgtacggaacccggtaagggaacccggtacccgggttcgtttaaaggtttacctttacgggttcggaccgtagggttaaaccgtaggttacggggtaaaaaggtaaaaccggttgttacccggggttattggttttaacgggttagggttaccgggtaccccgggtaagggtcccncccgggggttttaagcccccggttacccggg

SEQ ID NO: 117912 - DNA, 574 bp, Homo sapiens
  misc_feature: GYAE6OF02IIF68.17.16.B05.1.454.CMB.1.raw
  modified_base (307)..(307): a, c, t, g, unknown or other
  misc_feature (307)..(307): n is a, c, g, or t
  modified_base (373)..(373): a, c, t, g, unknown or other
  misc_feature (373)..(373): n is a, c, g, or t
  modified_base (408)..(408): a, c, t, g, unknown or other
  misc_feature (408)..(408): n is a, c, g, or t
tcagcgtagactagcacgaccggtgctcgatttagagctcacgtagttgggggtttggggaggtctcagagaggaggcttagccctggactccaaggcctttccacttggtgatcagcactgagcaccagaggactcaccatggagttggggctgaactgggtttccttgttgctgttttagaaggtgtccagtgtgaggtccagttggttgagtccggggagcctggtccagcctgggggtccctgagactctcctgtgcagcctccggattcccccttcagtagttattggatgacttgggtccncagactccagggagggctggagtgggtgccaacataaagcaagatggaactgccgtagttttacgnggactctgtgaaggtccgtttcaccatctccaganacaacgccaaagattcactgtatctaacaactgaaacagcctagagagtcgcagacacggcgtagtacttactgtgcgagatggtaaggaaaaagtagtcggacttaggttagttttaagttcgggggacccaaggggtaccgtacccggttggtccctaccccgg

SEQ ID NO: 117913 - DNA, 685 bp, Homo sapiens
  misc_feature: GYAE6OF02HDWZX.17.16.B05.1.454.CMB.1.raw
  modified_base (265)..(265): a, c, t, g, unknown or other
  misc_feature (265)..(265): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
  modified_base (379)..(379): a, c, t, g, unknown or other
  misc_feature (379)..(379): n is a, c, g, or t
tcagcgtagactagcacgaccggtgctcgatttagagctcacgtatttggggtttgggggaggtctcagagaggaggcgttagccctggactccaaggcctttccacttggtgatcagcactgagcacagaggactcaccatggagttggggctgaactgggtttccttgttgctgtttagaggtgtccagtgtgaggtccagttggttgagtccgggggaggcctggtccagcctggggggtccctgagactctcctgtgcacncctccgattcccctnagtnttatggatgacttgggtcgccagactccgagggaaggcgtggagtgggtcggccaacaataaagcaaagntaggaactgaccgtagttttacggnggacgttctaggtgtaacggggtcctttaccaccactcctaccaagactaccgaacgccaaagaactcatgtactactaactaactagaaactcgtaccgtgaacggtacgtccgtacaacgaacccgttacggggtccccgttagtttaacgttaccttaagggtcggtaaccggaagtaagttacggtaagggttaaaaaaccggttaagaccggggttacttggttttaaggttttaggtaaccgggggggtacctaaggggggtaacccgttccccggtttagggtccccttaaaccccggg

SEQ ID NO: 117914 - DNA, 813 bp, Homo sapiens
  misc_feature: GYAE6OF02IRGCB.17.16.B05.1.454.CMB.1.raw
  modified_base (211)..(211): a, c, t, g, unknown or other
  misc_feature (211)..(211): n is a, c, g, or t
tcagcgtagactagcacgaccggtgctcgatttagagctcacgtatttggggtttgggggaggtctcagagaggaggcttagccctggactccaaggcctttccacttggtgatcagcactgagcacagaggactcaccatggaggttgggctgaacgttcggttttccttgttgcttgttttagaggtgtcagtgtgagtctgttggtgngggtcggggagtccgtggtccagtccggtcgggggtccctggacgtacttctccgtgtcgcaccgccctccggtacctttcccctagtaacgttagttagttggtacgtcgtacgttcgggtaccgtccacggtaccgtaccggaaggggtacgggcgtaggtagggtcgggtcggaacctaacgaaagttaaacgacgtaaaggacggttaggaacccgttgaccggtttaacgtttacggacggtcttaggttcgtaaggggtaaccgggttcctttacgacccgttagttccacgaacgacggtaaaccctaacgaacctaaaggtaacccttacggtacgttaacggtaaccttacgtaaaccgtaacgttaacgaaaaccgcgttaaccggttaaggtaacgaccggtaggaaccgtaagaaccggtaaccggttccgttaagttaaccgtttacgtcggtacgtaaagggttaacctacgggttaacgtaaaggggttaaaaaccgtagttaggggttaaccttacgggttttaagtttaacgggtcgggtaacccggtaaggggttacccgtaccggtttaccgggtacgtcccg

SEQ ID NO: 117915 - DNA, 754 bp, Homo sapiens
  misc_feature: GYAE6OF02JC3T9.17.16.B05.1.454.CMB.1.raw
  modified_base (313)..(313): a, c, t, g, unknown or other
  misc_feature (313)..(313): n is a, c, g, or t
  modified_base (476)..(476): a, c, t, g, unknown or other
  misc_feature (476)..(476): n is a, c, g, or t
tcagcgtagactagcacgaccggtgctcgatttagagctcacgtagttgggtttgggaggtctcagagaggaggcttagccctgactccaaggccttccacttggtgatcagcactgagcacagaggactccaccatggagttgggctgaacgttgggtttccttggtgcttgtttaagaacggtgtaccaggtgtgtaggtcctaggttggttcggacggtaccgggggagtcccgtggtccgacggtccggtcgggggtccctagacgtactcctcctgtcgcgcgcccgtccggtacctttccccgttanaggttagttacgttaggtattacggtaccggttcgggtaccccgaccgacgtacccgtaccgggacgggggaacgggtcgtagggaggttcgggtaccggaccctaaagaacgtaaacgacgaagtagtaacggaacctcggtaccgttaacggtttaccggngtaaccgtcggttaggtacggtaacggttcccgttcaaccgtctaccgtacgaagtacgaacgacccgtaccgtaaacgtactactacgtacgtactactaaacctacgtaagaaccgtacgaccgttagacgtacgtaccggagaacgccgtacgggtccttaggtttactagtagtccgaaggtagtagtacgtaaaggtaaacggtgtaccgtaggttaggtttacgttggtaccgggtacggttacgggaccgtccggttacgaccgttacccg

SEQ ID NO: 117916 - DNA, 154 bp, Homo sapiens
  misc_feature: GYAE6OF01DPDOG.1.45.E01.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtgagtcagtaagggaaagggaccaaggtggaaatcaaacgaactgtggctgcaccatctgtcttcatcttcccgccatctgaacgcactcgtctgagcgggctggcaaggcgcatagnn

SEQ ID NO: 117917 - DNA, 155 bp, Homo sapiens
  misc_feature: GYAE6OF01BDNE5.1.45.E01.1.454.CMB.1.raw
  modified_base (154)..(155): a, c, t, g, unknown or other
  misc_feature (154)..(155): n is a, c, g, or t
tcagacgagtgcgtcacgaccggtgctcgatttagtgagtcagtaagggaaagggaccaaggtggaaatcaaacgaactgtgctgcaccatctgtcttcatcttcccgccatctgaacgcactcgtctgaggcgggctgggcaaggcgcatagnn

SEQ ID NO: 117918 - DNA, 154 bp, Homo sapiens
  misc_feature: GYAE6OF02IVOVL.1.45.E01.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtgagtcagtaagggaaagggaccaaggtggaaatcaaacgaactgtggctgcaccatctgtcttcatcttcccaccctcctcacgcactcgtctgagcgggctggcaaggcgcatagnn

SEQ ID NO: 117919 - DNA, 276 bp, Homo sapiens
  misc_feature: GYAE6OF01CLUBV.10.27.C05.1.454.CMB.1.raw
  modified_base (275)..(276): a, c, t, g, unknown or other
  misc_feature (275)..(276): n is a, c, g, or t
tcagcatagtagtgcacgaccggtgctcgatttagacgcgatcgaagggtttgggggtgtggtggtctccactcccgccttgacgggctgctatctgccttccaggctgacgacgaggctgaatattactgcagctcatatgtagatggtgcctctttcaaggttttcggcggagggaccaggctgaccgtcctaagtcagcccaaggctgcccctggtcactctgttcccaccctcctccactactatgctgagcggctggcaaggcgcatagnn

SEQ ID NO: 117920 - DNA, 510 bp, Homo sapiens
  misc_feature: GYAE6OF01BK4KM.10.27.C05.1.454.CMB.1.raw
  modified_base (289)..(289): a, c, t, g, unknown or other
  misc_feature (289)..(289): n is a, c, g, or t
tcagcatagtagtgcacgaccggtgctcgatttagacgcgatcgaagggtttgggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaaagcccccanactcttgatttatgaagtcagtaagcggccctcaggggtttcagtcgcttctctgcctccaagtctggcaacacggcctccctgacaatctctgggctccaggctgacgacgagctgaatattactgcagctcatatgtagatggtgcctctttcaaggttttcggcggtagggaccaggctgaccgtcctaagtcagcccaaggctcgccccgtcggtcc

SEQ ID NO: 117921 - DNA, 487 bp, Homo sapiens
  misc_feature: GYAE6OF01ACN8Q.10.27.C05.1.454.CMB.1.raw
  modified_base (470)..(470): a, c, t, g, unknown or other
  misc_feature (470)..(470): n is a, c, g, or t
  modified_base (475)..(487): a, c, t, g, unknown or other
  misc_feature (475)..(487): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggccaggctgaccgtctaagtcagcccaaggctgccccctggtccactctcgttcccaccctcctccactactactcgctgacgcgggctggcaggcgnagtgnnnnnnnnnnnnn

SEQ ID NO: 117922 - DNA, 538 bp, Homo sapiens
  misc_feature: GYAE6OF01BKDST.10.27.C05.1.454.CMB.1.raw
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcagtcaccatctcctgcactggaaccagcagtgacttttgtgcttaataactatgtctcctggtaccagcaccaccaggcaaacgcccccaaactccttgttttgagtcagtaagcgcctnaggntccctgatcggttctctgcctcaagtctggcaacacggcttccctgaccatcgtcccgggctccgacgctgacggacgacggctctatttatactgcagctacataactaccacccgagggccacgtctcgtgactagtcggcggtaggccgtggccgtcgtaccgtccgtcgtccacgcccgtaacggcctaccgccccgtccggtctacccg

SEQ ID NO: 117923 - DNA, 506 bp, Homo sapiens
  misc_feature: GYAE6OF01A86IJ.10.27.C05.1.454.CMB.1.raw
  modified_base (397)..(397): a, c, t, g, unknown or other
  misc_feature (397)..(397): n is a, c, g, or t
  modified_base (500)..(500): a, c, t, g, unknown or other
  misc_feature (500)..(500): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggtgtttctagtcgcttctctgcctcaagtctggcaacacggcctccctgacaatctctggctccagctgagntgagctgattactactgcagcgcatacttcaggccccaagagggtgttggcggcggactaggtgaccgtcgtgggtcagcccaaggtctacgccccctggtcncgtccg

SEQ ID NO: 117924 - DNA, 517 bp, Homo sapiens
  misc_feature: GYAE6OF01EIC5C.10.27.C05.1.454.CMB.1.raw
  modified_base (304)..(304): a, c, t, g, unknown or other
  misc_feature (304)..(304): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (475)..(475): a, c, t, g, unknown or other
  misc_feature (475)..(475): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttangaagtcagtaagcggccctcaggggtttctagtcgcttctctgcctcaagtctggcaacacggcctccctgacaatctctgggctccagctgacgacgaggctgaatattactgcagctcatatgtagatggtntccttntttcgtaagggttttcggcggtacgggaccnggtcctgaccgtctaagtcacgcccaagctcgcccctggtcc

SEQ ID NO: 117925 - DNA, 562 bp, Homo sapiens
  misc_feature: GYAE6OF01DCG03.10.27.C05.1.454.CMB.1.raw
  modified_base (295)..(295): a, c, t, g, unknown or other
  misc_feature (295)..(295): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattatacttgtctctgtatcaacaacgccagacaaacgccccacactctgatttangaagtcagtaagcggccgcgtaggggtttctagtcgtcttcgtctgccctcaagtctggcaacaccggcctcctgaacaactctcgtggctccgaggctgacgacgaggctagtaatattactgcagtctacattatagtagagttggtcgtccttcgtttacgtaagggttttcgggacgggtacgggaccgtagggtctacggtacccgtccgtaacgtaccgacgtacccgaacggtccgtcccggtcccccgtcggttacccg

SEQ ID NO: 117926 - DNA, 566 bp, Homo sapiens
  misc_feature: GYAE6OF01EFB9O.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcgccctcgagggtttctagtcgcttctctgcctcaagtctggcaacacggcctcctgacaatctctggctccaggctgacgacgaggctagaatattactgcagctcatatgtagagtggtcgtccttctttacgtaagggttttcggacgggtacgggaccgaggtccgttacggacccggttccgtaaacggtccgaaccggtaccccgtaaacgggcccttaccggcccccccgttcgggttacccc

SEQ ID NO: 117927 - DNA, 280 bp, Homo sapiens
  misc_feature: GYAE6OF01AQP51.10.27.C05.1.454.CMB.1.raw
  modified_base (277)..(280): a, c, t, g, unknown or other
  misc_feature (277)..(280): n is a, c, g, or t
tcagcatagtagtgcacgaccggtgctcgatttagacgcgatcgaagggtttgggggtgtggtggtctccactcccgccttgacggggctgctatctgccttccaggctgacgacgaggctgaatattactgcagctcatatgtagatggtgcctctttcaaggttttcggcggagggaccaggctgaccgtcctaagtcagcccaaggctgcccctggtcactctcgttcccgccctcctccactactatctgagcgggctggcaaggcgcatagnnnn

SEQ ID NO: 117928 - DNA, 482 bp, Homo sapiens
  misc_feature: GYAE6OF01AXLTG.10.27.C05.1.454.CMB.1.raw
  modified_base (470)..(482): a, c, t, g, unknown or other
  misc_feature (470)..(482): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgaccatctctgggctccaggctgaggacgaggctgattattattgcagctcatatacaaacaccaaagctttgatattcggcggaggaccaaactgaccgtccttcgtcacgcccaaggctcgcccctggtcactctcgttcccgccctcctccactactatgctgagcgggctggcaggcgcatagnnnnnnnnnnnnn

SEQ ID NO: 117929 - DNA, 596 bp, Homo sapiens
  misc_feature: GYAE6OF01DKWKV.10.27.C05.1.454.CMB.1.raw
  modified_base (441)..(441): a, c, t, g, unknown or other
  misc_feature (441)..(441): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgccagacaaacgccccacactcttgtatttatgaatcaagtaagcgccctcgtaggggtttctagtcgcctttctctcgtccctcaacgtctcggacaacgaccggcccttccctagaacaattcctcgtcgggcttccgaggtctagacgacgaggctagaatattacngacacgctacattatgtagtgtaggtctcctttctttacgtaagggttttccggacgggtacgggacccgtagggtcctacgggaacccgttaccgtaacggtcccgaaccggtacccgaacgggtccctacccggtcccccgtcggttaccccg

SEQ ID NO: 117930 - DNA, 612 bp, Homo sapiens
  misc_feature: GYAE6OF01BGIJG.10.27.C05.1.454.CMB.1.raw
  modified_base (197)..(197): a, c, t, g, unknown or other
  misc_feature (197)..(197): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacngtcggtcaccatctcctgcactggacccagcactgatgttggcattatacttgtctctgtatcaacacgccagacaaacgccccacactcttgatttatgaagtacagtaagcgcctcgtagggtttctagtcgcttctctgcctccaagtctggacaacgacggcctcctgacatctacgtcggcttccgaggtctaggacgtaacggagtctagtaaattacttaacgtcgacgagtactcgtaatagttagtaggtaacgttgggtacgttcccttacgttttaaccggtaagggttttcgggaccggggtaacgggtaacccgtaacgggtccgttaggaaccccggtttcccgtaaaggtcccgaacggaccccgtaacgggtccctcccggtcccccgttcgggtaccc

SEQ ID NO: 117931 - DNA, 524 bp, Homo sapiens
  misc_feature: GYAE6OF01DS543.10.27.C05.1.454.CMB.1.raw
  modified_base (512)..(512): a, c, t, g, unknown or other
  misc_feature (512)..(512): n is a, c, g, or t
  modified_base (514)..(515): a, c, t, g, unknown or other
  misc_feature (514)..(515): n is a, c, g, or t
  modified_base (517)..(524): a, c, t, g, unknown or other
  misc_feature (517)..(524): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgattttatgaagtcagtaagcggccctcaggggtttctagtcgcttctctgcctccaagtctggcaacacggcctccctgacaatctctgggctccaggctgacgacgaggctgaatattactgcagctcatatgtagatgatgccttcttttacgtaaggttttcggcggtagggaccaggctggacccgtctaagtcacgcccgaaggcctccgcccccgttcggtcctaccttccttcgttcccgcccctccctccctacctactactcgctgacggcgggctcgggctaacggcgacgatagancnngnnnnnnnn

SEQ ID NO: 117932 - DNA, 562 bp, Homo sapiens
  misc_feature: GYAE6OF01ASCFO.10.27.C05.1.454.CMB.1.raw
  modified_base (404)..(404): a, c, t, g, unknown or other
  misc_feature (404)..(404): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacaccaggcaaagcccccaaatccttgttttgagtcagtaagccggccctcaggagtccctgattcggttctctgcctccaagtctggcaacacggcctccctgaccgtctcgtcgggcctccgaggctggaggntgaggtctgattactactgcagcgcatattccacggcccaagtgggttgttggcggtcgggagtacgggtcgtacccggtcgtcgggtacacggcccgaaggcctcggccccccgttggtcctaccgttccgtcgttcccccgtcccttcccgtaccc

SEQ ID NO: 117933 - DNA, 580 bp, Homo sapiens
  misc_feature: GYAE6OF01DBHU1.10.27.C05.1.454.CMB.1.raw
  modified_base (285)..(285): a, c, t, g, unknown or other
  misc_feature (285)..(285): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataccttgtctctgtatcaacacgccagacaaacgcccccanactcttgtatttatgaagtcaaggtaacgcgccctcgacgggtttctagtcgcttctctcgcctcaagtctcggacaacaccgcctcctgacatctcgtcggcctcgagctagacgacgaggcctagaattattactgcagtctacatatgtagtagtggtctccttcgtttacgttaacgggttttcgggacgggtacgggacctacgggtccttacggtacccgttaccgttaaacgtccgaaccgtaccccgaaacggtcccgttcccgtccccccgttacggttaaccccg

SEQ ID NO: 117934 - DNA, 603 bp, Homo sapiens
  misc_feature: GYAE6OF01EC6Y9.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctgtatcaacaacgccagacaaacgcccccacactcttgatttatgaagtcagtaacgcgccctgaggggtttctagtcgcttctctcgcctcaagtctggcaacacgcctcctgacaatctctgggctccgaggctgacgacgaggctagaattattactgcagctacatatgtacgtagttcggtcgtcctttcgtttacgtaagggttttcgggaccgggtacgggtacccgtagggtccgttacggtaacccggttcccgttaaacggttcccgaaccgggtacccccggtaaacgggtcccccggttacccggtccccccccggttccgggttacccccg

SEQ ID NO: 117935 - DNA, 580 bp, Homo sapiens
  misc_feature: GYAE6OF01B6NDA.10.27.C05.1.454.CMB.1.raw
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (371)..(371): a, c, t, g, unknown or other
  misc_feature (371)..(371): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctcctggtatcaacaacgccagacaaacgcccccacactcttgatttatgaagtcagtaagcggccctnaggtntttctagtcgtcttctctgcctcagtctgcaacacgcctccngacatctctggctcgagctgacgacgagctagaatattactgcagtctacatagttgtagtagttggtcgtccttactttcgtaaacgggttttcgggaccgggtaagggtacccgtaacgggtccgttacggtaaccccgttaccgtaaacggttacccgaacggtaccccgaaagggtcccgtccgggtcccccccgtttaccgggg

SEQ ID NO: 117936 - DNA, 671 bp, Homo sapiens
  misc_feature: GYAE6OF01C001G.10.27.C05.1.454.CMB.1.raw
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctctcactcaggacacagggtcctgggccctgtctgccctgactcagcctgcctcgtgtctgggtctcctggacagtcggtcaccatctcctgcacgtcgaccngcactgattggtggactattaactacttgtctcgtagtacacaacaccacanaacaccgccccanacttcgtagtactttagagtaactacgaagtaacggccgtcctacgtaggttcgtttactaggtctctttctcgtcgtccctacgtaacgttcgtacggaaccaccgtacgtccccttccgtacgaactacttcctacggtcggtaccttaccgacggtaccgtacggaacgtaacggacggtactaacgtaaactttaacgttaacgtcggtaactacgtacgtacgtaaattacgttaaggtaacgtaggttcgggttcgttacctttacgttacggttaacgggtttcgggacgggtacgggaccgtacggtcgttaccggtaccgttaacgtacgtacgtaccggaaccgtacggtccgtcccgtcccggttaccgg

SEQ ID NO: 117937 - DNA, 591 bp, Homo sapiens
  misc_feature: GYAE6OF01DQIXU.10.27.C05.1.454.CMB.1.raw
  modified_base (303)..(303): a, c, t, g, unknown or other
  misc_feature (303)..(303): n is a, c, g, or t
  modified_base (466)..(466): a, c, t, g, unknown or other
  misc_feature (466)..(466): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccagcactgatgttgggctattataaccttgtctcctgtatcaacacgccagacaaacgccccacactcttgtactttanagaagtcagtaacgccggtccctcgtagggttctagtcgtcttctctcgtccctacgtaagtctaggaccaacgaccgtccctccgtagacctaacgttcctcgtcggccttccgacggtctagaaccgacggaggtctagaattattactgacagctcaatntagtagagttgtcgtccttcgtttacgtaacgggttttccgggacgggtacgggtaccgtaggtccgtacggacccgttccgtaacgtccgacgtacccgaggccctccgtccccgtcgtacccg

SEQ ID NO: 117938 - DNA, 281 bp, Homo sapiens
  misc_feature: GYAE6OF01BQJKV.10.27.C05.1.454.CMB.1.raw
  modified_base (278)..(281): a, c, t, g, unknown or other
  misc_feature (278)..(281): n is a, c, g, or t
tcagcatagtagtgcacgaccggtgctcgatttagacgcgatcgaagggtttgggggtgtggtggtctccactcccgccttgacggggctgctatctgccttccaggctgacgacgaggctgaatattactgcagctcatatgtagatggtgcctctttcaaggttttcggcggagggaccaggctgaccgtcctaagtcagcccaaggctgccccctcggtcactctgttcccaccctcctccactactatgctgagcggctggcaaggcgcatagnnnn

SEQ ID NO: 117939 - DNA, 527 bp, Homo sapiens
  misc_feature: GYAE6OF01CSOMR.10.27.C05.1.454.CMB.1.raw
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (443)..(443): a, c, t, g, unknown or other
  misc_feature (443)..(443): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacaacgcccagaacaaacgcccccacactcttgatttatgaagtcaagtaacgcgtccctcgtagggttctagtcgcttctctgccctcaagtctgcaacncgcctccngacatctctggctccgagctgacgacgaggctagaattacttactgcagctacattatgtagagtggtntccttcttcgtaaggtttcggcggacgggaccaggtctacgaccgtcctaagtcacgtcccaaggcctccgccccgtggtaccc

SEQ ID NO: 117940 - DNA, 660 bp, Homo sapiens
  misc_feature: GYAE6OF01C3X3Q.10.27.C05.1.454.CMB.1.raw
  modified_base (338)..(338): a, c, t, g, unknown or other
  misc_feature (338)..(338): n is a, c, g, or t
  modified_base (443)..(443): a, c, t, g, unknown or other
  misc_feature (443)..(443): n is a, c, g, or t
tcagcatagtagtgcacgaccggtgctcgatttagacgcgatcgaagggtttggggggggttcggacaagagggcagcgctctcgggacgtcgtccaccatggcctgggctcgtgctgctcctcaccctcctcactcaggacacagggtcctgggccctgtctgccctgactcagcctcgccctccgtgtcctgggtctccgtggacagtcgatcactactcctcctgccacgtggccaccgagtctagttgactataggtcgtacttataactatcgtctcctacgaaccaacaccacccgacgccctacgtcccctagtactctatcgtagttccnggtatcggtactagtgtacgttccggtccgtttggtactttcgtaacgtcgtcttcgtacgtcggcctaccgtacgtcgtacgccaaccgtccggtccctaccgngtacctagtccgtaggtcggtctacggaggtacgtaggacggtacggagtctagtaactttacgcgtacgaccgtacgtagttaccgtaagttaccgtacgaaccgtaggaccgtagtcccgttacgttcgtacggtacggttaccggggaccggaaccggtaccctaccggtccgtaccggtaccccgttaccggtaccgtccgtcccgtaacccg

SEQ ID NO: 117941 - DNA, 554 bp, Homo sapiens
  misc_feature: GYAE6OF01EIH02.10.27.C05.1.454.CMB.1.raw
  modified_base (432)..(432): a, c, t, g, unknown or other
  misc_feature (432)..(432): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgcccccacactcttgatttatgaagtcagtaagcggccctcgaggggtttctagtcgcttctctgcctccaagtctggcaacaccggcctccctgacaatctcgtgggctccgaggctgacgacgagctagaatattactgcagccgnatattccgacggacccctaagtaggggttcgtttgggccggacgggactaagggtcgaccgtccgtgggtcacggcccgaaggcctccgtccccctcggtaccaccttccgtccgttccccc

SEQ ID NO: 117942 - DNA, 596 bp, Homo sapiens
  misc_feature: GYAE6OF01DOTA3.10.27.C05.1.454.CMB.1.raw
  modified_base (368)..(368): a, c, t, g, unknown or other
  misc_feature (368)..(368): n is a, c, g, or t
  modified_base (453)..(453): a, c, t, g, unknown or other
  misc_feature (453)..(453): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccacactcttgatttatgaagtcagtaagcggccctctacggggtttctagtcgcttctctcgcctccaagtctggcaacnccggcctccctgacaatctcgtcggcctccgaggctggacgaacggaggtcctagaattacttactcgacagctacatatgtagntggtcgtccttactttcgtaagggttttccgggacgggtacggggtaccgagggtaccttacgggtaacccgttcccgttaaacgtccgaaccggaccccgtaaacgggccccttaccggtcccccccgttcggttaaccccg

SEQ ID NO: 117943 - DNA, 566 bp, Homo sapiens
  misc_feature: GYAE6OF01DJB4U.10.27.C05.1.454.CMB.1.raw
  modified_base (301)..(301): a, c, t, g, unknown or other
  misc_feature (301)..(301): n is a, c, g, or t
  modified_base (379)..(379): a, c, t, g, unknown or other
  misc_feature (379)..(379): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctctggacagtcggtcaccatctcctgcactggacccagcactgatgttgggctattataaccttgtctcctgtatcaacaccgccagacaacgccccacactctgtatttangaagtcagtaacgccgcctcgtagggtttctagtcgtcttctctcgcctcaacgtctcggacaacgccgcctcccgtnacatctctggctccgagctagacgacgagtctagaattactacgtcgactagctactatagtgtagtagttgtcgtccttcgtttacgtaacggtttcggacggtacggaccgtagggtcctacggtacccgttaccgtaacgtccgaacgtacccgtaacggtcctcccgtccccgtcggtacccg

SEQ ID NO: 117944 - DNA, 638 bp, Homo sapiens
  misc_feature: GYAE6OF01EM7YC.10.27.C05.1.454.CMB.1.raw
  modified_base (476)..(476): a, c, t, g, unknown or other
  misc_feature (476)..(476): n is a, c, g, or t
tcagcatagtagtgcacgaccggtgctcgatttagacgcgatcgaagggtttggggggggtccaacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctccgtggtactcaacacgcccaagaccaaacgcccccacactcttgtatttatagaagtcagtaagccgacctcggtagggtttctagtcgtcttctctcgtcctaccaagtccgtggccaacgtacccggtcccttaccctagaacctaacgtcctcgtcgggcctccgaggtctacggacgacgaggtactagtaattattacgtgaccagtcctntacttagtagtagtagttggtccgtccttcgtttacggtaacgggtttcgggacgggtacgggaccgtagggtcccttacgggtacccgttaccgttaacggtcccgaacccggtacccggtaacgggtccctaccccggtccccccgttccggttaccccg

SEQ ID NO: 117945 - DNA, 539 bp, Homo sapiens
  misc_feature: GYAE6OF01BGVEQ.10.27.C05.1.454.CMB.1.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (425)..(425): a, c, t, g, unknown or other
  misc_feature (425)..(425): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacaacgccagacaaacgccccanactcttgatttangaagtcagtaagcgcctcgtagggttcagtcgcttctctgcctcaagtctggacaacgacgcctcctagacactctcgtcggctcgaggctgacgacgagctagaactatactgacagtctacatntagtagtagtggttactccttcgttacgtaaggtttcggacggtacggtaccgtaggtcctcggtacccgtccgtaagtcacggacccaaggtcctccgtccccgttggtaccc

SEQ ID NO: 117946 - DNA, 577 bp, Homo sapiens
  misc_feature: GYAE6OF01DG5WR.10.27.C05.1.454.CMB.1.raw
  modified_base (299)..(299): a, c, t, g, unknown or other
  misc_feature (299)..(299): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcatggacagtcggtcaccatctcctgcactggacccagcactgatgttggcattataccttgtctctgtatcaacaacgccagacaaacgccccacactcttgatttangaagtcagtaagcgccctcgtaggggtttctagtcgtcttctctgcctcaagtctggacacgacggcctcctgactaactctcgtcggctcgaggctcgacgacgagctagtaatatactgcagctactatagttagtagtattggtcgtcctttcgtttacgttaaacgggtttttcgggacgggtacggggaccgtaacggtcgtacggtacccggttacccgttaaggtacgtaccggaacccgaaggtcccgtccggtccccccgttacccggg

SEQ ID NO: 117947 - DNA, 538 bp, Homo sapiens
  misc_feature: GYAE6OF01C2SUX.10.27.C05.1.454.CMB.1.raw
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacacgccanacaacgcccccacactcttgatttanagaagtcagtaacgccggccctgtacgggtttctagtcgcttctctcgcctccagtctggcaacnccgcctcctgacatctcgtcggctccgagctgaccgacgaggctagaattattactgcagctctatagtgtagagtggtctccttcgttacgtaacgggtttcggacgggtacggaccgaggtcctacggtaccgtcctaagtccacgtacccgagcctccgccccgtcggtcc

SEQ ID NO: 117948 - DNA, 733 bp, Homo sapiens
  misc_feature: GYAE6OF01B9YEF.10.27.C05.1.454.CMB.1.raw
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggctattatactgtctctgtatcaacacgccagacaacgccccacactctgtattatgaagtcagtaacgcgtccctcgtagggtttctagtcgtcttctctcgcctaccgtaacgtctcggaccaaccgaccggtcccttccccgtagaacctaacgttccgttccggtcgggtacccttaccggaacgggtccgttacggaaccggtacggaacgggtaccttaagtaaactttaacgtttaccgtagtacccgacggtaccttaccgtaattagttacggtaaggtagtttacgggttaccgttccccgttttaccggttttacgggttaaaccggggtttttccggggaaccggggttaaccggggaacccggtaacggggttcccgttaaccgggttaccccggttaacccgttaaacggttccccggaaccggtaccccggttaaacggtccccgttaccccgggtcccccgttaccgggttacccccg

SEQ ID NO: 117949 - DNA, 708 bp, Homo sapiens
  misc_feature: GYAE6OF01B40OX.10.27.C05.1.454.CMB.1.raw
tcagcatagtagtgcacgaccggtgctcgatttagacgcgatcgaagggtttgggggggtcacaagaggcagcgctctcgggacgtctccaccatggcctgggctctgctgctcctcaccctctcactcaggacacagggtcctgggccctgtctgccctgactcagcctgcctcgtgtctgggtctccgtggacaggtcggtcaccatcctcctgcacgtggaaccagcagtgtactttgtgcttaataactatgtctctggtaccagccaccaccaggcaaacgcccctaaacttccgtttgttttagagtcagtaacgccggcctgaacggtcgtccctgtacgttcggttctcgtcgtccctacaacgtctcggaccaaaccgcggtccctacccgtgacccgttctcgtcgggacctccggaggtctggacggtagtcggacggtctaggtaactttaccgtacgtagccgaacggtccgtactaagttaaccgttccgaacccgggacccctaaacgggttaggggttcggtttcggggaccgggtacggggtaacttaaccgggtcggtaacccgttccggggtacgggtaccgaccgggtaccccgtaagggtccccttaccccggggtaccccccgttcgggttaccctacccgggttttccctaccccggtttacccccccgaacccccgtttccccg

SEQ ID NO: 117950 - DNA, 672 bp, Homo sapiens
  misc_feature: GYAE6OF01DKTMX.10.27.C05.1.454.CMB.1.raw
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctggtctcctggacagtcgtcacatctcctgcactcggacccagccactgagtggtggctattactaaccttgtctcgtgtatacaacacgccagacaaacgccccanactctgtattatgagtntagtaacgcgtccctgtacggttctagtcgcttactctcgtcctacgagtctcggacaacgtaccgtccctccgtacgaacctaacttccgtcgtcgggtacctaccgagggtccttacggaaccggaacggtaacggtcctaagtaacttacgttaccgtgacctacgtctaccgtattaagtacgtaagtacgtttcggtacgttaccgtttacgtttacgggttaacgggttttccggaccggggtaaccggtaccggtaccggtccggttaacggtacccccggttaacgttacggtaaccgtaccccggtaacccggtacggtaccccgttaccccggtcccccgttcggttaacccccg

SEQ ID NO: 117951 - DNA, 598 bp, Homo sapiens
  misc_feature: GYAE6OF01BT50M.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgggtctgggtctcctggacagtcggtcaccatctcctgcactggacccagcactgatgtggcattataaccttgtctcctggtatcaacaacgcccagacaaacgcccccacactcttgatttatgaagtcagtaagcgccctcgtagggtttctagtcgcttctctcgtcctccaagtctggccaacacggccctccctgacctaatctcgtcggtcctccaggctgacgacgaggcctaggaacttattacctgacagctacaatctagtagagttggtcgtccttcgtttaccgtaagggttttccgggacgggtaacgggaacccgtagggtccgttacggaccccggttaccgttaacgtacccgacggtaccccgaaagggtccctacccggtccccccgtcggttaccccg

SEQ ID NO: 117952 - DNA, 596 bp, Homo sapiens
  misc_feature: GYAE6OF01BHAE6.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaacgccccccacactcttgatttatgaagtcagtaagcggccctcaggggtttctagtcgcttctctgcctccaagtctggcaacacggcctcctgacaatctctgggctccaggctgacgacgaggctgaattattactgcagctacatatgtagagttggtctcccttctttacgtaagggtttttccggacgggtacgggtacccgtagggtccgttaggtaccccggttccgtaaacggttcccgaaccgggtacccccggtaaacggggtaccccgttcccgggtccccccccgttcggggttacccccg

SEQ ID NO: 117953 - DNA, 603 bp, Homo sapiens
  misc_feature: GYAE6OF01AJK0J.10.27.C05.1.454.CMB.1.raw
  modified_base (293)..(293): a, c, t, g, unknown or other
  misc_feature (293)..(293): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctggtatcaacacgccagacaacgccccacactcttnattatgaatcagtagcgccctgtagggtttctagtcgtcttctctcgcctcaagtctggcaacgaccggtcctccctgactaatctcgtcggctccgacggctacgacgacggaggactagtaattacttacgtcgacagtctactaattacgtagtagtagttcggtcttccgttaccgttttacggtaacgggtttttccgggacgggtaacgggtaaccgtacgggtccgttacggtacccggttaccgttaacgtccgaaccggtacccgtaacggtcccgtcccgtcccccgtccggttaccccg

SEQ ID NO: 117954 - DNA, 512 bp, Homo sapiens
  misc_feature: GYAE6OF01B1EII.10.27.C05.1.454.CMB.1.raw
  modified_base (324)..(324): a, c, t, g, unknown or other
  misc_feature (324)..(324): n is a, c, g, or t
  modified_base (365)..(365): a, c, t, g, unknown or other
  misc_feature (365)..(365): n is a, c, g, or t
  modified_base (436)..(436): a, c, t, g, unknown or other
  misc_feature (436)..(436): n is a, c, g, or t
  modified_base (469)..(469): a, c, t, g, unknown or other
  misc_feature (469)..(469): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctnaggttgtttctagtcgcttctctgcctcaagtctggcaacncgcctcctgacaatctctggctccagctgacgacgagctgaatattactgcagctcatatgtagtatggtntcctctttacgaaggttttcggcggacgggacnggtctgaccgtactagtcgacgacccaagcctcgccccgtcgg

SEQ ID NO: 117955 - DNA, 504 bp, Homo sapiens
  misc_feature: GYAE6OF01EZ7HG.10.27.C05.1.454.CMB.1.raw
  modified_base (491)..(494): a, c, t, g, unknown or other
  misc_feature (491)..(494): n is a, c, g, or t
  modified_base (496)..(504): a, c, t, g, unknown or other
  misc_feature (496)..(504): n is a, c, g, or t
tcagcatagtagtgcacgaccggtgctcgatttagacgcgatcgaagggtcctgggccctgtctgcccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcgtaggggtttctagtcgcttctctgcctccaagtctggcaacacggcctccctgacatctctggctccaggctgacgacgaggctgaatattactgcagctcatatgtagatggtgccttctttcgtaaggttttcggcgggagggaccagggctcgaccgtctaagtcacgccgaagctcgccccctcgtccactctcgttcccaccctcctccactactatcgtctgacgcgggcgtcggcgacggccgcgagtagnnnngnnnnnnnnn

SEQ ID NO: 117956 - DNA, 621 bp, Homo sapiens
  misc_feature: GYAE6OF01CJMY4.10.27.C05.1.454.CMB.1.raw
  modified_base (302)..(302): a, c, t, g, unknown or other
  misc_feature (302)..(302): n is a, c, g, or t
  modified_base (449)..(449): a, c, t, g, unknown or other
  misc_feature (449)..(449): n is a, c, g, or t
tcagcatagtagtgcacgaccggtgctcgatttagacgcgatcgaagggtttggggggggtcacaagaggcagcgctctcgggacgtctccaccatggcctggctctgctgctcctcaccctcctcactcaggacacagggtcctgggccctgtctgccctgactcagcctgcctccgtgtctgggtctcctggacagtcggtcaccatctcctgcactggacccagcactgatgttggctattataaccttgtctcctgtatcaacacgccagacaaacgcccccacactcttgtatttangaagtcagtaacgccgccctcgtaggggtttctagtcgtcttctctcgtccctacaagtctggaccaaccgaccggccctccctagaaccaacttctcgtcgggccttccgaggcctagaccgacggagtctagaaacttattaccngacagctactaattagtgtaagtagttcgggtacgttccctttcgttttacggtaacggggttttccgggacgggtacgggacccgagggtccgtacggtaccccggttaccgtaacggtaccaccggtacccgtaagggtccctccccgggtccccccgttcgggtacccc

SEQ ID NO: 117957 - DNA, 580 bp, Homo sapiens
  misc_feature: GYAE6OF01BKAR8.10.27.C05.1.454.CMB.1.raw
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataccttgtctctgtatcaacaacgccagacaacgcccccanactcttgatttatgaagtcagtaagcggcctctagttntttctagtcgtcttctctcgcctcaagtctggcaacaccggcctccctgacaacttcctcgtcggcctccgaggtctaggacgacgaggcctagaattactactgctagcttacatactgtagtagttcggtctccttacgtttacggtaagggttttccgggcggtaacgggtacccgagggttcctacggtacccgtaccgttaacggtccgaaccgtcccggaaaggtcccttcccggtcccccgttacccgg

SEQ ID NO: 117958 - DNA, 591 bp, Homo sapiens
  misc_feature: GYAE6OF01AXOSB.10.27.C05.1.454.CMB.1.raw
  modified_base (212)..(212): a, c, t, g, unknown or other
  misc_feature (212)..(212): n is a, c, g, or t
  modified_base (577)..(577): a, c, t, g, unknown or other
  misc_feature (577)..(577): n is a, c, g, or t
  modified_base (581)..(583): a, c, t, g, unknown or other
  misc_feature (581)..(583): n is a, c, g, or t
  modified_base (585)..(591): a, c, t, g, unknown or other
  misc_feature (585)..(591): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagccccccacactcttgatttangaagtcagtaagcggccctcgaggggtttctagtcgcttctctgcctccaagtctggcaacacggcctccctgacaatctctgggctccaggctgacgacgaggctagaatattactgcagctcatagtgtagatggtcgccttctttacgtaagggttttccggacgggtacgggaccgacgggtctcggtacccgttaccgtaacgtccacggacccgaagggtccctccggtccccccgtcggttcctaccgttccctcccggtttcccccaccccgttcccttaccctaaccttaccttacgtcgtaccgttacggacggtcccggggactcgggacgaaccgggtcgaccgtaagtcgangtcnnncnnnnnnn

SEQ ID NO: 117959 - DNA, 562 bp, Homo sapiens
  misc_feature: GYAE6OF01B8NKG.10.27.C05.1.454.CMB.1.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctcgtgtctgggtctcctggacagtcggtcaccatctcctgcactggacccagcactgatgtggcattataaccttgtctcctgtatcaacacgcccagacaaacgccccanactcttgatttangaagtcagtaacgcggccctgtagggtttctagtcgctttctctgcctacaagtctggcaacacgcctccngacatctctcgggctcaggctagacgtacgagtctagaatatactgcagctanattaactacaaccngaccagtcctactttctacgtattccggggacggtaacgggaccaaacggtctacggtaccccgttccgtaaacgggtcctaaaccggcccctaaagggcccttaccggtccccccgttaccggg

SEQ ID NO: 117960 - DNA, 592 bp, Homo sapiens
  misc_feature: GYAE6OF01DPU25.10.27.C05.1.454.CMB.1.raw
  modified_base (365)..(365): a, c, t, g, unknown or other
  misc_feature (365)..(365): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctgtatcaacaacgccagacaaacgcccccacactctgatttatgaagtcagtaagcggccctcgtaggggttctaggtcgtcttctctgcctccaagtctgcaacncggccctcctgacaatctcgtggctccaggctgacgacgaggctagaattattacgtgcagctcatatgtagtagttgtacgtcccttcttttccgtaagggtttttccgggacgggtacggggtacccgtacgggtcgttaccggtacccggttacccgttaaaggttcccgaaccggtaccccgtaaacggcccgttcccggtccccccgttccgggttaccccg

SEQ ID NO: 117961 - DNA, 581 bp, Homo sapiens
  misc_feature: GYAE6OF01BD4VA.10.27.C05.1.454.CMB.1.raw
  modified_base (303)..(303): a, c, t, g, unknown or other
  misc_feature (303)..(303): n is a, c, g, or t
  modified_base (417)..(417): a, c, t, g, unknown or other
  misc_feature (417)..(417): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacacgcccagacaaacgcccccacactcttgatttangaagtcagtaagcggccctcgtaggggtttctagtcgcttctctgcctcaagtctggcaacacggcctcctgacatctctggctccagtctgacgacgaggctagaatattacngcagctacatagtgtagatggtcgtcccttctttacgtaagggttttccggacggggtaacgggacccagggtcccttagggtaaccccggttccgtaaaacggtccaaacgggtcccccgaaagggtccccttcccgggccccccccgttccggggttacccc

SEQ ID NO: 117962 - DNA, 571 bp, Homo sapiens
  misc_feature: GYAE6OF01C4V5Q.10.27.C05.1.454.CMB.1.raw
  modified_base (442)..(442): a, c, t, g, unknown or other
  misc_feature (442)..(442): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattataaccttgtctcctggtatcaacaacgccagacaaacgcccccacactcttgatttatgaagtcaagtaacggccggtccctcgaggggtttctagtcgtcttctctcgccctccaagtctcggcaacgacggtccctcccgtgacaactctcgtcgggcctccgaggctcgacgacgaggctagaatattactgcanctcatatgtagagtggtctccttctttacgtacggttttcgggacggtacgggaccgaggtccgtcggtacccgttccgtaacgtccacggtacccgaaacggtccgtcccgtcccccgttcggtaccc

SEQ ID NO: 117963 - DNA, 597 bp, Homo sapiens
  misc_feature: GYAE6OF01ASUBE.10.27.C05.1.454.CMB.1.raw
  modified_base (449)..(449): a, c, t, g, unknown or other
  misc_feature (449)..(449): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatcctcctgcacgtcggacccagcactgatggttggctattataccttgtctctgtatcaacacgccagaccaaacgcccccacactcttgtattatgaagtacagtaacgccggtccgtcgtagggtttctacgtctcttctctcgcctacacgtcgtgacaacgaccgccctcctgaacctactccgtcgtcggcctccgacggtctacggacgacggacgtactagtaattactacgngacgactcacttatagttagtagtagttcgtcttccgtttacgtttaccggtagggtttcgggacggtacggtaccggaggtccgtacgtacccgtaccgtaacgtacgaccgtacccgacggtcccgtcccgtccccgtcgtacccg

SEQ ID NO: 117964 - DNA, 654 bp, Homo sapiens
  misc_feature: GYAE6OF01CNS2F.10.27.C05.1.454.CMB.1.raw
  modified_base (298)..(298): a, c, t, g, unknown or other
  misc_feature (298)..(298): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcacgtcggaccagcactgatgtggctattataccttgtctctgtatcaacacgccagacaacgccccacactctagtattangtaagtcagtacgcgtccctgtacgggtttctagtcgtcttctcgtcgtcctacgaagtcgtcggacaaccgtaccggtcccttacccgtagaaacctactcctcgtcgggtcctaccggaggtcgtaggaaccgacggaacggtactaacgtaaattacgttaacgtcgactacggtctaactaagttagtacggttagtaagttcgggttaccgttccgttttaaccgtttacggttaacgggttttaccgggacgggtaaacgggtaccgacgggtaccgttacggtaaccccgttaccgtaacgtacccggacgacccgtacgggacccttcccggtccccgtacggtcccg

SEQ ID NO: 117965 - DNA, 627 bp, Homo sapiens
  misc_feature: GYAE6OF01BV9IH.10.27.C05.1.454.CMB.1.raw
  modified_base (295)..(295): a, c, t, g, unknown or other
  misc_feature (295)..(295): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggctattataacttgtctctgtatcaacaacgccaagacaaacgcccccacactcttnactttatgaagtacagtaagccggtccctcgtacgggttctagtcgtcgttctcgtcgtaccctctaacgtcgtacggaccaacgtacccggtcccttacccgtacgaacctaacttccgtacgtcgggccttaccgaacgggtctacggaacgtacggacggtaccttaagtaaacttacgttactcgactacgtctacaattacgtagttagagtggtctaccttcgttacgtaacgggtttcgggacggtaacggaccgtggccttaggacccgttacgtacgtaccgacggaccccgtaaggtccctaccggtcccccgttggtaccc

SEQ ID NO: 117966 - DNA, 564 bp, Homo sapiens
  misc_feature: GYAE6OF01E24KF.10.27.C05.1.454.CMB.1.raw
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
  modified_base (440)..(440): a, c, t, g, unknown or other
  misc_feature (440)..(440): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttnatttatgaagtcagtaagccggccctcgtaggggtttctagtcgcttctctgcctcagtctggcaacncgcctcctgacatctctggctccagctgacgacgagctagaatacttactgcagctcatagtgtagagttggtntcccttctttacgtaagggttttccgggcgggtaacgggaccctagggtcttacggaaccccggttccttaacggtccaaccggaccccgaagggcccttccggcccccccgttcgggtacccc

SEQ ID NO: 117967 - DNA, 647 bp, Homo sapiens
  misc_feature: GYAE6OF01AUV3W.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattatacttgtctctgtatcaacaacgccagacaaacgcccccacactcttgtatttatgaagtcagtaacgccggccctcgtagggtttctagtcgcttctctcgcctccaagtctggcaacgacggcctcctagactaactcctcgtcgggcctccgaggtcctaggaaccggacggacggtcctagtaaacttacttaccgtagcctagtccttacaattagtagtagtagttggtcgttaccctttacgtttaccgttaaggggttttccgggacgggtaaacgggacccgtagggtcccgttacgggtaaccccggttcccgttaaaacggttcccgaaaccgggtacccccgtaaacggggtccccttaccccgggtcccccccggttcgggtaaccccg

SEQ ID NO: 117968 - DNA, 657 bp, Homo sapiens
  misc_feature: GYAE6OF01DYXAF.10.27.C05.1.454.CMB.1.raw
  modified_base (291)..(291): a, c, t, g, unknown or other
  misc_feature (291)..(291): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgccagacaaacgcccccanactcttgatttatgaagtcagtaagccggccctcgtaggggtttctagtcgcttctctcgtcctccaagtcctagggacctaaccgaccgggtccctccccgtacgaaccaaacttcctcgtacgggtcctccgaggccgtcgaaccggaacggacggctagtaaattattactgacagtctctaataagtggtagagttggtcgtccctttacgtttacgttaacggggttttccgggacgggtaacgggacccggtagggtaccgttacgggttaaccccggttacccgttaaaacggttcccaaacgggtcccccgaaaagggtccccgttaacccgggtcccccccgttcgggttaaccccg

SEQ ID NO: 117969 - DNA, 574 bp, Homo sapiens
  misc_feature: GYAE6OF01DN72V.10.27.C05.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (333)..(333): a, c, t, g, unknown or other
  misc_feature (333)..(333): n is a, c, g, or t
  modified_base (562)..(574): a, c, t, g, unknown or other
  misc_feature (562)..(574): n is a, c, g, or t
tcagcatagtagtgcacgaccggtgctcgatttagacgcgatcgaagggtcctgggccctgtctgccctgactcagcctgcctccgtgtctgggtctcctggacagtcggtcacccatctcctgcactggacccagcactgatgttggcattataccttgtctctgtatcaacaacgccagacaaacgcccccanactcttgatttanagaagtcaagtacgcgtccctgtaggggtttcagtcgtcttctctgcctccaagtctggcaacacggcctccctgacaatctcgtggctcgaggctgacgacgaggctagaatatactgcagctnatatgtagatggtctccttcgtttacggtaagggttttcgggacgggtaacgggaccacggtcgttacggacccgttacgtacgtacgacgtaacccgacggtccgtaccccgtcccccgttcggtccctaccgttccctttcccggttcccccgtccccttcctaccctaaccttaccgtacgtcggcgttcggcggccgggcgtacggaccgtaggccgactagtgnnnnnnnnnnnnn

SEQ ID NO: 117970 - DNA, 628 bp, Homo sapiens
  misc_feature: GYAE6OF01BHK5J.10.27.C05.1.454.CMB.1.raw
  modified_base (487)..(487): a, c, t, g, unknown or other
  misc_feature (487)..(487): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattatacttgtctctgtatcaacaacgcccagaccaaacgcccccacactcttgtattatagaagtcagtaacgcggcctcgaggttgtttctagtcgtcttctctcgtcctacgtaacgtcgtagacctaacgaccggtcccttaccctacgtactaactcctcgtacgggtcctaccgacggtcctacggaccggtaacggacggtcgtaagtaaattaacgttactacgactacggtccctanacttagttcgtaagtacgttgtcgttacccgttctttaccggtaagggttttccggacgggtaacgggaccgtacggtcctcggtacccgttacctaacggtaccgtacggacccgaggccgttcccgcccccggttacgg

SEQ ID NO: 117971 - DNA, 753 bp, Homo sapiens
  misc_feature: GYAE6OF01CIBTM.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctggtatcaacaacgcccagacaaacgcccccacactcttgatttatgaagtcaagtaacgcggccctcgtaggggtttctacgttcgtcttcttcgtcggtctacccgtaagtcgtacggacctaaaccgaccggtccctaccccgtaggtaacctaactcctcgtacgggccttcccgagggtcctacggaacggtacggacgggtaccgttaggtaaactttaacgtttaaccgtgggtaccaacggtacctacgtaaacgtttaacgttaaggttaacggtaagtttacgggttaccggtttaccccgtttacgttttttacccggtaaacgggggtttttttccgggaccgggggtaaacgggggtaaccccggtaagggtcccgttaacgggtacccccggttaacccggtaaacgttacccggtaacccggtaaccccgtaaacgggttccccgtccccggtaacccccccgtttccgggttaaccccg

SEQ ID NO: 117972 - DNA, 568 bp, Homo sapiens
  misc_feature: GYAE6OF01DW3IE.10.27.C05.1.454.CMB.1.raw
  modified_base (456)..(456): a, c, t, g, unknown or other
  misc_feature (456)..(456): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtccggtcaccatcctcctgcactggacccagcactgatggttggctattataaccttgtctctgtatcaacacgccagacaaacgccccacactctgtatttatataattcagtaacgcgccctcgtagggtttcagtcgtcttctctcgtccctacaagtcgtcggaccaaccgaccggtcccttaccccgtagacctaatcctacgtcgggcctccgacgcgtagacgacgagctagatattactcgcacgctanacttagtgtagatggtctccgttactttacgtacggtttcgggacggacggaccgaggtcgtacgaccgtctacgtacacgacccgtacggcctccgcccccgtggtacccg

SEQ ID NO: 117973 - DNA, 747 bp, Homo sapiens
  misc_feature: GYAE6OF01BOQFE.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgtggcattatacttgctctgtatcaacaacgcccagacaacgcccccacactcttgatttatgaagtcagtaacgccgtccctcgtagggtttctagtccgtcttctcgtcgccctaccaagtcgtacggaccaaccgtaccgggcccttaccccgtagaacctaacgttccgttacgtcggggtaccctaccgacgggtccttacggaaccggtaaccggtaagggtaccttaaggtaaactttaacgtttaaccgtggtacctaacggtaccttaccgtaattaacggttaggttaacggaagtttacgggttccgtaccccgttttaccgttttaacgggttaacggggtttttccggggaaccggggtaaccggggtaaacccgttacgggtaccgtttaccgggtaaccccggtttaacccgttaaaccgggttccgaaacccgggtaccccggtaaacgggtccccgttacccgggttccccccccggtttacgggttaacccccg

SEQ ID NO: 117974 - DNA, 594 bp, Homo sapiens
  misc_feature: GYAE6OF01DUHXI.10.27.C05.1.454.CMB.1.raw
  modified_base (243)..(243): a, c, t, g, unknown or other
  misc_feature (243)..(243): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatggtggntaattataaccttgtctcctgtatacaacacgacccagaaccaacgcccccactactcttgtatttatagagtacagtaagccggccctcgtagggtttctagtctcttctctcgcctccgaagtctcggaccaacgaccggccctccgtagaaccattctcgtggcctccgagcgtagaaccgacggagtctagtaattacttactgctagctatatagtagtacggtagttggtcttccttacgtttacggtagggtttcgggacgggtaacggaccgacggtcgtaccggtaccgtaccgtaacgtcgaccgacccgtaaggcccgtcccgtcccccgtggtaccccg

SEQ ID NO: 117975 - DNA, 621 bp, Homo sapiens
  misc_feature: GYAE6OF01AGBJI.10.27.C05.1.454.CMB.1.raw
  modified_base (209)..(209): a, c, t, g, unknown or other
  misc_feature (209)..(209): n is a, c, g, or t
  modified_base (278)..(278): a, c, t, g, unknown or other
  misc_feature (278)..(278): n is a, c, g, or t
  modified_base (306)..(306): a, c, t, g, unknown or other
  misc_feature (306)..(306): n is a, c, g, or t
  modified_base (546)..(546): a, c, t, g, unknown or other
  misc_feature (546)..(546): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgagggtcctgggccctgtctgccctgactcagcctgcctcgtgtctgggtctcctggacagtcggtcaccntctcctgcactggaccagcactgatggttggctattactaaccttgtctcctggtatcaacacgccaanacaacgcccccacactcttagtatttanaggaagtcagtaacgcggtccctggtagggtttctagtcgtcttctctcgcctaccgtagtcgtgacaacgccgtccctcctagacctaactcgtcgtcgggtcctccgacggtctacggaaccggacggtacgtctaaggtaatttacgtacgtgccgtagtcctactaattacgttgtaacgtgttacggtctaccctttcgttacgttaacggggtttcggcgggtaacgggtaccncgggtccttcggaacccgttcgttaaacgcgtaaccgacccgtaacggtccctcccggttccccgtcggttcccg

SEQ ID NO: 117976 - DNA, 611 bp, Homo sapiens
  misc_feature: GYAE6OF01CRMH8.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctcctgtatcaacaacgcccagacaacgcccccacactcttgatttatgaagtcagtaagcgcctcgtagggttctagtcgcttctctcgccctacgaagtctggaccaaccgaccggtccctccctagtacctaacttcctcgtacgggcctaccgaggtccgtacggaccggaacggaggctagaattaacttacgtgactagctactattaacgtgtagtagtggttctcctttacgtttcgttaacgggttttccggacgggtacgggaccgtagggtcctacggtacccggttaccgtaacggtaccaccggacccgtaacggcccgttcccgtcccccgttcggtaccccg

SEQ ID NO: 117977 - DNA, 595 bp, Homo sapiens
  misc_feature: GYAE6OF01C84ML.10.27.C05.1.454.CMB.1.raw
  modified_base (298)..(298): a, c, t, g, unknown or other
  misc_feature (298)..(298): n is a, c, g, or t
tcagcatagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggaccagcactgatgttggcattataaccttgtctctgtatcaacaacgccagacaaacgccccacactcttgatttangaagtcagtaagcgccctgtagggtttcagtcgtcttctctgcctcaagtctcggacaacgaccggtcctacctgaacaacttctacgtgggcctccgaggcgtagaacgacgaggtactagaaacttaactttacgacgaccacgtctactaactagttaggtaagtagttacgggtccgttacctttcgtttaacgtaacgggttttcgggacgggtaacgggaccgtacggtctacggacccgttaccgtaacgtcaccgacccgaacggccttccgtcccccgtcggttaccc

SEQ ID NO: 117978 - DNA, 517 bp, Homo sapiens
  misc_feature: GYAE6OF01E3557.10.27.C05.1.454.CMB.1.raw
  modified_base (505)..(517): a, c, t, g, unknown or other
  misc_feature (505)..(517): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcgaggggttttctagtcgcttctctgcctccaagtctggcaacacggcctccctgacaatctctgggctccaggctgacgacgaggctgaatattactgcagctcatatgtagatggtgccttctttcgtaagggtttttccggcgggtaggggaccctagggctggtacccgttcctaagtccgagccccgaaggcctccgccccctcggtccacctctcgttccccgccctccctccactactatcgctgagcgggctggacaggcgcagtgnnnnnnnnnnnnn

SEQ ID NO: 117979 - DNA, 667 bp, Homo sapiens
  misc_feature: GYAE6OF01DIC4L.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctctggacaggtcggtcaccatcctcctgcactggacccagcactgattgttggctattattaaccttgtctcctgtatcaacacgccaagacaaacgccccacacttcttgtactttatagaacgtcagtaacgccgaccctgtagggtttctagtcgtctttactctacgtccctactaacggttcgtcggaccaacgtacccggtcccctacccgttacggaaccttaaccgttccgttccggtcgggtaccctaccgtaacgggtccgtacgggaccggaacggaacggtacgtacgtaattaacgtttaccgtacgtacgacgtactacaagttacgtagttagtagttcggttacgtcctttacgtttacggttacggttttcggggacggtacgggtacgcgggtcgtacggtacccggttctaacgtccgacccgaccgtaacggccgtcccgtaccccgtccgttacccg

SEQ ID NO: 117980 - DNA, 609 bp, Homo sapiens
  misc_feature: GYAE6OF01DNUAX.10.27.C05.1.454.CMB.1.raw
  modified_base (313)..(313): a, c, t, g, unknown or other
  misc_feature (313)..(313): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(609): a, c, t, g, unknown or other
  misc_feature (601)..(609): n is a, c, g, or t
tcagcatagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgattttatgaagtcagtaagcggccctcaggggtttctagtcgcttctctgcctccaagtctggcaacacggcctccctgacatctctgggcctccaggctgacgacgnggctgaatatactgcagctcatactgtagtagtggtcgtccttcgtttcgtaaacggtttttcgggacgggtagggaaccgagggtcgtacggacccggttaccgttaaggtccgaacggaccccgaaagggtccgttcccggcccccccgttcgggttccctaaccgtcccgtttaccgtttacccccctaccccttcccctaccctaaccttaccgttactacggtccgttcggacgggtccgggtccgttacgggaccgaacgggtccgactagtacggcngncnnnnnnnnn

SEQ ID NO: 117981 - DNA, 605 bp, Homo sapiens
  misc_feature: GYAE6OF01BJJJ1.10.27.C05.1.454.CMB.1.raw
  modified_base (389)..(389): a, c, t, g, unknown or other
  misc_feature (389)..(389): n is a, c, g, or t
  modified_base (430)..(430): a, c, t, g, unknown or other
  misc_feature (430)..(430): n is a, c, g, or t
tcagcatagtagtgcacgaccggtgctcgatttagacgcgatcgaagggtttggggggggccacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatggttggcattataaccttgtctctgtatcaacacgccagacaacgcccccacactcttgtatttatagaagtcagtaacgcggccctcgtacgggtttctagtcgtcttctctgccctcaagtcgtcgcacaccgtcctcctagacatctcgngggcctccgaggctagaccgacgagtctagaattattacgngacagtcctactaatagtaggtagagttggttcctcctttacgtttacgttaacggggtttcgggacgggtacggtacccgtagggtccgtacggtacccggttacgttaacggtcccgaaccggtaccccggaacgggtccccgttccccggtccccccgttgggttacccccg

SEQ ID NO: 117982 - DNA, 616 bp, Homo sapiens
  misc_feature: GYAE6OF01ERKBW.10.27.C05.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
  modified_base (477)..(477): a, c, t, g, unknown or other
  misc_feature (477)..(477): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctctcactcaggacacgagggtcctgggccctgtctgccctgactcagcctgcctccgtgtcgtgggtctccgtggacngtcgtcaccatctcctgcacgtcggaccagcactgagtggttggactattactacttgtctcgtagtactacaacaccgccaagaaccaaccgccccactactnttagtatttagtagtaacgtactagtacgtccgtaccgtaggttacgggttctacgtcgtcttctctcgcctacgtagtcgtacgaccaacgtaccgtccctacgtacactactcgtcgtccggtcctcgacgtacgacggaacgacggtagtacgtagtaaattacttacgngactagtcctataagttgtagtacgtacgtcggttcttccgttacgttacgggttacggttcgggacggtacggacgtggtcctacggtaccgtcgtaacgccgaccggtaccgacgtccctcccggtcccgtgtaccc

SEQ ID NO: 117983 - DNA, 656 bp, Homo sapiens
  misc_feature: GYAE6OF01CMKA8.10.27.C05.1.454.CMB.1.raw
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactcggacccagcactgatggttggctattataccttgtctctgtatcaacacgccagacaacgccccacactcttagtatttatgaagtcgaacgtaacgccggtaccccgtaggttcgttctacgtcgtcttctctcgtcctaccgtaagtcgtacggacaaccgccggtccctccctagacctaacttccgtcgtcgggtcctccgaggtcgtacggaacggacggacggtctagtaaacttacttacgtcgactagtcctacgtaagttacgtaggtagtagttcggtccgttaccctttacgtttacggttaacggggtttccgggacggggtaacgggaccgtagggtccgtaccgggtaacccgttccgtaaacggtcccgaaccgtaccccggtaacggtcccgtaccccgtcccccggttcggtaccccg

SEQ ID NO: 117984 - DNA, 560 bp, Homo sapiens
  misc_feature: GYAE6OF01EQABT.10.27.C05.1.454.CMB.1.raw
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
tcagcatagtagtgcacgaccggtgctcgatttagacgcgatcgaagggtttgggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttggcattataaccttgtctctgtatcaacaacgccagacaaacgcccccacactcttgatttatgaagtcagtaagcgccctcgacgggtttctagtcgcttctctcgcctcagtctggcaacncggcctcctnacatctctggcctcaggctgacgacgagctagaatattacgtgcagctacatatagtagagtggtactccttacgtttacgttaagggttttccgggacgggacgggtaccgagggtccgtacggtacccgttccgtaagtccgaaccgtcccgaacggtcccgtcccggtcccccgttggtaccccg

SEQ ID NO: 117985 - DNA, 801 bp, Homo sapiens
  misc_feature: GYAE6OF01EEK93.10.27.C05.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagcatagtagtgcacgaccggtgctcgatttagacgcgatcgaagggtttggggggggtctcaggaggcagcgctctcaggacgtcaccaccatggcctgggctctgctcctcctcaccctcctcactcagggcacagggtcctgggcccagtctgccctgactcacgccctccctccgcgtccggtctccgtggacngtcagtccaccatcctcctgccacgtacggaaccnggcctagttcgtacttttgttacgtactttaataacttattcgttcctccgtggtacccagccacccaccacggaccaaaccgcccccctaaaactttcccgttttaggttttacgaacggttacctaacggtaacggcccggtccctacgacgggtacgtccccgttaggtacgtttccggttcctaccggtcgtacccttaccgtaagttcccgtcggaccctaaccgacccgggtcccttacccgtacggacccgttcgttccggtccgggtcctccggaggtccgtaggaaggtacgtcgggtacggtacttaggtaactttaaccgtcgtacggaccacggtccgtacttaagttaccgttacccggaccggtacccctaagggttacgggggtttcgggttccggggaccggggttaacgggtaacgttacgggtccggtacccggttccggtacggggttacccaccggtcccggaacgggtcccgtcccggtaccccccgtttggacccctttaccgttcccggttaccccggttccccctccccgttcccgtacccc

SEQ ID NO: 117986 - DNA, 638 bp, Homo sapiens
  misc_feature: GYAE6OF01CQ5T7.10.27.C05.1.454.CMB.1.raw
  modified_base (308)..(308): a, c, t, g, unknown or other
  misc_feature (308)..(308): n is a, c, g, or t
  modified_base (353)..(353): a, c, t, g, unknown or other
  misc_feature (353)..(353): n is a, c, g, or t
tcagcatagtagtgcacgaccggtgctcgatttagacgcgatcgaagggtttggggggggtcacaagaggcagcgctctcgggacgtctccaccatggcctgggctctgctgctcctcaccctcctcactcaggacacgagggtcctgggccctgtctgccctgactcagcctgcctccgtgtctgggtctcctggacagtcggtcaccatctctgcactcggacccagcactgatggtggctattacttaacttgtctcctaggtatcaacaacgccaagaccaacgccccactactcttgatttangaagtcagtacgcgccgtgtacgggttctagtcgtcttctctacncctacgaagtctacgactaacgtaccgcctaccctgaactaacttccgtcgtcggcctaccgacggccgtacggaccgacggacggtaccgtagtaacttaacgttactgtaccagtactactaagttagtagtaagtacgttggtaccttaccgtttcgtttacggttacggttttccggggacgggtaccgggtaccggtacggtaccgtacgggtacccgttaaccgtacgtcccggtacgtacccgaacggtacccgtcccgtcccccgttcggtaccccg

SEQ ID NO: 117987 - DNA, 1053 bp, Homo sapiens
  misc_feature: GYAE6OF01AIJ1A.10.27.C05.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
tcagcatagtagtgcacgaccggtgctcgatttagacgcgatcgaagggtttggggggggtcgacaagaggcagcgctctcgggacgtctccaccatggcctgggctctgctgctcctcaccctcctcactcaggacacagggtcctgggccctgtctgccctgactcagcctgcctccgtgtctggtctcgtgcngtcgtcacatctctncactcggacccagcactgattggttcgggctaatttacttaacctttcgtccttccgttacggttacttaccaaaccaaccgtaccccgaaaggaacccaaaacccgtacccccccctaaccgtaaccctttacgtttagttaacgttttaacttacggtaaacgttacgtaaacggttaaaccggtcccgggtaccccgttacggttacgggggtttttaccgttaacgttcccggttccgtttaccgttccgttaccgtaccccgtttacccgtaaaacggttcccggttacgggtaacccgtaaacccggttaaacccccgggttcccccgtttaacccccgttaaccgggtaaacccttaaacccgtttccctttcccgggtacggggttaccccttacccccgggtaggggtccccgtttaaacgggaacccgggttaaccgggacccggggtttaaccgttaacggtttaaaacgttttaaccggtttaaccgtttcccgggaaccgttaccgtttaacccgtaactttaacggtttaaaccgttagggtttaacggttaccgtttacggggtttcccttacccgttttttaccgttttaaccggggtttaaccggggggtttttaaccgggaaccccgggggggttaaccgggtaaaccccgggttacgggggttaaacccccgttttacccgggggtaaaccccccgggtttttaaacccgttaaaaccccgggttaccggttaaacccccgggtaaacccccgggttaacccgggttcccccggtttacccccccgggttaacccccccccgggtttgggtttaaaccccccg
